United States Patent 6,812,339 (POLYMORPHISMS IN KNOWN GENES ASSOCIATED WITH HUMAN DISEASE, METHODS OF DETECTION AND USES THEREOF) - sequence listing, part 30

SEQ ID NO: 13214 - DNA, 113701 bp, Human
atgttgaaagctgagataggccaaaagctaggtctcttgtacgagttattcaagctgtgaatgcaaaagaaaacttcttgaaggagagtagaagtgctactccagtgaatacacaaacgataaggaagtgaaacagttttcttgctgatatggggaaagtttgagtggtctggatcaaacccgatcaaagcagtcacaacattctcttaaccacagcctaatccagggcaaagccctcactctcttcaattctataaagcctgagagaggtgaggaatctgtagaagaaaagttggaagctagcagagactggctcatgaggcttaaggaaagaagtcatctccataacatgaatgtaaggtgaagcagcaagggctgatgtcaaagctgcagcaagttctccagaagatctggctaagatcattgatgaaggtagctacacgaaacaacacattttcaatacggatgaaacagccttatattggaagaagatgctaccaaggacttttacagctacaaagaagtcaatacctggtttcaaagcttcaaaggacaaactgactctcttgttaggggcaaaagtagctggtgactttacattgaagccaaagctcatttaccattctgaaaattttaaagcccttaagaattatgctaaatatattccacctgtgctctataaatggaacaacaaaacttgaatgacagtacatctgtttacagcatggtttattgaatatttttaagcccactattaagacttactgctcaaaaaatgtttctttctaaatattattgcttaatattggttaataatatactttgtcactcaacagttgatggagatgtacgaagagattaatgttgttttcatgcctggcaaaacaacattcatcttgtagcccatggataaaggagtaattttgactttcaagccttattatttaagaaataaatagatagctgccattaatagtgattcttctgttggatgtgggcaaagtaaattgaaaaccttctggaaaagattcaccattctagatgccattaagaacatttataattcgtgggaggaagtcaaaacgtcaacattaacaggagtttggaaaaagttgattccaaccctcctgaatgactttgggagttcaggacttcaaagcaggaagtaactgcagatatggtagaaatagcaagagaactagaattagaagtggagcctgaatatgtgagtaaattgctcaatctcataagacttgaatggttgaggagttgcttcttatggacaagcaaagaaaatggttacttgaaatggaatctactcctggtgaagttgttcacagcattgttgaaatgacagcaaaagatttataattatataaacttagttgataaagcaatggcagggtttgagatgattgactccaattttgaaaaaagttataatgtagataaaatgctatcaaccagcattgcatgctacagaaaaatctttcataaaaggaagagtcaattgatgcagcaaacttcattgttgtcccattttaagaaattgacacagctattgcagccttcagcaatcactaccaggatcaatcagcagccatcaacatccaagcaatgccttccaccaccaaaaagattcccattaggtgaagatgatctttagcattttttagaaataaaatatctttttaagttaaggtaggtacattgctctttctagacatcgtgctattgcatacttaacagactacagcatagtgcaaacgtaacttttatatgcattaggaaactgaaaaattcgtgtgactcgttttgttgcaatactcgctttattgcgggggtctggaacctaacctgcaatatctctgcgttatgcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtgagtggtcgccgatcgccccgagagtcaggtcctggggcgcgcataaaggctcttttcctgcaccacctaacttcgctctcggacagaacagattggtgccgtgttgcacatccagaactccactcccacccgcgcctttggtataatgcctgctgcccaaactcaggatttgctgtgggtctggggatcaataaagtgacaggggatccgtaagtggagaggcccctcctcaggaaatgcgcccgtggaatgctctaccctcttccgcagccagtcgcccctggccttcccaacctcgcggctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatccacacgtgagtcccggtttccgcgatcggggagcgacctctgcctcccgtggcgcgcggggcccccggccgcccagctccctgctcccggggctgcctgctggaggagcctgcggtggcttcaggaagggcggcctcatatcttggggtcacacttggaacagggttggggaattccgatggaatcgttcaagaatgggggtaaacggaccgtggaaaggggcagaggtgggcggatgtggagcgagagacaagtgggaaggaaacggactcagtgatctaccttggggagcaacgcccagaagggatggcttgcggagttcagcctttaaggcaatcaaagccaccattcttttacacagtaggaaactctgtgttggctcttagtatagataaaatctcattaaaaagaaaaaaaaaaaggttcatgacctgatgcgctcgccctctaggggcagaacgccctgaatgagagtgggttggcgattgcgtgggcctggagtcgcccaacaggtttgctgccaggattacaattgtctgaacagcacgaaccttactcgtttgttccatcctcctaagtcctgcccgtaaagctgccgcttcccatattttttcctctattatgtagataggaaatgataattcaaccaagggtgagggcagttggtcaaattcaaaagcagaggtcaggttggaggccttcacgccagaactgaagctggtgggagcagcaccggagctttccaacctgacttgcatattagaattatttagagagtcttcattactggccttggccaaccccatcccagtcaaactggaatctttggaacctgaacatgggtatatttgaaagcttatattagtgaggatggagaagaactatagcagataggaaacattcatacaacttctgaagacatccgaaactacagactggtaaccactggtgtcactggtttgctttattgctttgctttacttccaagatttacttaacaaatatttcagtgctttcctttgccaagcactgtgctaagaagagcaaagacagacttggtatctgcttcataaaatttacagtagaggaagagacaaatattaatttgatagctatttgaaaaataacatgtaaaatcactgccatgctgatgctaagaaagggcctcatagtgcagcgagagcctgaaaaactataaccctagtatgcaataatcagaagagcagattgtttattgtgtccctgtctctgttcttcgtgctttgcatgtattgatggactcatttcctgtgcgcagcagtcccatgaggtagttcatattctcattcccattctacagagaggaaacaagcatggaaggtattaggttggtgcaaaagtaattgcaatttttgccatgactttttaataagttccttgtttacagccagataggtaaaaagtagcaaagtggatgctgtgagggacccattctcactcaaagcctatgacttttggaggaaaggtaaaacttcagtccccacctgaatctccagctgtcctgtggtgctcttcctttcccctcatgactggatggaaactttaggtgtaaagaggactagtaaaaaggcaaatggatatgagaaaagtgaacagatttaataaatacttaagaggccaggtgcagtggcttacacttgtaatcccagcacttcgggaggccaaggtaggaggatcacttagagcccaggagttcgagaccagcctggacaacatagagagacctcatctctacaaaaaataaacagaattagctgagtgtggtggcatgtgcctgtaggcctagctacttggaaggctggagtgggaggattgcttgaggtcagaagtttgtggctacagtgagccaaaatcccagcattgcactctagtctggacaagagtgagaccttgtctcaaaaaaaaaaaaaaaaaagagagatacaaaaaaggccagccacacctgtaattccagcactttgggaggctggaggagacagattttttgagcccaggagtttgagatcagcctgggcaacatggtgaaacgctgtctccacaaaaaatacaaaaattagctgggtgtggtggtgcgtgcctgtatcccagctatttgggaggttgaggtgggaggatcacctgagcccagcaggtggaggcagccgtgagctgtgattacatcactgcaccccagcttgggcgagagggcaagactctgtctcaaaaacagataaacaaaaagagaataacaacaaaaaaacttaagaaaagtcaaaattggattgaatgtgaaggagggcagtgtcaaggatgaccagcttcctacttgtacaatcaaatggaggataattacctcttaaatctttatttgcctagcattttaagattttcattttcagactttttgttatttataaagcagagatattgagttatttaagaaaaaacttctcacaaactgtttatagcatatattaaagggaaatcttttttccacttgcacattttttctggctaaatgaatgatttgcctcttagattctagataagacagttctgtgatttttaaagtgtaagtttccaccttcagcacagtttattttagaattacctagagtggagatggcttgtctttctgcctgctaatctagagacaggtaaagataagtgagattaagcaggcagttgctgatgagttgtacctcatattgtccaggaagacaccaaggtgttatggacatgattcgcccatatagctcagtaagtgcagcaacttactgcactagaaactttcccataagtgaaattatgcaaatatgttctttgactttgtaaaataatagattacttccagcaaaacaagaggactctcaggggaggtggtaggacactaaacaggaagtgggattatgggtggagctgttcactgaggagggctggagaacaacgtggagagagatgtccacaggagaatggcattcctatttgctttcctctggtaccagataattttgctttaagacaactgatatgttagagagggaattgggttggaaatgtagcattttcccgaaacatacagtagtcctttaaaataaaaacttcctgatccttttaaactacccttcaatattttattattctaaatggaaataactttgttgttttcacctttcccaacgtctttaatgttacaaggaaaactgtctccttttaacatttgcatatattcaaattaataactatgttagtttctcaaggccactgtaaaaattaccacaaacttcgtggcctaaaacaattaacatgtgctgtctcattgtttggcggttagaattccaaaggcactatcactaggctgaaatcaaggtgtcggcagcgctgtccttcctctggaggctctaagaaagaaatcgtctttccctctttcagttcctggtggctgccgacattcttgggctgcatcactccaatctctctgtctccgtggttatgctgctttctgttctgttcgcatcaaacctccctctgcctctctcttataaggacacttgtgatttcatttagcacctacctagataatccaggataatctctctctctctcaagacctttaacttaatcacacctgcaaaaggtaacatttccaggttccaggaattaggatatatttaggggccatcattcagtttactataataactattttttatatccactcaagaagagtctcagatgtccatgaatgaaataaagcaataaatatcagattaaccctactgtttgcaaagtcctttaaatgaaaatgtcattatactttacattatactttatacttacattataagtatacattctacattatacattatactttacattatactttataccttacattatactttgctcacagaacatttatataattttatcttgtttcaggaagtacataaggcagtttatatggatacttgaaatgcaacaagataatgtaaattaaaaatagatgaaagaaaataaatgaggataagaagagaaaaggaagcaagggatgaagctctagaaaaatgaatataatcacattacttttattgatattgcatggaagataaattcttactttataaaggaagtatggcattttgttataaaatgataaaagaaccattcttccttctgtcaaacagcagcaggtccagtctcttatacaggcataccttggagatagtgtgggttcagttccagatcaccccaaagaagtgaatattggaatacagcgagtcacacacgttttttggttttctagtgcatataaaagttatgtttatactatactgtagtttgttaaatgtgcaatagcatgctatctaagaaaaggtacatacctttatgtaaaagatactttttgctaaaaattgctaacgatcatttgtgccttcactgagtggtaagtgttttactggtggagggtcttgcctggatgtcgatggctgctgactgatccgaatggtggttgccgaaggctgaggtggctgtggcaatttattaaagtaagacaacgaggaagtttgtcacatagattgactattcctttcaagaagatttatatatagcctgtaatgctgtttggtagcattttgtctgcgatagaacttctttcaatattggaatcaatcctctcaagccctgccactgctttatcgactaaatttatataattctaaatcctttgttgtcatttacacagtgctgtgaacatcttcactgggagtagattccatctcaagaaaccactctttgctcatccataagaagcaacacctcattcattcaagttttagcatgagattaaaatgtcataaatttagttacatcttcaggctccacttctgcttcttttgctgtttctaccacatctgcacttcatttcctccactgacatcttggacacctcaaactcattcaggagggttggagtccacatcttccaaactcctgttaatgttgatattttgaccacctcccatgaattacgaatgttcttaatgacatctagaatggtgaatcctttccagaatgttttcaatttattttgcctagttccaacaaaaaaatcactatctatggcagctgttttcttatgagatgtatttcttaaataatacgacttgaaagtcaaaattactccctgatccacaagctgaagagtggatgttgtgttagtagacgtgtgagcaatgttaatctctttgtacatctccatcagaactcttgggtgaccacgtatgatattgtttggctgtgtccccacccaaatctcatcttgaattgtagctcccataattcccacatgtcatgggagggagccattgggaggtaattgaatcataggtgccggtctttcccatgctgttctcatgatagcaagtctcacgagacatgatggttttataaaggggagttcccctgagtatgtcctcttgcctgccaccatgtgagatgtgccttccatcatgattgtgaggcctccccagccatgcggaactgtgagtccattaaacctctttttctttacaaatttcctagtctcgggtatgtctttattagcagcataagaatggactaatacaggtgtgttatcaaccagaagtaatattcagaaagaaatattttttttctgagcagtagttcttaatagtggacttaaaatattcaagaaaccatattgtaaacagttacccaggctttgttattctatttatagagcacattttctaaatctatagatttagaataattatttatttatttgtatttgcattttcatagatgaaaggtcttgctcggttgcctaggctgaagtacagtgggatcatcatagctcactgacaccttgaactcctgggctcaagcaatcctcctgccttggcctcacaaagtgttgggattacagtcatgagccactgcatctggttacagttagaataattcataagggccttagaactttttgaatagtaagtgagcatgtaacttaaagtcaccagctacattagcccctaacaagagagtcagcctgtactttgaagttttgaagccaagcatcgactcctcctctctagctataaaagtcctagctgacatcttcttccagtgtaaggctgtttcatctatatgaaaatgtgttgtttagtttagccactttcatcaactatcttagccagatcttctggagagcttgctgcagctttggcaacagcccttgctgcttcaccttgcacttttatgttacagagatgactttttttttttttttttttgagatggagtcttgctctgtcacccaggctggagtgcagtggcacgatcttggctcactgcaaccttcacctcctgggttcaagcaaattctcctgcctccgcttcctgaatagcagggattacaggtgcgtgccaccacgccctgctaatttttgtgtttttagtagagatggggtttcaccatgttgtccaggctggtctggaactcctgacctaaggtgatccacctgcctcagcctcccaaagtgctgggattacaggcatgagccaccatgccaggcctgagatgacttctttccttaaacctcatgaacaaatctctgctagcttccaacttttgttgcacagctttctcatttctctcagccttcataaattgaagagacttaggaccttctctggattagactttcacttaaagaaatgttgtggctggtttgatctatccagaccactcaaactttctccctatcagcaattagtctatttcactttcttatcatttgtgtgttcagtggaatagcatgctacgtttctttcaagaacttttccttcacattcacaacttgaatcaagaggcctgcttttgatctatcttggctttcactgtgccttccttgctaagtttaatcatttctagcttttgacttaaggtgagagatttgtgtctctatgtttcacttgaatacttagagactattatagggttaattggcatactatcaatattgttgtgtctcagagagtggagagggccagggacagggagagagatagggaaatgggtggctggtggagcagtcagaacacacacaggatttactggttaaggtcaccatcttatatgggcatagttcatggttctccaaaacaattctgatggtaacatcaaagatcaccaatcacagatcaccataaccgatttaataataatggaaaagtttgaaatattgtgagagttactaaaatgtgacacagagacatgacatgagcccatgttggaaaaatggcaccaatagacttgcacaacctggggttgccacaaaccttcaatttgtaaaaataatatctgtgaggtacaataaagtgaagtgcagtgaggtatgtctctaactattaaattatccaaggaaaaaattattttgcattttatgtttcatatttaaaattttgtattgaagtttaggcaatataataataaacctcaaactatggaagcaagctgttatatattttgatttatgatttttaagagtattattaagactattcatacaattttcaaagttacctcctgtagttttgtttcctgtttaagtaaaggttttgaaataggtgatgatgcatattttaggtgaagtcagtcatttgcaacaaatcatataccactgttttattttaaattattttaaaatctaattatacaaatggcagctgttgtagtagatgggaacatattttgaattgccttccctgttatacaccttattaattatctgggtaggcagaatctgagaatttcttcaaaaacttataagcaaaggagtccatttttgtggcctataagaagatgtgctacttagtaatttatagtaaataataaacaaatacttcagcagatattgattcattaaatattttaataaatacttattgattactgcagtaatagcaaatatttgacaagcacatactattgggagggaaaagggcatagtgattaagatcccaggatgaaggtaaactgcctggattttaattctgacatgttacttaccattaatatgaccatgaacaagttattcatttcactcaatcttggtttctacatatgcaaagtgaagatagtaatagctccaatatcataggattgttatggggatttaacatgttaatacaagcaaagtgcttaaagcagggcctagcacatggtaagtagtatataaatgtttgctgttgcttttattagcatatgctgaaaactttgcatccattattttatcaaaaccttataataacatcatgaggtagatacctttacttttaactcattttataaacagggaactacgagtcagaaaaattaaatgaagaagacaggattcaactccaagtttaattgagtccagagaatgagcttaactactatactgcactgtgccttaatgtgtgctgtgccacacgtgcaaaggggaagctaagatgaacttgacatggtgtcatcttttcaggaggataggcaaaaaagagttgagagtcgttcctgtgggttaacacctagaactaatgagaggacatatttccatcccaatgggattttttgagtgctaatgtgctaattagagctaattcacattgagggtgataatagcaataacattttagtgtttttacaaatgtcaaataccatggcatgcacttttttaaaaagcatgttatttagtcaggtgcagtggctcctggtactttgggaggccaagacgggaggatcacttgagcccaggagttcaagaccagcccagacaacatagcaaaaccctgcttctacaaaaaataaagaagtaaattgggcatggtgatgcatgcatgtattcccagctacttgggaggctgaggtgggaggattgcttgagcccaggagtttgaggttgcagtgagctatgattgcatcattgcactctagcctgggctggacaaagtgacaccctgtctaaaaaaaaaaaaaaagaacaaaaacaaaaaactccaaacatgttatttaataagtacaacaggccgggcgtggtggcttatacctgtaatctcagcattttgggagcctgaggtgggcggatcacctgaggtcaggagctcaagaccagcctgatcaacatcgtgaaaccccctctctactaaaaatacaaaaattagctggcgggcacctgtaatcccagctacttgggaggctgaagcaggagaatcacttgaacttgggaggcagaagttgcagtgagccgagatcatgtcattacactccagcctgggtgacagagtgacactctgtctcaaaaaaaaaaaaaaagaaaacaaaagaaaaaaaccaataataataacaaactcacaaggaaggtaacattttggttttacagatgatgaaactgaatgacagactagttacacaacattctccaactcatacaacttggaagtgttggagttgggatttgaaatcagaaagtttgacttcatatcttgagatttcaattaccattctataggtactttgtatgcacaagcagtcagtgtgcaaagttttaaataatggttttgctttattttctatatgatcaaagaggctttaaacgggcagaatttaattgtacagttcatttcatatgtgggcagggtctaagtctgggaatatgaatgggactggagatctttaagagtaagccttgcgacatgtcaagttgcgggtggaggatgctcatttatcaacagcttgctatttttgttctgttttcaagatgaagaattctataaaaatcacatgacatgtgattcttaaaccaatacagaattttatcaccagctcaaacaaaagtcagttcagatatgttattccacttggtgttcatccatattcagtcatctcaggactttaaaataaataaaagtcacaggctctgcatgcttctttccagaaagtagaatctgtattctttagatgctggctgaaagggctaatttcaatgagtaccccaaaaaagaaagcattttattgcctcatgaacattataattacttgtttacacgaatatgttttattcatttaaccatctcccaaccatactagcagaataactactttaagaaaatacctagtaaaactgttgaaaaaaatgagccatcaatggatttgtccttaagcgactctagccatctctgtgttgaattttcacggtttgaagcagcaactgcagaaaagagggcatctgcctcagtcattgatcagctggcatgctctccatgcaggcagaggttcaccattacttctgttgtgaaatgtccccaacaacaccgtaaagccagtcacttcttcaatttactgagttaagctgatcatggtggtgagtgcttatagtcccagctaatcaaggtgctgaggcagtgggaccacttgagctccagagttcaaacccaggctaagcaaaacccctgtctcttaaaaaaaagatatatatatatattttaactgtatatatatagttttgtatacatatataaaactaaaagaaaaaagtaaaacaagaaaaaatttactgagttactacacagttaagaacacataaaaggtgacctcaaaatgtggatattcacatctgtcatcctacttttcattgaatatttaagcaataaagtgtaatgatttgaaatatatgcattaaattgagaagcattgttaatgtaccagggaaggcaggagaatattttaatgaatttgaaatggctaaaaggaagctttgggtcctcaaggaaagatgaattttaagcaatttctcacagtgtgaatcgtttataagtgatgcattttgatgcagaggaagtgaagttcccagaataaaaccacaaatctccaagaatacccttagtcaccaacatattgcttctttctcaaaaggcaaaaatctagcactttgctgtagccagatcatgtaccacacatgaaaaatgcatgtatatgttacacctcatctccaaacttacctatggttatttgtatcttatacaaattacagtttccctgacatatatctaaaatatggaaaactcttcaactccttggaaatacatttttcttataattagacatttcttttgtccattaatagcaagagcgtcttgtcaaggatcatggaagcagaactgattcaagattaaaaagatccgtaaaagtcacatgagatgtaattcttagaaccagtatagagttttatcaccagctgctaggaaaagtcagttcaaatatggaatggttcaaatatgttattctacttggtgttcgtccatacccagtaatctcagtattttaaaataaataagtcataggatctgcgtgcttgtttccagaaagtaggatttgtatcctttagatgttggctgaaaggactaatttcaatgagtacccaaaaaaagaaagctttttattgcctcatgagtattataattacttgtttacatggatatgttttattcatttaaccatctcccaagcatattcacggaagcagaactgattcattcaaaagaaaaagccaatttgggatgggggtagtgggaggagatctcttcagatctctcagttttaaagtctctgatggttggatatttgtagtttttcactgatttttctctctgcataaagagctaatagctcattgtctataaatattttccaacattttgttttccaaaatggactcatttctacataaagacgtcatggaaagatggtttttcttcctgaagggttaggtcagccctgggaagaagtatagaccttggctcctgttattcctctttagatatcccagggttccaacaggaagttacaagatacctgcactacctgtaaagtttatttaaaatgattggaaggctctcataagcattggaggggaagaaaaactttttttctaccctcttaggtgaagtgcctaggagcctgtgaattaaacttacagcagacagactagcaggagaaaaagcttacaaagttatttattttaaattttgcttgcacaagggtgtcatagaaagaaatgaataccccaaggagtgatgagatttgattttctgtatcattttactacaggaaagggaggtggagaaaaggcaatattgagagagcaaatgacttctttaaaaaaaaaaaaaaaagataaatgggtccttaggagaatagatgggagatatgacagtttgtgacaatgtctagaagagaagaaagagttgctcccagtgggaggaatttgtgacagctgagttcttttgggaacctctgcttttagtcagataaaggatttcgggaactcaaatgccttcagctcaaaataactcttatgggctgggtagggtggctcatgcctgtaattccagcacttttggaggccgaggcaggaggactgcttgaacccaggagctcaagaccagcccaggcaacatagcaagacctcgtctctactaaaaataataatttttaaaaattagccaggcgtggtagtgcatgcctgtagtcccactactcaagaggctgaggtgggagggtgacttgagcttaggaggtgtttgtcccactgcactccagcctgggtgacagagcaagaccctgtctcaaaaaacacaaataaaacaaaaaacaaaaaaacacctcttatggcaaagtggcatattttggggtggaaaacgctgattcctttcagcacgcatcatttgctcatgttttacccaatatatgaagggcattaccggaaaggaaaatacctgtttactcttggcctactgtgtatctggtgtggcttcattcatttataagatgttccaccaggctcttgtagcccattctcaacaacagtagccttcaaagaaggaagtatattctgagattaggacttgtaattttcacgtgacaatttagagaatatgtagaaataagaatacacattcagaacgtgtttgaaatattgttacaaatgtttctgaatttttacaattttcaaagaaacctgcatgtagaaaatatgagggtgctattcatcagtcagaagacatgtgattacatcgtgcagtgcttaacacatgcactttacaggtcctcctaccagtaggagaagacaccaagactccaggtcctcctttacagaagtcattgtggcatccacagggtaggaaagccccatactcagcagtgagcaattttatacatttgcaaagcaaatcttgtactaaaaaaaaaaacaaaaaaatggggtgggttgagtaacagtaaactatcataaaatatacatctgaaaagagattcagacatactttagaaaagaattaaagtcacaatatatttgccacctcgaattaaattcatttgattatggggttggtgacttctttcattaagtgatggggaaatagatcagttctatcaagcactgccagtttatcacttactatctcaaatctttcagttagacacaaatagaactttgtatgacctttgctaatggagagcaacagtagaaaattattcatcccacgttttgggtacttactattaaatatgcttgtttgcaatgacctaggaattcacaacatatgcaagtacaaaacctaccttattgtgacatctggcctcaggaagagaaagaacttggtgccagtgttctttgactcttgacccatcataacgggctcagtaacctctcccctcagatgattccctgagacccaccacagggatatcttctcttcttagtaccctcttctctgagtaccctcacccctcaaatgatatcctgagactcacctcaagggggatcctctcttctcagtcccctctcctctcaaatggtgtcctacacctgcctctgtagaacttgcttctgtccttctcagatttttttttttttttttgagacggagtctcgctctgttgcccaggctggagtgcagtggcacaattttggctcactgcaagctccgcctccctggtgtacaccattctcccaccccagcctcccaagtagctgggactacaggcgcccgccaccacgcccagctaatttttgtatttttagtagagatggggtttcaccatgttggccaggatggtctcgatctcttgacctcatgatccgcccacctcggcctcctaaagtgctgggattaaggccttctgagatttttatttgttctttttatcccttctcccatactgagggaaaataaatgttttggtttatgtagtaggacctgttatgtatgtttcaaacataatggccccatataatagctttgaatttggattccgttagagttggaaaaagagaaagtcagcactcacttgcatgtgggcgctttcttgctccctctttctttgtgccctccccttcctctctctacccctgctttccacctccctttctctctctctctcaaagtaccaagtccagtgctgtattctcagtgctcatcttcactgacctattagcatatcttggcggggttgcccactatctgctccttaaagcactttgttcacttggttttcaggatactgaacagttctcctccttcttctcagtctcctttgctagctgctggcctgccccaaggatccgtccttggcctgcttcttctttctatctacactagcactgtttgccatctcatgactcatgattttgaattggatccatgtgctaacaactccaaaatttatttttcctgcctggacctcacttctcaacttcagactgcctacatgatacgtctgcatgggtgtctgatcaacatcttgaactcaacatgtctaacactgatctcctgagctccctcctccaaaatatccctagtcctcctaagttcatcctcatttcagttaatgacaactccatttcaaatgcagaagcccaaaacctatcatccacggtttagctttgttttccctccattataccccatttccagtctgtcatgccagctctactttcaagatgtagccagaatgggacagcttcctaccacctctgctggtattgccttggtcccagccttccttatctcccatgcgcattactgcaggagcctcctagcaggcctccctgccttggtcctggactgccttcactccattctcaacatagtaaccagagtgatcctttcactcatggtgtatcatgacactccttcctttgaagttctccggtagttcttcaattcacacagaataaagggcaaagaccttacagtggcctttccttcttcctcttttatttcctggacctcatttcctaatgctctctcccttaattcccttcgcttcctcttaggaacctttgagtttattaatccctcttcttcaagacgcttcctcagatatcttctgggcctgcttcctcactttctttggttttttacctaaatattgcttgtcagtactacccttagatctggcaactggacccagatctgttgggacagacagttatctctgggtttgtcaagtttctgcacaacacgtattctgatcaaaggtatgaacagctcattttccctggactctcttttccaggtatttgcatgtcactcacagcaatagcagtagccacaataacatcattctaccagttctctgaggctcaattccaaaaggatgtgacaaggggcaggtattgcctattaatgcagtcaggtgtgttacaggagagtaacactgaggttaggaaacaccgagattaggttgtgtaggggctattatgtagcctagaaaaatagaaatttttctcttaggggcagatttatttactatccaggataataaaggtgataaagaccagatgttgggcagatttgctggtagctctcatataaatcggagtttcctaatctcagtgttactctccagtaacacaccagcctgcattaacaagtaatacccagcccttgttacatcatccttttggaactggggctcagagaactagtacaaggatgtttctctggctactgctattgctgtgagtaataaattgtcttttgtctatgacccagaagtcttgtgtcttctgccaatatccatgaaactggcaggccaatgtcttggcttgcaagtagggtaaaattctgacccttcttatttctaacacctgttcagagcctttggttttagagagccccactttagccctcttctagctgagcctttgtttagagtgagcagctcgtaggctcacctataacctgtgcctcctcttctagaccatgttctggtatctgagactccagaatcccctttccaaacagccctgagagtgttaccaggcatccatgagcctttcgtgggtagactatgctgccagaatgtgtattcctcatcccaagagatgaccaagggctggctgattttgggggtggcaatgagagtagcttgaacacacaggctaggaaactagttctcaggtgtgattcctcgaccagcatcattagcttcacctgggaacttgttagaaatgcagattcttaggccccacccatttctgtttctaccaaatcggaaactttgagaatgagccatttgtgttttaacatgcactctaggagattctgatgcccacttatgtttgatgatatgatgtacactcaacagactaggttatccacatacatgtgcataaggcgcctatcaatgcttgtggcagacagaccctaaggtgacccccagtgatttccagcttctgttattgatattcttgtataatttccctagttagagcatgggcaagacagtaacttgcttccaaacaacagaatatgacaaactgatgggatgtaactcccatgattacattacattaataagacttcgttttagcagactggagctgaggccctccttgtgggtcgatgaagtaaacagtcgagttggagaaacccacatggccaggaactgtgggcagcttctagaaactgggtgtcttttaggacataaggaaggcaacaaaaacctggttctttagttttgtgcctccagaaagtgagttctgccaacagtctgcatgagccttgaaacagttctcctctggtccagcctctagatgagagtgcagtatggccgacactttgactgcagcttcatgagaccctgggcagaggacccagctaagctgtgcctggatttctgatccacagaaactctgagataataaatatgtgttgttttaagcagctaactctgtggtcatttgttatgctgcatttgaaagctaacacagggcagggctccgtgtgagaggagaggatgggatgtatatttttttttgtgctcttgccttgccttgggttctgcaagtgttggtgatggtctgtcacggcccttctatttaaaacggtacccttcccctactgcctccttccctccctccctcccaccttctttctcttctttctttctttctttctctttctttctttctttccctttctttctttctttctttctttctttctttctttctttctttctttctttctttcttttctttctttctttctttctttctttctttctttctttcttctttctttctttccttccttcctctttccttcctttcttcctttcttttccttccttctatccatccatccttccttctttctttctttcctttttctttctttcttagacagagtctttctcgtcacccagactagagtgcagtggtgcaatcctgctagtgttaaacttctggcctcatatgatcctcccatggcagcctcccaaagtattgggattataggcattagccaccacacctggcctggatttttgtgtgtgtgtgtgtgtgttttttttttagcagctatttccctctttcatgctatatatatatatatatatatatatatatatatatatataatatatatactatatggcatgaaattaggtatatatatacaattatatatataaatatatataattatatatatataactatataataaactatataataaattaggtatatatatatatttattttcttcattgtctcttcccactccttctaaatgtaagttctacaggcccaagatattttgctgttggtcactgcttactctccagcacctagaacagggcttgacacacagtagaggttcaatcagaatttattgaataaataaagtaagctataatgtttttgaaagtctactggctcctggtaaatgctccactgaaatcaacaggtttttcctactgtctttccttattattaggtaattgcatgaatgataaaaataaatgagaaggaaataatttcaacaaaggagtaagcaaatgaaaaaatgtacttcattccctgcccttcccccattaaaaataatacattgactctgggtttgctgtttttacaagaccaattggtttatcgatcaatattgcaattgaatgtaacccttaatttctatcagcctgtctcttctcactccctggtggcctggctgctgtgtgtttgtgtgtgtgtgagcacatgttcacagaaggaatccaagaggaagaaaagtccaacttcctataaatctgtgccccattttcctttctctcttttcttaattacaaggctgtttctggctcaatcatttaagccaaagaactttccgctttgagtcaggcacacggtccaaggaatggtttatagagcagcttggttgtcctccctattgtaaatctaaatttttgtctgggtaattgttttctgttgttctctgccatttttctcttgattaaaccctttggagaggcagcctgatgcagagagtgccctggcccaagagccaggaggtgcagcttctgatcttggtttcaccaccactctgccactcccttctcaggtcctctgtttgctcacctctttcttacccaagagggttggattagtcgcccttggagatcctgcccagctcgttcttaagaagcctgtttaaactccttcaataggtgatgctttttaaatatatatatatgcgtacatacatatatacaaatacatgtattaagctattccttaaactatgtttgcttttttatttcctatgaggaaagtctgcagtcaagttagatattttcatttttttaagtaagtcctaaaatgctattctagatgctgatacttctcgtttaaagaatgactctgcatactcacataagtaatttctccaatctgagatgactgtggtcatacagaaggaagtcaggatgaagaacacagaagaaagcaaactaaagggcctgtcacataaagggatcctagtctagtgacaaagagcctacatgttgtcacaaagatttggattcatttcccagtgcagtcccttattagcgatgtgacctttaacttcctcaagtctcagtttgctcatctacaaaatggtggaaatggggggccctcgatggatcttgtgatgattgagtggcatgatgcagatgaattgcttatgactgtgcttgggtactattatggcaatgaaagagaaaagcgagattcatttatcaatttctcatgaaatatgcatttaatatcccctgtgctgggccctaaagtaggcactagtgaaacagacacgaaagaaccaaagtcctttcctttgtgagtttaccaccctattttcgttatagcagttaggtgtcaagtaactatttttaatgcattcttttacccaaaaatttgttgtacttttgtatgctacctaccacaaagttaaaaatagctttctggagctaaggaaagatgagtaggttgaagatagaaataaatatgtaagttgacggaatttggctatctggcctgcatgcaaatctgaagcatcaattgtacctactaaaaaagaccgaaattttgctaatgagacaataaatgttttaaatggttgctgcttttggtccttctttatttactaggatgaaagcttaaagatttgcatagcagatatacaaagcaatgttcattgtttggttacattttgaggaagaacaggttaaatgttttgcttacatttgcattgctgctttcaaaataacttagtagagcattggggaaaatgccagcagtgcttacctcttcagttagcagatcctatttccggtctcttgtggcttggatgttgatgataacaagacaggcttgctgaaaggagtgcaaagtgcatggggaagggtgcatgtcctccatggcaggactttgacaatcctggtgtctgttgcttaacaccatgcttcagacctctaactgatctgatttcagctcttgccattttaggtatttcaaaaaataaggcacaaaatgaaagcttttaatatgtttgtgtttatttacatatatatgtgtgtgtgtgtgtatcctatcattatctatcacctttactctgccttatttttcttcacaaactatgacattttatattatgcataatcatttactttttctcctagctagcatttaagctccttgagggcaggggctttgattgttttctttattgccgtatccccatatctaaaacaatgactgttcatggagagcactctataaatacatgcggggaaaacaatgaatgaatgaataaatgaatgaatagtattgagtgcatatagcattatatccaaccaagcaggtggtagcagcatggacgtttcaacttttataagaaatgaatagtttaaaaattttataaattattttaaaagctcctaaaattaaagaaatgctagggtgatagaattttcagtactctaccactggtattaaatgttgttcccaacactgaaatcctgaagacaattttaagcttaagagtccaagtgtgtcaacataaagatagaatctagggtagaactaagttacccttcttaagaaagagaggaaggggaaaatatgggaactggggaggaaattattcacaaagagtgagctccagaaggaaaaataaatagggagagaggacaatatgcctggaggctggagagataaacataggacaagagatgcttctaatgttttcccaggaaatgctataaaccaactcctagcttcccctatgaaatgattagtaaattctgcattgctcattcaaacttttatgggattagagttttgttatgggagaggttaaaaggaaagaggtcactggacagctgatgtatattttacaaagaaataggtattcattttctccctgtctccactaaacaaatattgaggaaattcttacagactatcagcatgagatatgcagctgagccatatgttttgagtgtccctgttcttctgctgtcttgatttggaggttccaacatactagaagagatgaaaggggacaatgtagccgaatcccatggggatgatctcttagattgccatggactcttaagcttaaaattgccttcagggtgattttcagggtgatcacagaccttggattggcaacacctgttcaaattattttaacctggcaaatcaaagcctcatttatagaaataaaaatgacaataatttggtggcattttcttttataatgcacatgtggcctgctctacttagctagttcatcgagatttatgagaaaacatgtccgtattcttgttgcttaaaaacattattctgcatgttgcaagtagtcactgaactcaacttgtaaaaggctgatttccttccctgaatgtgccatctccccaagtcctcacttatagcctgctagggtttgaaatattgatgagtacaaatccattcatctccaaatttcagtggcctttcaatggagagtatttttagctttgttgagaatttggggcagaggaaatcactttcagaaatagcagattattcttttagttttgtagaactcgagatggaatctgtaaaatgaatctttgagtccttgctggccttatactaatacagtagtataagatcatttctgtgtaagtaactgagagagtaatttaagagcgtatcctttctgcagaatctaatcttaatacaaatagatgttaaaattccgataatcaactgtttaggtcctgtgtgaatactatcatatattattaaactatctctggcagcctgatgtggtgactcacacctgtaatcccagcaactatgggaagctgaggtaggtggatcacttgagcccagaagttcgagaccagcctgggcaatgtggtgaaaccccatctctacaaaaaaataaaaaaattagctgggtgtgatggtgtgtgcctgaagtcccagctgcctgggaggctgaggtgggaggatcacttgagcctaggagaatgaggctgcagtgagctgtgattgtgctgctgcactccagcctgggagacagagccagaccttgtctcataaataaataaataaatgtaaaaatgaaaaaagaatctctgtcatcttaatggatacagtaacggctgctacttagctttttgagttttgagatacattcacccgtacattggtgaagtccactcttgatcagacttgatggctagctcatcattggccattttctcagatttctaatcttccaaacccgttttctacgttccctaatttagagcacttgctcagctggttttgtccacctgcactgctgttaccctcatttcagcttgtcagatctcacccatattgttgacagtgaactcctgatttttcccctggaagtcatcctccttttttttctcaactctcacagcatttttaatctttttaatgtccttaaaaagcagcatcataatttagagttggagaggacttaatgaatgttctaatacaatctccacattttgtagctgtaagcacttgagggatgaggagattggcctgagctagtatcttatacatgggaaaaccagaaaaagaactgaggttttcttactacagccctgtgatcctttctctgtattatcagcccttcaccttctgcagcacattgcagttattcatccatatgtcttattgaagagactgtttagaggcttatttttaattaaaaagttaacatttttaaattaaagtttcaggtttagaaaatttccacttttaagtgaagcttgcaagtgttatactatttataaaattaacaaaccattacttttaaagcgactttgataaatatgatatttaaatagtatgatattaactgatatacacattcaattaatatactcaatttcatatttaagcacttcaattttctatttgactagccttcctaagtacttaaatcttataaatttaaaagctaagtatataaaaagtgaatctaaaaattctctttagctgtttcaatattacttacaaatttagtaacatttccacttaaaaatcccaagtttaagccattaaccaaattaaacatttaaaattataattataagcctgatagtctctcaatagaccatattctttcgatcataatataaaataacaaatattcaagtgccttgtcacaaaacgactagttctatgattttgctttatttatttcttcattcaataattatctaaaatatacctgtgtgccaggcaatactctaggctctagataaacattagcaaacaaaataaaaatttctattcttgtgaggctcaaattctaaggaaggggcaaatagtaagcaacataaattagtaaaaaacataggccaggtgtggtggctcatgcctgtaatcccaccactttgggaggctgaggtaggaggatcacaaggtcaggagttcaagaccaacctggccaatatggtgaaaccttgtctctactaaaaatacaaaacttagccaggcgtggtggcacatgcctgtggtcccagctactcaggaggctgaggcaggagaatcgcttcaacccgggaagtggaggttgtggtgagccaagatcacaccactgcactcccgcctgggcgacagagtgagactccatctaaaaacaaaacaaaacaaaacaaaacaaaacaaaacaaaatatatatatatatatatttgggtaaatgttaaagaaaaaatcaatgaaggcaggatgtgaaatgtgagggatgggtggaatggtggttgcagatgatgctacctttttctaggattaatactctgcacaaagaccttattaattaatttaggctacttcccaatagagaggtgttacattctgagtacacttgaggttgtacaaggactggagatttggcttgttatgttgactggattcccactggtgactctggtgaatactctgaacttattattgtttgtccacaactccctgacttccaaagggaaacttgtagccctacattatttgattggattttgtatgtctttggctcttaaaataatgtaaacagacttcccacccaagtggaactacctttgacacagccctgaagtccttcagattcttcagaccactcagtcttaacagacatatctggctgaattctgggcatccctcttggttttgtcctgaaatgtggacacaattttcccagtcactttcctgattaattttagctctccaagaggatggagaacttcaagaggacaaatactattatgtcttagctctgttttgtttctcatttattactgtgtcctgcagaacacaatgggtttacccaagtagtccctcaatacatgttgtttaaagcagaatagtgcagctcaatgacatagggtcatgtcccactcagcctcttgattgcaggcaactgctcaaaaactggacttcctcaagtgtgaaaaggaattataagaatccctatgtgtcccaaagcactgtctaaactaagaaccactctatgaatgctagttttccttactattaatggtttaatgcttattttaaaaatccctcaaagcatttcacaagcagatagtccctttccctttgtatttaggcttcaggataatatgagcggtaccactgttttatttttacaatactgatcattttatcatgcctgttgtatattcaggtgtaagttctttttcacaggatagcttcaatatgtcaggatgaactttcatttatttattttcattcaatagaactaactaaattctttttctgttcattcagttatcccactctaaataccagggttctctttatagatggaaatgtgaagaaggcagctcttacttaaagggagtttttttctgctctcatgcactataccattatttgggcattctaaggaaaattcaggagtggttttttaagagggctgtgttgctctggggagcatcatcttgacaatcttgttaagggagggtgtttgaaagccacttcaactagaaaacttactttctacctggagtctgagtgcacctgtatccatcactggacggaactctgatgctgtcctgacaatgccctttcatgaccttaacctgtggctctggtcatcactgttcctcagttctcactctatcacatgggtaactgttgtactcagaggctttgggagtcctcaaatgtctcactttccctctgtcattttaaaaactgctgcacagcccttgtttatttctatgtaattattacttcatcatatatgatgttataagccaatttgattcttttttggggagaaggtggaagcgaaggaagataggaaaagaaagtcaggctcgtactattacattttcacagatttatttgaaattgagtctttcccagaattatctaccacctcttatggtcagtttgacacagttaatgccaagcacagtttataactttttaaaattgatcaaaaattaccctaactttgaaggtcctgaaattactgacacatataagaatttgcaaattaaatgtggcacacagtttttaaatatacatttaccatacacacacacacatatattatatatacacacacacacacacacacacacactcacacacacacagagagggagagctatttagccttttcttgatagaggacgtaaaggagagtgttaattaccccattctggagaattcaacttacaatggaaaacatgaaggagagctgtttaacatctgcataaaacacttgtttcctggtccttctaatgatgcattcaggtatgaaaaatgttttctatttacttgttcagaattattttaaataaaggaagaaaatcacagcagcttcctgcttcggaggcccacagagttgcagccaaatgacttgctattatcataggtctttatgtttgctgaatgcttttcagtatatctgattgtattcacagccctttctggtggcatgaaggaggctggtgttgctcttgtgcagattacaaagctagaaccagaggaaggggaagaaatgatggcttaaggcattcttagaagttgggttcgagcctacagtttgtttttctctttaagatctggaaaggtgaagaatctgatggcagtgaacccagtaatgaatacgatgttaatattataatgttatttattttatttacttatatactatagtaattaatttgtagtaattaagtagtaaacctgataatatctgatctaaatgattagcataaagaactatgtcaagatcaaaattcaggatgactaagaggtcagaacataagatactcacgcagaaggatgtaggaataaccaagagaactgaatgacctctctaagagcaccaagaaacatttacgccaggatacacaaagaactaagacatttgaggggtttggcgatggtgtcaagaggtgctcgctgttttacattattatgtatatgctgtccattttctagagagcatagagatagaggaaacaaaactgagacttaatcaacatcatgggatttaaatatcaaactatgaacagataaagaatgcatgtgttttacacgagtactgaggaaagacctaaattgaagcatgtgttattttacgataatatttatttactcacaaacatttggtaaacatcttccttgtgctaggccatgcatagattctggggatacatagtgtttttctgatgaactagaatggatgctaaattgtatcagcacagataactctgaatatctaggacttgccagtttacattggcgtggtgcaagccatagatctttggacatattgtcttctcccagatcatcaaaggccaagattttccaggataactgggagcaagtcagtattagattctgcactgactccacgaaccaaggtgtttcagggatattaggataattttagggcaatggagtttgatttggaaagttggctttgcacagccactccccagatggccctggtctagatcaccccttcatgtcagtttttatggacaaggcttcccctcggatacctctggcattagggaggcacagatgtacttctctgcagctgtactttctagaaaccaggtaaggataatgaccaagagccacttgaaaggcaggtaggtatagatgatgagtaactgcctggggccttttaaaagctaatatttataaacatatattacttggctgggcatcatacaaaccaatttaaaccaattctgtgctttctctagggcagatgtgcaaacatcagaagcatgtagagcccagggaaagcatgcaaacactgatcaagtgcacagcgctgtgtgacttttgtcacttttcatgatgtataagcacagctgccttttttaggaatcgtgagctggagtcgtgagcaaagtgttgcaggagtagcatttttcaggagagtgaggtgctgatgagtgttaccctctctggtagtcaggagaggatcattgagggggtggtttttgagagttggtttaaggtagaaagggagggaacctgccatctggaagtgtgatgatgttccaggcattgggtacagcttcttaaagtggcctttgcttctggagtaaatgaaaaaaggggacatttagttaacttgactgagagaagctgagagagccaggctgttgagagcacttgattagctgtcagataccattctccctacagtttcttggcctcccagccctgaagaactgtcagtaaatattgccatacaggatcgattccatttaatcttttccaaaccacaactgtgcagtaggtgatggcatcatcatttcacagacgagtaaacagaggcccagggaacttaagcagcttgtgtgccaagtatttaaaaattactgtgtgtttacatatcacatatgaattcacacacacatagatggtggggattacgaatgcaaggaatgttattttttgagtcctttattccagtcacagtattataaactgtgaggacagccaaaagacaaattccccttttttgaggaatttccaatatgaccagtctttatacaataagtaggaatgaaaagaataaaagcaacattaaaaatgcatgaagaacactgaagcacccagaagatttcagtgtggccagcctgggacagggctatgcaggagaacttttgagcggtgagattggagccagtttttgtagttagaaatggagaccaggtgtggtggctcacacctataatcccagcattttgggaagccgaggtgggtggatcacttgaggtcaggagttcaagaccagcctagccaacatggcaaaaccctgtctctattaaaaatacaaaagatcagctggacatagtggtgtgtgcctgtaaacccagctacatgggaggctgaggcagaagaatggcctgaacccaggaggcggaggttgcagtgagctgagattgtgccacttcactccagcctgggtgacagagcgggactccatctcaaaaaagaaaaaagaaaagaaatgaaatgaaatgataggctatatgtattcagaagaagcacagatagatgaagagtgcccagtccgtgaagggccttgagtagaagcacatgatgtagttcatattctcttcatgactcaccaggttcttaagggaagtatttttaatgaaaacgatgaacaaaaagcatcacgattacatgagattagaactggaaaacataaaatctgtgaaggtgactaatataaaacaataagaaagagatcaacttttagcaaccttttttccgcaaagtccaattcctggcaacatggttgacactgaaatgttggataaacataaatggaataaatggattatgatagtgattgggaatgtatacgatatgagctaaaatatagattcttgatacagaagagacatattgaaagaaaaactttgtctaaaattaaaaatattaaattattattgtctcagtaaaatctggagattctatggggagatagggagagcatctatcaatcagggtccagttgcagaggatggaatccacccgtctattttaaacaagaaggaatttgttacagagccatggtaagtgggcctcagaaccattgcacagctgaagtagtagactctaaactgagctttcatgaacaactctcaaactcaaagctgctcccagaactggggccccacattgatgctaccatagcaacttattaagaagctattaggatcaggaaggcactgccatcaggacctgcctcggcaccaaggagtggatcctttcatcggctccataactgctcctgtctgcactagcaaaatggatgggatttttttgacaccacatagttaggggcagaaaactgggacctcagccacagaaaactgatgcctccaagactgtgcttgactgtaggaacagcagaagtggctgctctctcacaaatctcttaggaaggcatttcactgaccaagccaaagttaccttttggtctgtggctccaaagaggccagcttccagcactttgcagcaaaggcaggtatgtccacacagagagggagaagcaatgtagcagcaagtatctggaaggaagaaatagttggtattttgtttgcatatgataacaaacactggtttcatttgattcctagtattaggcattttgttttcagaacattttaatacaattatttgtgaagggaaggtaacaacttatagaattgaaaacaatgatggaacgtttacattaacaagagaaaaaaaggtaataagctgaaactctacctagccagcaaatagtagaggaaaagaggagaaaccaacaaagtaaactaaattgtaaatataaaataagaaaaaaaaatgaaaaaaaatcaagtgcaccattgctacattaaaatgtaaaaggactaaataccccatgtaaagaaagattaggaatgtgttggatcaaaataaaagcacacatgagttgcttacaaaaactatactttaagcaatatttcttaaaggttagggaagtgaaaagatgaacagaaatatacaagacaaagagcaaacaaaataaaaacactaagagcaatttgtattggaatgaaagcataaaatagtagaaagaggagcaatttgtaaagtcataaacttccatgtccaaataacacagcaactataaatgcatttttaaaaactgtcacaatgcaggaagaattgattaataatttggttttatagtggtatattttaatgagtagatagtagataacaggttaggacagagaggctttgatgatccaatttagaaactgacttagtaggtatatatcacagaattttatatagaatttcatgtcctttctctagctttctagtgccatgaaacatttagaaaaattagtcaagtacttggcctggagaatagcttgaaaaattcaaaagagcgtttacagaccacattctttaagtattgcccaataaaactagaaataagtattaaaatataaccaaaaattttaacaacttggaaattaagaaacacacttgggacaaagataaaatcagaatgaaattctgaactatctagaaaacaatgaaaaggagaacacttcaaaatctatgagacgaagagagactgccaataataaaagttgatacataagaaactagaaaaaaaatacaccaaaagaaaagataatttaaaaagatggaagcagagattaatgaaatggaaaatagcaacaactaaaatagtagaatggataaataaattcaaaagttaatttggggtaatatacaaaccccctctgaaacctttctctagagaaaagttagaaatgagaaaacaaacataaccaaaatattgaagaaattctagaagatagagaataccatgtataactttttggaaatttgatttttttttttttttttgagacagagtctcactctgtcgccccagctagagtgcagtggcatgatctcggctcactgcaacctctgcctcccaggttcaagcaattcttctgcctcagcctcctgagtagctgagattatagatgcgtgccaccacgcccggctaatttttgtatttttagtagagacggtgtttcaccatgtcgatcaggctggtctcgaactcctgatccacctgccccagcctcccaaagtgctgggcttacaagcatgagccaccgtggctggcctggaaactagatttttaaacctagagcagggatctgcaaactttctccgtaaagaccagagagtaaacgatttaggctttttggatcataccgcctctgtcacaaccactcaactctgtcattgtagcacaaaaggagacttagacattgtaatatcaaatgggtatgactgtgatccaacaaactttatttatgaaaataggccatgggtggatttggcctgcaggtcatagtttgtcaaaccctggaccagaggaacccagtatagcaaaatataaactaccaaaattgagctagggaaaatttaaaacttgaatagatgaattaatattatatttagtgtaatttcagttaaagtcccaacaaagatattttgaaattagattgtgctcttagagcatctattgaagaataaactgtgacacatgacaaagtgttatgataactataagcggaagaaattgccttatgtgctgttaatatgtaccataaagccatctttatcaaaacggtgtgacgttgacaccatagctaagcactatgtgacaccacatagttaggggcagaaaactgggacctcagccacagaaaagtcaaaatgtgacttttattgtatgccttataaagttaattttatatagattaaaatcttaaccaaaaactataacacaatgtaaatattcacagaaaaatgagatgatcaagtacaacgtagtaattggggtgactgtttcagccaagggattggaaatgcaaaggtacaaaagaaaaaaataggcattttatcctttatgaaaatgttaaatatttgcaagaaaaaatatatcatcaaatttaatagacaaacaataggtgggagaaaggattgcattgcatataccagttaatagattaatatcaatacaatatgaaaaaaatctaataatttgatagagcaatagaaaaataggcagataatttgaatgagtaatttacagagagcaaaaataactggccagccgtgtatgaaaagtcttaactatataaggaaatgcagatttaagtaacaatatggcattatgctatatcccttggacaggcaaaatattaaaagtatgataattccaattgctgacaaggatagagaaagagtagtttcatgtcttgctggtagaaatgtgaattactacactctttttggaaaataatcaggcaacagctaataaaatttaaattcttctcctggaactaaaattagcttaagtaatgatacgtgtacaaaaattatgcattgcagcactggttatagtagggtaggcagaccctctcttcagaaaaaaataaaataaaataaatatccatcaaaagagcaatgtttgaatacatgcggtatttgcttaccatgaaatattcagcagtcttttaaaagaatgaattttaactccaacatttggcacatacatttagtatgaatggtgaagattaacaagatggagaggagtttatagaatatgaaatcatttttgtcaaacagtggcaaagactctggtatgtgtatgtataattatatatactgtagtgtgtatgtataattatgttgtaaatgtgtatgtacacacatacacacacacattgccaaagaataaatgaaatcttgttttattttaaatccagaaagtgtcagatgcacttttatttgtaatccccccttaaagagaagatattagttaaactaccctctcaaacactgggaaactaaactgagatttttttttttttaatgatgtcgaggaacacagcattagctggggtatggtggagagtgggagagcatttacatttaagaataattaatagagatcttgttttagacgtttctattgagaagaggtcctggttttatggcatcacctattgaatgggagtatcccatagttagccaagcatatattaattagtacattccgccaaagccttcagcttcttaggttttggaaccagttaccatatttggaaaaaaccagtgactcaaatggaaactttacagtgcttctctcctctgttaagatatccacgtcatcagcttgttatccaagtggaaaggcacatttttatccttcagtggatctgtcttcttcacctagtaagagctgattcttcctcccacagctgtgttcttagtgtagctaaaagtgggtgcacccatcctgtttactcctacccttaccttcttgaaaagagggaatagattggtagtatgtgaacatttagatacaatgtgaaacaataaaattaaatatccttcttagaagtggttttcagacttctcaaaaactgacacagggtaacaaatacattttatatcacattgagttgtgttggtgtgtgcatgcctgtgtgtgtgtgcatataaaataatgaacaaaattttatgaaatgttacttgttcttattatatgcattccaaacaattcctactctcttctagtctactttattttatctcatttaaaaaatactgatcacagcacactgagttggcttagtaacccactaaatggggtagtgacctgcagtttgaaaacatactgcatcaaaggactcctatcaaagtggcatgcatggcattccatggtcagaagattttcactggactggagagacagttgctcagtgaggtcaaatacagacctaggcatgttttactttatttcacatatgccaataaggtcagcttatgtgaaagaccttctgacagcaggttccttaaggtagttttaagtttaccttgggccaaagccttgcaatacttttagagaattagcttaagctagaggcaaataaattttaactgctgtggtagatgccttagctaacgatttttctcctacagttgggactgtcatgagaagactggtcatcttggtataaatagaaggcatctcagttgatttcaactctgccctaagctttcttggattcctctcccatttaggctttaaaagaataagctaaagttggaaaaagaatttccatatgaaactaagcaacacttaagtatattcttttataataataaccccagttgggcatattgactacttaattcttcataatcagtagagatcagttgtacactattctaaatacaggatttgtgtgggtcataagaacagaggtgacttatgtacaggcatttaaagtggaagtgtttgaaaatctggctcatactttgactacaaagtaaaatgatgtgtgttatatctaactggatttgggagcaaagaatttcaaaaagccagtggaaactggactctgcctgtggcctcttttacaatatacctaatttaagatgtgtataagacacatttttagatattcactaggaaaacaaaggcttttctatcctgtcatttacttaatttttttaacctaacttatttttctgaatgattaacattgatgcctttgattgtgtgggtgttgtcaaaagagagttcatcacatggggaaaggttggcaacctctctctgcttggtacttttccatgagcctcctttcactattctcattgttatttccttttcactctgaagtagttccaaatctgatactgaaggaactcgattttattttacatgaatatttgaagtaaattgagccacttgtgttttaaggtttgtttagtatgcactacacagagaagaatataaagtaaaagcaatagcaataataacttaggtttgacaaaacacataacaaaaaagggtactttgagacacagaaagtcaaattataggtaaccctaaaactcacctttccactttcctttctttactagaattctctaccaacattggggtgtcggtggtggttaggacagaaggaagtatagatatagctatctgcttctaagacatttgccatgtctttctatggctgaagacaacttcaaagtaactaaaagtgccactggaaatagtttctgtgaactatattgatcataatttgaagaatttctaccagctgtgactttgtgaatggcaggaattcttagtttgtaggactgtcaaaatatgaccccaattttgtgaccagacccaaatgaagccgaccgttgtccctggtggtccattttctgttaggttctaggtcatttttttctgaaaacagtactgaagttggtagcttgtgggagtcactgcaacaaccaaactgataacgggaacccatgagactcagagccatgaagactgtcccagcacgctttacagcagcagtccctaaccttttgggtaccagggactggtttcctggaagacagtttttccacagacgaaggttgggggatggttttgggatgactcaaaaacattacatttactgagcactttatttctattattattatattgtaatatataatgaaataattatgccacttaccctaatgtagtcagtgggagtcctgagcttgtttttctgcatctagatggtctcatctgagggtgatggaagacagtgacaccatcaggcattagattttcatagggagtgaacaacctagatccctcaatgtgcagtttacaatagggttcgcactcctttgagaatcaaatgctgccactgatcccacaggtggcagagctcaggctgtaatgcaagcaatggggagccactgtaaatacagatgaagccttgctggcttgcctgccactcacctcctgctgtgcggccttgttcctaaccgcctgtatgtagcccaggggttggggacccctgctttagagtatgttgtactgaatatatcattctctgttgctacatcaaggtaacaatggcaccatctactcttgttgtcttgactctacatattaactatagtgatttgtatatcgtgtaacattatgtggaatcttaatatgattttaaattcacttgtcctcacaactacagttaacatttctctcttacatggaatcattccttgctgatcttgggttttcttttcttgctgtggagttgcgttgttgtttattttgttccagccacgctttctttattctcagtaatactcttagcccaatttcctgctgaatgattttgcagaagaacaaattgtcctttggcatttgcacctgtatgtcgctcattgtccacttgcttgatgtgtttctgtgaaagggggcagcttttccttttctaaatgaagaagggagagtccaaacgtttttttccagctcccatcaaaatatggacttaattccttttctttgattttgaaaggaaatggtgaagggataatgatgtgtttaaaattgggtgaattgtgttctttcttctaactgaaacagtgcagaggaacctacccattgtgaaatgttacttgtgcagcattgtagatgtgcaagaacggcagtgttttctacttggctggctatcctggcatatagttcatcaaaatagagaaacagggtgcagacattctgagtgtaagaccaaatgaactctaagcatgtttacctccctatcatctgaggagagagagagctgggagtgaaggaagaagtgaacaactgtggaatgtctccctatcctcagtggccttcagatacctctgttttttctccccctcccttctgttcattgggcactgacataccttgtcattacaagctattattattttttaacaaggtaagttcaagaagaaatgaaaaagagccagtattcatactgtgtaatagcatatggactttgctattctaaagcagaatctaagtagaatcaaaagatttgaacaaaattatgaatgaaggaccctgacatatctactaaatagtcaccagctttcacgatagcttctgtagcatgccaggggggaagaaagccacgttctttcctcactgttcccttagggcctttgttgtaggagaatagtgggaggggctgaggttggctttgactacaagtggaaatttttgttttcctgatgagcctggcactcaggacactagacatttaactgtaggtttatgattgtcacccactctgcttttaatgccaagagtttcagaacccggctgacctgagcagaataaagttctttgggttcaatctgcagcaatcagaattttgagaacaacaacaaaaaaaatcttttttttttttttatctggtgttgcctcagcaggatccccgaatgtacttgctggtagcttagagcatagtctatgcaggggaggagaaacagagttgcagctgtgatgtgactcattcatactatgttcttttaatggagaaaaacctgcagtgacatcatctggccaccaggggttgtgctgttgccagagagcccttgattttatctgcccgcaagtcctgaggcaggaagtagcaccttaacagagagccccatcttcattcctaagaaaaccagcatcagttttttgttccctttgttgactttccaactagggctgagcccgcttttctgaattaataagaaccaagaaagaaaagggaacattagtcgtggttccaaataccaaccaagcactttgctgcatacggtcggctttggtggcgggcctgagtctgcacccagatggacccatatggactcacctctctcacatctgcacctgacttgcacatataccttgttgataaagcccagtgacagctggatctatcacaaatgtcccacctgatttcttggaagctttgattagcatccatgtcctccatggcaaacatttaattataagggctggttgttgataataatcattgctaacatctatttattatccttatgtgttaagcattgtgcccaacagcttatacaatttagtctcatttaatcctccaagtagctatttgagatagttactattatctttcttttgcagatgaggaaagtgaagcatagagaagctaactgtgatgactgggatcactctgctgataattgtgttgctaggactagattcaggcccctctaactctgaaagccaaccacttaaatgatacttgattttcaagttggggggatggaggctgtggctaagacctgtccctggtggggtatagcagaaggacttcggggcttttttgttcaaactgcttatgtttatgttctcctttcctttccctcatcctttccttctccctcttctgatatgctttctgggtagggtggggtgaggtgtgtccgttgctgtcacactgagtcactgttcctcatgggtgtgccatagccttcaggagtattgggatgggaaaatagctgagaaccagtagactcaagaatggttgcaaaagtcccaagcagcttttctgtgaattattgcctttggtgctctctctgtgatggcagaacttcacaggccaccacactgctgtgggtgctgaggaagggcagaaaatagccatatatatggaaaacatatgcctgttacaaatatgaaaatatatacatgaaaagatacctatgcaacacacatacagatgaaaaatatatgcatatattttaaaaatatatgaaaaacaaatatattaattcatgtgtgtatatatgtcctcctctcccaattccagcatcagtgttggtaagagtgcaagctgttatacattcattatgcaactggttttcactgagcaactgctaggagccttgcagagtgagctggggctttggtggtcatgaagccctggcccggggcttcaaggagctcacaacccagtgggtttttgcttttcttgaggctaacactgatggttcaatttatagatcaagtctcttcaatcataatgattcagataaatagagaattttgtggaaaagtcttctgaatagttttttttttttttttttttctaaaaaaacaaaaggctgataaaaggacaaggccccatgctttttagtttctaatagtagtggactggaactacttgtggattttgagtttttgtttttgttttacttaattataggattagttttaggtgtgactttttccatttcctttggaagcgtctagtttgcaataaattagaaatgccagctgacagcaggctaagatccagaagaaccattaactcaccattaactctacagtctcagcattactgagctttctgtttaaaggttaaggccgtttataactcaacaacccctcaggtcattcatgaaatacatcgcagcaccaagaaagtagtgttttcttccttaaacacatctcttatcccatcattcttctgctcaaaaatctgtgcttctctactgcttccagactccttaccatggaattcaacgtcctctatgatctggaccaaatgtcctttttggcgtatttcatactatccttaggttcccctggaaccctgaccccaggcaatcaagcagctcttggttctttcaatgtacctgatactttgccaatgatcttccatataagatgccctctctacctctgtctaaatcttattttaatatatgtgctgccgaaacgagaatgaaatcttcctactttgtaagaccaaactcagacaatattacctctatgaagatctttggtgtcagctattggaattaaatattccttatttgtgttaatagcacgtagtttaaaccttggttaaagcatttaatgttttcttttcttatttatagttagttggtgtcaacctaaaataatcaaaagggtcagaatctgacttagagagagtttattcaagggcaaagtttgaggatagcccacctataaacaccagctccaaaggaatggagtcagtgttctgaagtagggaagttaaagtttcatttatatatagtcagagaccagggagtttttagcaggattacaacatttttctgacaaagttggcacacaattgcagcaatttgattggttgtataggctgtgtttctttttgggaaggatacatataacatttgttacagagggtatagtggttatgggttttctgtcaactggcctaagcaaagcaggacaagaaaggggaagttaatctgtaacaagggtcattaagatggcagcaggtttttgtccctgttgttgtttgagtctctctagtcactgtacagaacaagaacaataagaaacaagttgttctataatctgagaaacagaagtcacaaccctgtgtggctcagatcacaatcacatctctctcaaggcttaaagtgtcttcagggttccaacaggttttaaatcatatttattttcacactgggtacattgtggaccgctaagtcctttgagagtaagaagcatgtcttctgcattttgtgtcacccatccatgagagaaaggttttatataaaatgagtaaatttttgagtggtataagattaagtaaattttagatctatggaaaaggcacttacgtgaaattctctgatgatactgaacaaattgcattgttgtcttggtccagtcaacaggcatctttttgatcctttgaggtaccaagcaggttttacccttagggcatctgacctagctgttacctctccctggaaatctcttttattctggaatgtcacatagcaactccttcttaaggccaagtgcactgacccatcttagagaggctttctgcaacttctcagaccattgttggttttgcatggtgacaaagcctgtctccagtcactccatcacagtgccctgttcgcgctatcacagccaggccagttgttgcccacttgctcatcatatgcatctcttaagcttcaggagagcagaggccctgtctgctctgataatcattgtatctccaggacctagaatagtgctgagctcacagtaatgccccttacatcatactatattatttaaaatcagtgggttttgacattggctgcccatcagtgtcaccagtggggattaacaaaacacagatgtgcaaggttaacctcaaagattctaattcagtaggacttgagtgatgcccttaaatttggctctaaatgtattaatcatcaaagactcaggaaaacaaggaaagataagctttctgtagcttccaaagttgtagctgtttttaaaattgtttatattttcttttaaactctcatcccatatccttaagccttgtgactgccacagagagaaaataagatcaagcatgagcttacattagccacagaaacacctggggcagttccaaagttttaattactgcttcattaatgtaaaagcttaactatagttgtaatgtataaacaacttttggcatgtgccctgcaaatgcaaaaaagtctaaataattattgtcgtggctcctgtctcaacgcaagaccaatgatcgccaaattatttttaagacatggactacattaaaaagttattgaattatgttttctgttagcttatataaagcacatgacatttaataacttgcaaagaaatgcttattttatctgtaatatatactttggtgtttatcagattctgttcaaactgtgtagcaaatttccttgaaaatagaactttcttttttcctcacatccctgtatttgatatcagactattcttagactctccacctcactcatcaccatggtgtctacggacttataagtatgacatgctgtcacccttatttatacatgaggtatggaggtgagcgtgaataagaatcttgctcagagccaattagttgcagatccagcattggaattcctctcccatagtatcaaaagtgtagtcatattcctagatcattaggcaggaagaaaaagaaaataaaagaaaaactactcagagacatctggccggatctgtgcctttcatcagaataatcatgtcctgaatctcccactggggttgtcagaaaagatttttcccaagcttttctataccacggagagctacatttaatttataacctgaaagtatcccctaaaacagactcataatcatgcttgctgaaattttagcccagccttcttgcttgctgagaaaagagctggctgtcctttctctttgaataagcctccttgtatgaacagtctctagagatgtcccttttccagatgaaaatctgttttatgtgttatcatgttgaccttccaatcccttgaatgattttacgttttcatcttggtaggtctgttctctctataatctaatttaatagttctaatctgcacatatccaccacatatctagttcaatatcaagcaggtatccagtgagttcacaaactcagaagggcaagaaatataacttttcttatttttcggcaactcattttcacttctattttgagttctttttctaccaggagaattttagggaaatgtttgcccccagatcaagagacactctcctctttctgcttgctaggcccaaaagaacagactcttttgaaaagtgcagagtttagaactctaagaggaagaacagtcagaaggatttttttttaagcaaagtctatttttcacccaaggtggaatataatataaagtactaatcagttatacaaacatgttatttataaaataacagcccactaagcgtcagaggtgaggggttgccccatccaattttcagagtctaaaagaggcatctgggtgtccattacctgaaacagcacaggcgctagtgtctccagagaaaaggaaatggaagagggaggcaggggatgttacaacagggtgtgattaatagcagctcactgctggagttcactcaggaaaggctgggtaaatgctgcagctcaaggtcagtgtgaggcaggccaagggatcggttagccctggaacttctgagtgagtccttggctccagttaaataagaagcagccaagatctgggaaggtcaacacagtcaaagccctaccaggaactaggattataccctgggcttcaagccaagaccagggcactctggctgatctgagtgtgatcttgaactctgctttgccctctgagagaaggagccgaagctctgtctaccttcagggacagaggtctggagttagtttcctgattacagcaggaacaacccaagaggccatcagatactgggaggttcttacagtgctctaaaccctttcaggcaatttgagtcttctgtgtctattgtcttcacaggcatcttgtatagtgttggaaacctatagtgataagtgattttcagctacttactagagatgggagaatttcaaagtcctttccttcattgtccatctttactcatttgggtagagttatacccagttctatccctgcatacatacttgcatgcatggggtaagagagatctatttacaaacacgtgaccacaaacacatgaccagcttccaaagctgagaatgccaaggacacatggaagttattggtcacctgagtatagaaaaagcagggaaacccagctcaaccactttctgtctatgaacgtcaattttcctctttataaattagggatgtgtataaaataatgtgcataaaatctttggcacagtgcctaacacattgtgaacacaagtgtcagccaaaattatgagcatgcagctgtctctgtgtctgttgagcagagcttcctcaatgtgttgtcaatggctcaattttggaaacgggcaatgtctcgagacagtgctgattgccacaacttacgggatgagtactactcgtatctagttggcagaggccagatatactgctgagcatcctgcagtgaacacacagttccctacaatcacaacaatgagttcccctacctgaaattccatagtgctgaggctgagaaatccggcgaaatggtcatagcaagatgagatgagtttagctgatttccttcatccttaggaataagaacatgttaacatattaacattattgacctctaccagcacttaaaggacaaaaagcctatcaaatctaaaccttgctatgaaacaaaatctgattcttgtgagagaaaagtcttccttgattctcaagagaaagtaaaaggtttttgtggttttgacttaaataattctaatgactcgatttgtttattggacaatagattgaaggagctaagctggattttgttgattttaatttttaccagtaatgtagtataaaaaatgttttgctagacttgtatgatttactaaataattattgatatttgcatatcatgtaggatcaagaaaaagtcacatgttaaattctgtgtacagagataattattttcagtcaaatgaaagtaaaagaggccaggcgcagtggctcacgcctgtaatcccaacactttgggaggctgcggcgggcagaatcacctgaggtcaggagttcaagaccagcctgaccaacatggtaaaacctcatctctactaaaaatacaaaattagccaggcgtggtgctacatgcctgtaatcccagctacttgggaggctgaggctggagaatcacttgaacctgggaggcggaggttgcagtgagccaagattgcaccattgcactccagcctgggcaacaaaagcaaaaccccatctcaaaaaaaatcaaaataaaagtaaaggagatattaagtttagcttgcctgcaatatacaaattaaatgtgctagaattgagcacttatagcacaaattataggaaataagatagtgaaaaattaaaaattacttaggtcataaaaatgcagaaaatacataaagatgctttggagccatagagcacctgttaaagcttgactttcattgtatttccatgttgttccattacattaggggaagcctccttagtggctcatcacctcattgcctagactgggtaagcagggacacagggtcattgctacctttcacaggtgctttactgtgctaaacttctgaaaagccaccttttaaaaagggaacatgcattttcaaagccactgattattaaacccctctttcagtcatcttatttgcagactttcatttttgagctttgtttgccatctgggaaggattttgaaagagaacataggcctcttcctgcttttatgttcagcatgccatgaattgcattaatgaattcttaagatcgtttgatctatttaaaaaaatagctctagattcagtcagttgttaaaaaaatgtgttcaagattgtctataattgcactagccacaaacagattttcgtaggtattttctttgtaaagaatctatttgaaatattggaaatgttttcaggaactagagacaaaagatatacatggttttttgaataatttagcatgtcctaatttttaaatgtccctcagtagtcatttatctgcagagcaagtaaatacaaattttaaaaaaattaacagttatatacgtgcttattgtaaacagtcaagtaatacagaggaatataaaacagagtgaatcatcttctccctgtccaacctcacccttttgcagcagccaacattaacaatttggtacatatcctttctcaactttctcaatgctcatacaaatgcatggatgttcatgttcacataaaaatggtgttttattcctcccccaaatggtgcagatgcaaatatgatgcagtaacttgatttttgcattcaacaatatacaatgaaaattcctcctagtcaatacatgtcaatccaattcattattttgtcaacctaaggtagtcataagggtcagaatccaatttaaggagaggttatttaagtgcatattgtgagggtggccaactcaaacatgccaactccaaaggaatggagtcagcgttctaaagtagggaaattaaggtttcatttatgtagtcagggacagggaagtttttagcatatttcatttttcagacagggttggcacattgttacagcaatttgattggtttataggcagcgtttctttttggaaaagttacatttaacattcattacagagggcatagtagtcatgggttttctgtcatgtggtcttagcaaagcaaggtaccaaagaggaagtcaatctatagcaagggtcattaagaaggcaggagatttttgtcctggacatttaattatctctagccattgtagagaacgagaaaaataagaaagtgagttaatgtataatctgagaaacagaaattataaccatatgtgactcagatcacagtcacatctttctcaagacttaaagtgctttgggggtcgcaacaacttttgcattatatttattttcacaaattttaataactgaaaaatagtatacagtgtgggtatattatacttgaatactggtgccctactgatggacgtttaggtttttgtagttttctaccactaccaacaatgatttatactctctccttaggtttgcacctttttttctgtaagattgattctcaaaagtgggatggcagtgtcaaaggctctcccaatcaggtgtcacagtgcaaaagccaacaatgtgtggttaaaggatccattttttcacaatcttgccaacacaggctcttatcccattttggcttctttgcaaatatcttagatgaaaaacagtatctctgtgattctaatttgtgctttccctattgctagtgaggataagtgtcttttcatatttcatctcaccattgcattttcttgtctgtgacttgagtgaaacttttctaattcttgcatattttattcttgctcaacatgtcacgactcagaaacacatatttccatctcctttagcatttattttgctactcagatttcagaaggaaaaaggatttttttcctgggcattgtcagtagtagctatttggaatgctaaagatttgataagagacattgaagaaatgtgaatgttactgaaccgatttgcttaaagtaaagggaagactgtctatacgtctgaccaatgctttttgaatgttcaggcccctgaatctggctgcagtcccagtaggcatgggtccaggcgtgatgtgtttgtggttgcatcatggcatcgctgtctaaccctcgcctttgcattgaagttgtgcaaagattagagaactgtaaaaatctcaggcctgtctgaggaagtctttcttactatctatccctttctttaaacatgccttgaaaaaaaaagctacattttgtcctgctttgtgttcatagtgaatatctttcattgtcaagaaaattttttcctgaactagctctgaaagatgactcagcactttataagatcagtgagcctttaaggaatgacctaagatggaatgtatcctgtccagtgaagctcaaggcatgcacaggtcgtgttcacctcactccctcaggagttgaaggagataagaaactggtcccacagccctcaactctagcttgggtgcctcgcagctactcagctaaccaaagaaatgagtggaaaatcagttctctggtctatttttgatggtgtgagaagaaggaggatgaggaggagaaggagaagaagaagagattacttctcattttaattgaaatgagtgactttttattaatgagcttgaattcagaataatttattaccctggagttttcttataatataataagtgagactgttttcctttttgcttagggcaaaaaatgtaaggaggctgagtgttacatttggaggtttatcttttttttttttttttttttttgagacggagccttgctcttgtcacccaggctggagtgcagtggcccaatctcagctcactgcaaactctgcctccccggttcaagcaattctcctgcctcagcttcctgagtagctgggattacaggcacccaccaccacacctggctaatttttgtacttttagtagagatggggtttcaccatgttggccaggctggtttcaaactcctgacctcaggtgatccacccaccttggcttctcagtggaggtttatcttgtcaggtttggcttccttttcccagttccatgaaatgtgaatttgaatatgtgtttgtgtggtcagggagagtgttgggaaatgagggtgggatacagagagaaggatgatttaaaggtttagatggtctggttatttttagtttttctattcccatttctgcaatagtttttatttttcctcatacactatgggagtttgttcacagaaggaagttcctggagcctatccatcaggaacattaactatatttttgtttgtttttttgcataactatttgtttagtttttccttcccaaatttgtggctgctgtgttcttgtgactttttgtcgggggtgtttttttcttgcttgcagtgttacccacaatgcatctattttgtgtgtattaaacagtccctttcaagagtacaaataatggtttgaaataggaagagtatcccaaatgctttaatcttatatttgaaatgtaggaaattggaggagctgaggatatttgtgacacatattttacatcttctcattgaaagtagagctgttgtttgtctgcatggttttgagtttggtcactgaaatgctaatgacacagcagaaacccttggtgtgtgcataaggccacatgacctcaggtcaggaataaaagcttagggctgagcagctcactctttggttgagaatccagttggctcccctggagtgaagttctacacagaccctggaggaaccaccccatctgtaaggaacctaagtttctgtatttctggctttcattgtagaaaacctgatgtcttctatacttgttcccttgacctacttctaaaacagtttataaacaatttcaataatattcacagtcaagtagagctgtcttttactgatatattctaaacaacataaattaaggtggagcttagaacatataacacaactatgtcctaatgacatgaggagacacctttctcctgcaaatagtcccagatatacatcagttttcaacttgtcaggatggcggataagattctgctgtaggtgtctttaattaccaagtggaactaacattctagtgttacctgcaatgtaatgaagagcctgattcatcttgatctttttcactgtacttacttatcgttttcctgagaaagtgtggctttagcatttgttttacctgagcatataaaggtataaactcaagcagaacattgatagaatgaaagctagaccctggcttaatgtagtccttgaaggaacaagatgcattaacaaaaatggagtgatggttctagtagagctggtatactgatgcgtgctgattgttacttctctagcacatgttatttgctacccttgttaatggtcattgcattggttgcaagtcttggttattttatattcaacactttaagaagaaatgtgcttccctggctagttatcagattttttatttttatttttttttcgacggagtctcactctgtcgcccaggctggagtgcagtggggcgatctcggctcactgcaagctccgcctcctgggttcacgccattctcctgcctcagcctccctagtagctgggactacaggcgcccgccgtcacgcccgggtaactttttgtatttttaatagagacggggtttcaccgtgttagccaggatggtctcgatctcctgacctcgtgatccgcccacctcggcctcccaaagtgctggaattacaggcgtgagccactgcgccaggcctatcagatttaatttataggcatttgaatagtacaaatgtaagggcatgatagctaattaaattattccccaaatatttattgaacacctagtgtgaacaaggaagcagtgatacgaagaatggggcatctaacaatctagaggaagaaaaagacaatgaattgtggaattaaaatacagcatagtaagtgcttcaatattaagtcacctaactctttattctccacaatgtttagcaaataatcttttgctgttcatttggtttttcaagtagattttgttctgaggaaggaaagagagcacagaatttaccttaaggtatttggtctactagtcaaaccagtctcccagcagatttgttagtagaaattatctcccaagaggctaatcaccattgtgtaaactgatggaatacaatttctggacctaagaaaacacaggtgaagccttggaatatgatatgtctcaaatatgcagcaaacttggtgaccccgacctgaaaggccggctgatcttatgtggtaatgaaagctgggtcttaatgcagggacattttctgtagttagcccagtgaaatgatgtcccaagccagccactcccacgcttctgagcagtgtcaccttagatggtccttcccatcactccaaatttccacagcttccagtgccttcaagagcatactgtataggcacaagctagggatgggaccagggaggccttgggtaaaagcagccagttcaggctctctgagattcttgtctctggaggtgaataggagtccttgcttaggtcttggccacagagataataatttaggcttatgtatattcctgaaacctttaattggtttgagctcctggaagattctccaccctttaggaccatgtggtacttggttaactgttgggtaccatatactttctgctatctttagtattacattgaattttggtgacttaataatacatggttaacctgagattattgtatcaatggtatatttttcctggcagtcagaagatggccaccttgtacatatggaagaatgagaaagggaaggaaagagttccatgtatttgttgacctctatatgtaatagcacgtcacttccatttttagcccaagttaggttttggacagccacaaatgtttcttttgagactagagtccattttaatcagcatctaactatttggattgtcacctaagcagcatatttaacaacaacaaaaaaggaatagatgtttaatgtggtcggctacaacttcagaagcatcttctaagctctttctatagtcaactgattagtacattctcaggctgagcattgcagacataatttctttttttagccacattattaatgaaaccaaagctttagaaaacagtactattaatagtggtgactcatgtgttctttatattttcagaaggacaataaatgtttagaggacgatgtctgaaatattttcttcataaagtgtttaaccataactatagtaataggtaatattatgtgtcttagtgcaatttataatgcaatttgtaatgtcatttatactgtatatagtatatagtggtaaggtatctagtaatgtatataatattttgtatatatataatgagatgaaaaaatattttagatcaaatgaaggcacagaacatgatactcattattctagtgctgttggcaatttggtaggattcttacaagagaaacagaggaaaaagaggttttctagagtgacagatggcactaaaagctaggactgaatagaacatgactgaggaatgctgtgtgtgacagcctacatggcttagaggctttggtagggacatcacaggcagtctaggtggaatcaccacttacagccagctatggaggactttgaatgattatataagaattttcaaatctacgccagaagcaatggagaatccatccattgaatgttttttgaacagggttttggcatgttgaaagcaatgtgttcaaaatattcagtgttgtgtagattgggtggtggagaaagagaatacaagcaggaagatgaaatttggctaagacttcagtagtgtgagtatgtagtgatgaaacccctaaatcactgtcatatagcgatgaaaattaaagggttatttatttttcctcatgcagtctggtagtttgctcagtgaaggaagttcctggagtcaatgcatcaagaacattaactattttttgctattgacaaacaaacatcacagatattatgaaaagagcatcaagaagacttgattgtttttgtcttaggggattaattcaacaaacattggttgatcaagtcctatcagaaagagtttgggagacataagccaccctggacctttcctagtggtcgatgtggggaaactgcagctattaaagctcaggcttaggcattcagtaagcccagatggagtcttgagtgggattgggagatttcagttcctgtcaaatttctgcatgaggtgttgtggtaaagtcaaaatagcatgaattctgtaacctaacagatttgcattaaaatctcaagttcaccactcatcagttatgtgagtttgggcaatttatttaactttctgaaccatcatttcctttttggaaaatgaggaaatgccacctatggaagacgattctccatagatctcttctgtttctacacattttgtaagcagagacactgatggtcttttttctggactatccattcaaatttcttaatagtgaaaaacgttggaagacagagacagtgtctctttctagagcagaagtcagttttgcttcttcctccagagcaaaggtttgcttactgcctattagaaaagattcagattccctgagctcaagtttcttcagctgagatgcaaacccattgcttgtgcagtatccacctaggtccctccatttcaccctccatgggacttggtagcaaggggaacccactggaacacaatgttcatgctatttgctgtgccatgagtctctgatctaggagtctggaatctgccagaatccatggcactgttgcggactaacttgttagcttgcaagctgagcaaaatctcagaccctttatagtgcttgatgccacctgcctaatgtgtttctagggaggacgaggcaagataagatatgtaacacacctggagcatagcatgcagttaaaaagaaacacacacatttattccacttcttcccttaagagaagtaactgagcagctgcttcgagaaagttcctgcagtggtagcagcagttatccctttttcaatatagtttcagagtcagggcagttcctttgtctgagtttcaggatacatttgggcatgactcatagagaagaactcaacaaagtttaagaacagtagattattatactgcttggttgcaattgaagttcttgagtccctcattaacttctctcaaggccaagatatcattagagagcaacaaagagtagcctgatagcaattctttatccatgttactaggattcagctggggataaggaggaataaacacagtcatctaagatagtttcctaggacagaggaaaaaggattagggcctggggaagaggagtaaaactgctatctgtcagaggacatcaatctgaaagagaaggtgcaagcaactcttcctataagaaggatggatagttcccagaagggattggtggaggagggagcatcacccttgcagtctcgtgacatttgttatcaactaatgccttttttttttggcacactttagtatgacagtcaggtggctgatcctgggttactgtttttagagacattttcttattggtggctccaggcacagtaagtacgtttgcctttagctgtggtctgcccttacaccctcatgctaggacatgtggaggtttcaaggtgaacaaaactgattttctatcattcagttgctaacattgtagtaagggaggtaagacacgtaatcaaatagacataacccgggagaaaaagtagcaaatgcctgagagtgggccaggtgctgagagagtgctgtgtggtgacagcactcccagggagagtctgggtcctgagccctcacaccagtgaagagaacctttcaatccctagggcaggaataagccagcaggcccaaggtgtagctcaaagctgtagaagcctgtgctgagctgttgaggcaagcaatgctgagcactgtcttcagagtctcaaaatcttatctctaccatgtgcctctgacacagctttatttatttcccatacacagccttgatctctgatactggccgcccaacttgttttagatccttgacttcaggcttaatccctagtgactactatcatcaacttggagacatataacccttggctgccatctatggccacatgacccaaatgaaaccataggttccagcgtggcctatgctctcaggaggccctagccatgaagggccaggcacattgaacccagcctcaaacattggagtagagaacgcccatctggcatttctcagggcagaggaagacgaacatagcttaaagacaagcccacagtcatgaggtctatgccaagcttcaggagactccgggaaaccagtcctgtaccctcacctccaggaaattcctgattggtctctccagggatattcactatagtcccagaagggtctctggctcttgtggttgagccagcatccctgaacttctctctatgcatgtagagaatgtttccaggtaaactattgaaaggccacatcttaattaccagacctatcttcagaatccaaatagagaccacagaccaacaactggtagctacagttccatctgtctcagagagtccaaatgccttaacaatgccgctgtgttgaggtgtgctgggggcactgtgtggcctgttcactagtgccccacacctggctctcttcagagtgaagggggctgggctcagggaaagcaaagaaggaaattgtcatattgttcaggtatggtttagactcctagaccatttattgcagacaagatcttaaaaactgtacagaagacaaagtgacctctgcaggcttagaggaagccagattggggcaacaaataatttattgaatttttaattaatttaatttggggtcatggcaagtcattgaagacatagagatgaaacttgatagagagttcataatgatctctcttttgcctgaattctatgatattattagtctctgtttaactcagagctcttctttgaaaaaaagaacatgacattcagactagtgccaatgaaaaatgaggcttatttttaggataaagagaaagcttatggacgttcaggagaagtcaaataatcaggcctcaggccaggccgaattataaattccaatgagctcagagacctgtatagcacttactagattcttaataagtgttcgttaaaagaatgaatgaatgaatgaatgaacaaatgaactcacaaatgacctaagggagctcagaggaatactgaggactacactactgtcctaccaataactgacttaatcttactgcacttaactctcctgtgtctcttggcccaaaatcccaacagaggaatccagagaatacccctgggtcagatgcccatctcagtccattaagcaatagccagagaaggtaatgccaaatgaccatagggctcccttctaaggatcagacagattaagccagaataagaaactgaacatggcctgtgggtttgtatttctccagggcattcattttgtatgtaattacagactgccatgtactggtgtatatgcatgtaaggtatatatgcgggtggcaccacagtgaaatatttttgcttcttgaggacagaataatagcttctgttctttcttctatagggcttcaattttataaataattctgatcaaggaagaatgttcaagtatgaccagattgggagctaatgtgctaactgattattatatgccagacactgtgttaggcattttacaaaactgtaatctctcacaatttattcttgtgggtaggcattattatccccattttacagatgaaaagactgagatttcaactatcacagttacaaagttgaaaaggggtggagctggaattcttcctgagattggtttgttccccaaagttataccctttccaatatcactatactatcttgcaatcgacggatcattaagcaaaatatcgggatgaattctgcaggacagagccaggactcttccatgagtcattagtcaggtaaagacacttaaggcacataattaggcaagtatgtagttttttatttaatattggtttgaggaaactagctctaaataaattaggggaccaattgggaacctttgatatggtcaggttttagaggagatgagaaggataaaaggagaaagttgtttgaaaaaaatcaagttacaaaatactgcgatttcatttttagatatatggatctgtctatctatctatctatctatctatctatctatctatctatctatctatctatcgtgtaacacatatgttaaagatgtaaaatacccattgttttatatatctgtaagaaagaaaaagtgctgtcaattaattgcaagacataattgattatgaaagccatcctgatttcaaagatgttaaatgtgagaaaaaaaaagtctgtgctgcaatatgtaggaaaagatccagagaaatgtgcccgaatgttgcagtggtgatttccgggaggtgacagtatgacttgcgttttatgattgctcgtctgtgtatgcagatttccctgatccactctcatcccactctcaaaggttcaagtaggtgatccccagccccaggagaaccacttttaaactctttcagcatgtcacgcattagagttcacacattagatttcaagcattggctttaggatttggggatatacatctcccgtggtattgatcttagcatttgaagcctctgccaaaacttcacggcaacaggaataaaacacacttaagagacttttctactacacacctgattcaataataggcgagatacgagttgttagcaaatgaaggaaaagcatgctgttcaatgatgaacgttcttaagaaataatatctaggttaatgtagtacttttagtaaatgcacagaaagtacaattctaataaataaacttgttttatatctttaatttccatctagaattgactcgtgttagattttttgtggtcttaaagataatcataaatccaacagtaatatgattagctcaataatttttcacttggggaatacatgtagatattttgaagttttatgttaaggaatgcttgaggttatttttaccaaacatcatgaagaaaatataattaattaataaatattacagtcttaaatctattatttaaaacatggaaaattttcatataagctactttattgcattccttcttttattaagtcctaggataattttgtattctttttgaaagtgtatgctttcctccctttgcttggttacacagttggacttatttaattttctaatacagtgcaagattattttactattcaaaagcgattctgcaacttttacatatttgccaacaatgcaggatatggctactgatccaaaatcatagtttgtaatcattttaactcccggtcctctgtattgtttcaatcatggccatgaagccaccacctactccacaggagagcttgccagcatgcgctggaagtgtgtggatgccaatgagtgatttcattgcaaggttgaaggaggcactttaatctaaagctgatctcttgattcatacttgccaagattttgcctacattcttcagatggcttaagacagggaagggcataagctttggtgccagactagctttagttaaagcccagcaacttgggactgagccccaggtcccatgaatgcaggtcttcatcagcaaggctgggagcagaccacagtgaacattgtgacttctcagttggagctggtttaatttgtggtgttgttcagctctgcatgggagacttaaatggagtcatcactggctaactgtaggtatagtgaaaacaggcacatagtaacatttgacaaatattttaaagcctacctgttttccacagacctcacctggccaacggagaagtgcaattactagattataatcagatctatgattatttgttacctttattaaaacaattctatatattttattgcatgtaaaagagtaaaatggctatctttaagtaccaaatactccaatagcagggtagcaacatttatttacactacagcttggtatgtatatgtgctcaattttttttaacctatacttggtgtgagtatgagcacctaggctttgagtagtgggggaaaaaatattaggcctagtccattccaatgcaattattttaaaaacctctttaaatattactcatttccttcagcaaagttatcttctagttcagatttctcctttttcagatcccattttcctgtgtcctagctagggaggcatctggtgtgcctggtgtatggaagcctgaaggactatgcagtgccttgtgttctgcttgtatggctcttcaggtagctgggaacatgatgtcccctggtgctgaagttttttgcagatactactcatgatcttgtctccctcagctgagtttcagttcagtagcccctccgagctgattcagctttgccttggctctcattggagggagattctttccacttcctccatttgtcctctggccagggctggtaaccccagcccctgatgcaggagcaccaacttcttgccaagttggtgagtttctccctaagaaccatgagaagttctgaatcctatccatggttaactgactgcagaagagtgagttggagaattaaacacgaggggcctctctgtccaacacccctggacctgccaaggttacagtgatgtggctgtgtaccaggttggtgtgggatagcctgaaggatattccttcctagagttcaaaaaggaaattggggcaggcttcctataccattcaaggaccaggaaagatgtaaatgggtggcatgcccaaaagggatgcctgattccagaaagcttagtgaatgggccatcagaaaaatgacaagagttaagggcatcaaacagtgttgaagcaccttggaacagccgcagtaggaagtcaatacagtccttaggccagaggagagttcttggaaccagacgatggctgagctgtagaagggagctacctaatgggagctttggcctgtggtagttgaaagctgaaactgcaagatgcagcctggcagggagggagacaggcaggactagacatttgctaaccactcgcttctgccctccagtgtcctgcaggggcttcccattggccaagggcatgggaatcatattgatataatccttaggtcatctcctgggcacagagaagggtagaggagggtagagagtgggtctgaaggagtgaacagaatctccagcagattcttctctaagtgtaacccatttcatactttctgggccaatgcccagagagaaaggtgggacatacacatctcagggcttagctctcctcattctctcctcctttcctcttcccacaatctaccagggatagagccagaggcacatacctcctcggtaagtcctagatatctaaggggtatctaaggggaactgcttgggctggatgtcctgggcttggcttttgctatgccaagagagaaataatgatatgtagaacattgcctcaaaaaaaacttttttctgcatatctcttttcttgctggtaaatccaatttcaaatgccaaaatcctaaatattaaccttttctttgtgtttctttaacttctctgtcctgccactggcagatggatgccttagaccagctaggaaaatattacattttgggagaggcaaagagaatacttttaaaaactattactccccaatttcatgctgctgtagtttgtttggaaattttaaaattttatagcattttcaagtatattatctgatttaacatcatttaaccttagcaacaatcctacaaggtatccattttacagatgagataattgaggtcaaacgtactctgctagttaatagcaaacccacaactagaattccagatctcctgactcccattagagtgctccttcttctgtgccagacagggggccacagtttgcacatttggaaaagagaaccaagttcatgaaattggttcataatatactggtacttgctaaaagtggtgacttgagcatttgcccagtgataattgctttcactgaaaaattttttttaactttttctaatatctgcttccatggtaactaggtaattttatacttattttattgcccttcttgcattatcatctgtcatttggtatctttcaccatttgcttttttcattcctggttttgacttcatttcactagttaattacctttttaatccaactcctctttttaactacttcttgattcttgaattatcctttgacctcatcatttgattgctgctttcctaactcagtgagttgaacatattctgctaaaaatagcagatcttgttttcattttgtctctgtttatgtgacaccctgtgtataactcagagagcaccactgggacaagatgtaacagggaaaaatatgtgcctaggtagagaaaggatgaggagagcttaaacctagactaactagcaacctggtctctgggcagatttcttgaatgggtggtttctggcagtgagactttgaaagattcgtgatgtctctgaggagtgggatgtttggcccatcagagctgaaggccagttcagagtttctcactttgtaaggtttatgcgctccccctctgaaaagtggaagctaccggctgggtactgggtctgtctttccctagattcactcgaagtttcccaattcatgtattaccagttaaacagggttttgaactttcttttcttactagaatatagaaggtactaaagatgtttgatgtcttgaaaagtctaaggacctggaactgttgtttattccctggagcatgtcttctcacgttatgaagatagggaagactgagaatttgggttccagctaagtttgagcagtatctgtaagtccttgggccaggctgagtggggagaagtccacagtgtgttgcagtacccccaggactgtctgctgacccccactgcaggggtggggtggagcttactttctgggtctatctctcatagctgtgcttggaattgctgctgattcctggtttagatcgttatcctagagcattgactaaaatgttaaatgacctgtaagttacattgttttaccaagaggctgttccctacattctcttgagtctgtagtctcataggttgctgatgttgcataaaactggtacagcctctctgggtgatagtttagcagtaggttacaaaatgtccatgccatttgactgagaaatccaatggataggaagtcatcgtgaagcacctaatgacttagctaggagatgttcactgcagcttcccagcaaacagggtaaattattaatcatccataagacaaaataaagcacaaccattgaaaatatataaatgtatatgtgtgtctttacacacgaaaagatattcataatatcctattgaataaataaaccaagtttgcaacagtaaattcagtatgtgtgtgtatatatatatatatatatatatatatatatatatatatatatgaaaatattaatacacctatgctcagaagaaataccagaaaggaaggatcaaaataccaatttttgggtaatatgattaatgttgattttaattaatagtggataattttactgtcttctaggatgatcagatattacttatgaaaaaggaaattacttagcattgaaactggcttctggcatagagagaagggatgaggatctgatgaacgtggatcagcaatatgccacgtttactaatgtttgttaccgtgttggcagtgacatcagggtgccaatggcacactattgattcagacataaggatgtgaataccagggactcaagagaagggacagcttcagaactatacacacttgagccatatttttattctctttatctaaaatgttctgattttgtaggataattatttgcctttttctttttactttagacaaaatccattttcatttgtttattaaataattataagtacacaaaagaatatttacaatataaaggtaaagtggagaaaatactcatgaacagaaagtcagtgtccagaaatggagtatgaccattgatcctgtaagagttccctaaggcagcagtccccaacctttttggcaccaggaactggtttcgtggaagataatttttccacagacaaagggtggcggtgatgtttttgggatgattcaagcacattactttcattgtgtattttatttctattattattacattgtaatatataatgaaataattatacaactcaccataatgtaaaatcagtgggagccctgagcttgttttcttacaactagacggtcccatctgggggaaacgggagacagtgacagatcatcaggcactagattctcataaggagcacgcaagctagatccctcgcatgtgcagttcacaatagggtttgcggtcctatgagaatctaatgttgctactgatctgatgggaggcagagctcaggtggtaatgcaagcagtggggagtggccataaatagagatgaagctttgccagctcgcacacctctcacctcccgtggtgtgatctggttcctaacaggtaacagaccggtactggtccatggcgcgggagttggggacctctgccctatgggatcctccattcctttctcctttcctctctggcttgagaaaaccacagtcctaaattttttattattgctttgcttttctttataatttaattcctaagtgatattttagttttgtgtgcttttgtacttcattaagtagaattatacttattcttctgcaacttgcatttttcactcgatatcttatttccaagttttatccatgtggtgtgtatagtgatagttcattcattttgctattgtccagtctttatcatggaaatgcaccacagtatgcttatgtattgtcctgtttatgaacttttgtgtgacttacagtttgttgacactatgaaagcttttattaatggcgtctgatgtgcatgtataacatctaatgctcatgtaggttgtctcaggtctatacacagtggaattgctaggttatagggtatgtgaatgtccaattttaatatacaatgtagaccatgctaaatcattttccaattatttttatctatttatattcttgccagcagtatatgagagcttctatctttgcacagtcaccaacatttagtaatgtcagacttgtaaatttttgctaatctactgagcgtgaactaatttaatttgtatttccctgagcatcagtgaagtcaagcatgtttgcttcagtgaagtcaagcatgctttcctgggtttattaacatttgtgatttctgtctataaatcatctgttcaggtcttttgacccatatttctattggattatttctggttttaaagtgggtctgtaggaattctgtatatatcgggaacaaatctttttagttatatatgtgagagatatcttcttccaattagtggcttgtcttttcattttccatatagcgtctttgataaagagccattattaatcttgttcgtccgtttttcatggtttgcctttttgtgtcttaagaagtcccttcctaaccagaggttcataaacacaaacttctagattgtcttctaaaatgtttatagttttgtccctgtgaatggtttaaaggtgtccaatgtgttttttctatagagataactgttctaggacaatctattaaaaactcttctgttgtaggactttctccttagttcagctaaaaacgggtccttgtcacacgaccatgaaagattaggcttgcagacactttgaagggtgagaaaaatggaatttattgggtgaaaaggaaaaaaactcagcaaagcaagagagcttcctgttaacagatccccatctcacagatagaattcccagttaccaccccggaaaaagaaaggacagactcctaccccctaaaaccggcagaaacttccatggctcaacctgttctcccagtgctcaggccggtgggagtttctccagggacccctttgtatttgaatgtttcattttctttccctacagaggtgtaaatgccagctgactggaatcatgtcatagatgaagtttctctctgagtgtggacctgtttcctgggttccctggagaacacaggcatttgagtcagccagatgttgaggggccctaccagggaacttctttatattttaaataagaagtcatttatctcacataacaagttagaagctattctgggttaacccaaggcacaatgatggcatcaagaaccccggctcttcccatattttcctctgccagagtcagtttgtcagtgatgattcctcacagctccaactgcttcgagccacatctgcagtggaaaaaaggcttcatattttaaattctaacctcaaggttgttgtggacgacccaggtggtgtgcattcaagttgcaagctgctttcccatgcagtcccactcagggtcacgagttctcaggggaggatttttttctctgtccattcagtcctgagtttcaagatgggcaacttgcctttcagatccctgtgtaaagaatgaaggtatttatttctagttcacctgactctcagggtgcagcccttggggcctacaatttacacaggaatctcacattaaacccctctccatgggcgggccttgggctttgtcctctgcccttacgcctcatgagacagtgaagagctaagctggaattcaccaaggtggtaaatgtagacctccctgaaagcttgtcctgtttacatctctgccttctcattttctcttaatttttttctttttttggcttcttggtattctttgctttcttggagctcgtcacacatttaggaggatttttgtcttttctggaatttttagttgttttttggtgggagggtctgtcagtgcatctagtcctccacactatggaagcagaagttggtttaaattcactttaaaaattgccttctgttttatcaattctgcctaaaggtttgttggagactgaaccgttgcaaggaacagacgaagatgcagtagccagtgctgacttctctagcatgctctctgaggaggaaaaggaagagttaaaagcagagttagttcaggtatgtttagtaatcttattgttgctatttctatctctggatcttaagagttattattagtttgatataataattgtaatgatgttgtattgtaatgatgttgtctttcatttaataaaatttataaatgaatacattacaagatgattcatttttccagggtatttttctactgttacatattacttattagttacagttgtagaatgaatcattgtgctgcttaagcaacaataataaccagttttaaatatacacttcttattctttttactgtcagaatactatgggaataataaattacttacaaacctgatagaattcattccagaccatgttataggtgcaagatccttttgaagatgggttctggttttaggtcagcaacttagctcaacaattactttgaaatgatttttttaaatgaaaaagtcaatcatagaagcaactgaatttataagttgtgtactttttggcagaaaaataaagctctaggggtagagaggaaagcaatgcttcatcgaggcctaattagatcttgtggagctgctgtggggatccggacctagggaggaggaggatgtcaggctcattatgaatacacatctttgttcaagtcttttgcttgcaatacccactttagacactttgctgacaagcctttactttctaggaggagagtgttgtaaaaagggctccttgagtaggaggaagcagcagagccagaggagctgaggccaacattccctctgcattctgtgtcctggctcataggccaggaagatcctgttcccacagaagcaaggcttggccttcctgctttggcctctccacaggctgaggacacagctctgagctccaccttaccctctccccactttgtccactctgaactctgagttctagcctcctgatagtgtttgtctatgacagctcagaataatattaaagattttcaggtgcttttacaagacacacctccaagttaatttcatttcaaaatgaaagagcagcacgttcctctggtataaccaaaaatgatttcagtaagcacagtgcctcaaatctttagctgggtctgtctgtggccactgagtggctgcacgtaccagagtgcacagaccaaagttagcattaacagataatggactgactccacatattcttatggcctgaaattctggctcatgactagttcatgtcaactgcagggtccaaatgtcatgttctgcagagtggggtaagccaactgagtctaagctaaaacttcactccatcatggtgataatgctagtttaagtttaggcacaatgtctgtaactgaccaatttctataaaatgcctcgatttttatttttctgggctgtaggattactggggtatacatacatacatatactaatacatgctgatttttgtacattattttctaaatgtcaacagtgagcatgatactacttttataatcaagaaaaaagtaagtattggttttaaatggatgccccatgaatatgaaaaaatagaagtgttttcagaaattcctgtctcatttggccacagtaatacacttccagaacatttcactcctaagagtttttgagcctgacttctggaaataacaccagactctttgttactgtgttcaagttaccaggattcatgttttgcactagcctccatgcttcctggctcttatttctgggttcttcggagatgaagaagtaccgcatgctgccaaaggtagcgtcgtgacttccaggggcacatgagcacagctctctgccccaggcctggtgaaaagcagagaaagtgtatctttgcgatttttcttcttcacatttctctttctcctcctccacgtcaggccacctctgctttatgctcattctgtttttaaaacagctttccttactcttttacaagtgtgcatgcggatgtgtggacacaggaactcaagttccctgatagcacgtatgcattcggattttaccttcaatgctaggattcaattttaacaaggacacatagaaagccatctctgcagtctcactgctggccttatgaagaactgaggcctcctatagagtcagcccctctgccccaattctccacagagattctttatgggcccctggtcacagacaactcctctttctgtctgaggagagatcctactgggtctgttagctccttgggtaccaaagatacctcagagaccagcctattagatgacggccttggagtcaggcactcagttgtggtcatgatccaaagcaagacctgtgtgtacaaggacttctgacccctgactgctttgctgaaaagaggtcttgagtgtgccaggtgtccagcctcctctttgtttccttcctctccctactttcctcgtctcttctgtgaaataaataattcaaaataaaagctgttgggactttaaattattttgagccttgaaggaatgtgaatatgggacctgagtcacataacaggcagctgtgacctaggcagctgtaacctgtttctctgattatagactagccttttcattacctacattgttttgtaaaatgctataaaagactaaagggcaccagagaagacctcttttattatagattaacttccctctttattctcttacacaaacgccttagattgtctaagatggaatgttaaacatatacttttaaactggaaaagaaaaagaaaacaaactgtaactaatcaaattgctgtaactcataaaccagcaatatatgaaaaatgctgtaatcctattaaatttctttgttttctgcctgtgtaaataagaccttaacttttcagcttcatagcactaaccacattcctttagagtctgtgtttcccagatgtctatccttagcttttcacttgaattaactcttaaactggattctgatccattttattatttcaggttgacacctcctactgctttctggctatgctggattccttcctcccagctctctttctcttccctcccctctgtcttatcctgcattatcttgttgataatattcccatgaggttgcccttagacttcaaccaatctcataaccccattctctcacacagccaacatatttttgtgtgcttaccaagtgctggcaagaggaagacttcttttggtaggaaacgtaaactaagccagtagtgtccaaaaggcttacatcttggacaaattcagcattttaaaagaggaatctcttggccagctgtggtggctcacgcctgtaatcccagcactttgggaggccgaggtggggggatcaccagaggtcaggagttcgagaccagcctgtccaacatggtgaaaccctgtctctattaaaaatacaaaaattagtcaggcatggtggcatgcgcctataatcccagctacttgggaggctgaggcacaagaattgcttgaacccaggaggtggaggttgcagtgagccaagatcatgccactgcactccagcctaggcaacagagtgagattccatctcaaaaaaaaaaaaaaaaaaaaaaaggaatctcttttaacataacttgatctttaatttattgttgtggtcatgcaatatgtatcttttttaaagttcatcaagtgtgaggccaatatcacctctgatctggtgcagtggttcatgcatagaaggaatgtaattaatatttataattagcttgagttattttatattttaagcaaatatttatatttgtaaattccaaaagtagaatatgctcttttttttacaaaccttgtcagtaaataaagaattaatcttttgtttcagatatttattctcattggtcttattaccagacaccttttctgaagtctttacacacctgttttttttttctctctctctctctttaagtacacttgcccaataattctgtgccactatcatcccactcccactttaatttcactaagctgcattttatgtttagtatttcataatgtgtcttgccttttgaaaaggataaagttttggcattagtactgtaaatttgtgattatataacaatcaagtactgccaatgtccctgagataagatgacttaagagaaataggcattaataggaataggaaaaataccagacagcattatcaagtaagtaaagcctattttcatgctctctcaatctctcctttggctctttcctcttcctctggtctgtgcagtccccaagaacacacagtgctctcaagctaacggtgtcttacacttgcaaagaagtgccttaggctctgggcctctctctctctctctctctctctctcagctccttcctgaagaccttaactctttctggactgagctagtgaacagctaatgtcttcataaccataatatcttattgttttgcacctcttagtcagtatctgcattttaatcttgggtctcttagccaaaggcaagagtagcccagagaggcaggccttgaagccacgtgcacgtgagaccaaatgtggttactcctaaataacatactgatgatgcctagtttatgaaaatagttttccttctgggttgcagttagaaattttatgtaatctagcagataaaactgaaaaacaaattttataaatttcatactgaagctaattcattagctaattcagactagttagttcacttttttgcatttttctttagataaatttatataacataaacttatccattttaaagtgaccaattcagtggcatttagtgcactcacagtgttgtgttgtgtaaccaccacatctgaaaggaaacttgtactcattaagcagttgcttccatttcccacttcccagcctctggcagccgccagtcttcattctatctctatgggcttacctattcttgatatttcatataaatggaatcatacaatatgggaccttttgtgtctggcttctttcacttagcctgatgtttttgaggttcatccatgttgtagcatgttttagtacttcattgtttttatggctgaataatattccattttatttatctactacaatttgtttatccattcatctcttgatggacatttgggctgtagtcacctttggtctactgtgaatagtgctgctatgaacatgtgtgtccatgtatttgtttgagtaccagttctcaattctttggggtatatacctaacagtggaattgctgagtcctggggaaattaattctgtgtttaactttctgagaaactgtacgactgttttccacagtggcggaactattttacattcctgccagtaatgtacaaaggttccaacgcctccacatctttgtcaacacttgttattttcctgttaattcatatttaaataatcaagtttaaatatctaatattgggcataaatattcatcctacaaggagatcttctagggagtcaagaaaccaaagaactagaccattaatttgcaatgcagaaataattaaaattaaaaggaaaagatatattaaatactttaattcattaacatgatttacttgcacttcatctcattccaaattggatgtggcttacagaagtacttacagtttagagtttccatactccttgtatcagaatctctgaggatgcttgctgataacacaagcagtctggctccaccaaatctaaggccttgaactctcagggcattaaaaggcagcagatgcctgggaatctgcattttaaatatgctttcttatttaaactgaagttgagaaccactgagataactagaccaaacgatcgcagtcaaataaaggattgaagttcatcagcagcagcctttaaggtatttgtaagtaaagacctcattgtggcaggactcttggttctgtacaaagagaggttgttggccttttggaaccttacacgttaatgtaattaaagattgtctgtctttccaacttttgcgattagtttttggcatatatttagatctctgataaatattctgaacgttttgaaaagtgtgagtctttatattgcattgaaatggttagaattttattatagaatctgagaatacacccaacttaaatagctgacttcatgtcttcattattagaggtctcttccccatatgtgtctttgaaagtgtgcctgaatttttgaattattaagtgtgggactttatatttcttttttttaagaatgatttttgttaaattggtcactttaatgtttctatcgcttttgggggatgaagattttattaaaaatttaatggcagctctgaatcctttcctcactccccacctccagataacaaatgaataatccacagcccctcgtggtttttaatacacttatggggctccatggctatgaggttgagaatattaaggtgttcaagcctctttctccttgtgtacatctgtaatttatttcagcaagttaaaattttccccttatttttttacacagtggaaaatactgtaacactcaatatacccccacccccgccgagaaaaaacccagactcccagtaatttcagtcactctaaatgaaagaaagcagaaatggcctttttaatagagaataaaaggctgacatgaaccccaagcattttctgtggtaaaagagcaagagatacaaccatgagaaatattgggcagcagattaaatggaggaggacacattgacaaagatgaaaaagagaaatatgacatgataacaaaagaatagaagggcttaattttaaaataacagtgtattctcatttaatggagagactaaaagcattattctctttagtggtccctaaacatactccttttacagtaatcagtgtatgtatgcacactgaagactcttgctcatcaaggaaagacagggttctattgattatactatgtttgtagaatatgtaattcactttagattttagaaagatgtccatgtacatataaaaaatgttctgtgaacataaagaaatggataatgttaaattgccaggacattttgctgatattaaaaaccccaagatattgctacttcttactgtggtatttaagatgcttgtgattcagtatttctgcttgttttgcttacgtgattatttgtgtatataaaggttcgcaaaaccatttctgtctgttcactattggcgctagtgaaagactggggggttttattgcatgttttgcttttgcaaaggcagatgcccttcttgagctgctttcccaggagctgtgactctggtgatccaaggaacgcatttgcaagatgactgacagcctgacagggttggtgtgatgcagcttgtggtccgaagtagagtgacactttacagtaaatgagccacagttgctcctttttaaaaaaaatttagtaagaaatccactaaagtgacagagttttattacctccatgcatgtgggatactaaggtagttctaatgattcttttccggcttaacaaggaaaagtcacaaaatttgttttccatatttcagaaaacaaagatgtaaatgtaagcactgataccagagcaatatgttatagagtatgacaactaattaaaatcaaagactttgtgatttattcagatttattttcacaggatagaacagcactttccaaaatctgagtactttacagagctcttttgttagaaattgcatttgcaagagcaattttatagtgctgaagagatctgcttttctgtagcacaggggaaagaggaaatatgtccatacgaagccttgtacatgaatgttcatagcagctttatttgcattagcctaacctaaatgcccttcaacaggcaaataaacaacacactttggcatattcattcaatagaatactactctgcaaaaaaaggggaagaaccattgataatgcagcaacatagatgaatataaaataactatctgcaaagccaagcaaaaatgagtgtatactctatgattcaatttgtataaaattctagtaaatatctgcaaactaaaccctagggaaagaaagtcagtcagtggctgtctggtgagagtggattgggggaaaggaaagaagagggagggaggaagaagaagaagcaagtaaaaggtgatgaatatgttcacttccttgattgtgataatggcttcacgggtagatacatatgttaaaacttacaaattatacatatacactttaaatgtctgcagcttattgtatgacagttacaggtcaatgaaactgttaaaaagaaaaatcaacacaaatcactcttttacatacatcctctaatcccttgttccttcctttcttaaggcattagcttggcaaaaccccattgtctgccaattccattcctgcacctatgcaactgtgtgtggttggcaaaaaataaactacactgagaccaggcgtggtggctcacgtctgtaatcccaacactttgggaggccaagacaggagaatcccttgaggccaagagtttgagaccagcctggtcaacatagtgagaccctgtctctttaaaataaataaataaagtggcacttgagaagaagttatataaaataagggtacagtagaaaaccaatttttgttcaaaaattatgtctatatacaacttatagaaagaacatttggaagtttagaaaccaaaaaataagcagtggctatttcctagcaggatacaggtgatttttattttcttgtttatgtttttctgtacaatctcacttttttttttaacaagcagcataaattacttctataatcattaaaatgaaaaattctgtttctactttgagatattagactatcatctgtatggggtgtatttggcaaacctacacatgggattgtataaataggagggtcagaggctgctttggaatacccagagcttctgtaagtatccttttttgctggtctgacattttcccccaccatttcccctccgccttgtagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcgtaagtatcatatgaacagtgttttattaactcagcctgatgtctcctcactctgttgtgttttgtttcatttttcctacaaggctgatttggtgcatgaagctaggaaaaaaaaatactttctctaaaagcaaagcaaagaaatgtgaataatcattaagtatgctgcatgtgaagcagattctataaagtagcttcatgaaataaaactctgttcactgaaactctattttcactcagactactttcattaggttttattgtttaaatgtttttctctttatatttttaacatttgtcaaatatactttttttaaaactttttctcataaaaactataaatgggaaggtgttttctcctcagcacacttgacactcactatgtatgtcttccaaaagtggttggcagtttcaatactgacttgctggcaattgatttacaaagaaaaccttgtacttttcatcttttgttttgcacttttcattctcactattctagggaatatttagagctgggtttagaccagttttagagcttggtttagattacagttttggccctgtaatcccagcactttgggaagctgaggcgggtggatcacaaggtcaggagatcaagaccatcctggctaacatggtgaaacctcgtccctactaaaaaatacaaaaaatcagctgggtgtgatggcatgcccctgtaatcccagctactcgggaggctgaggcaggggaattgcttgaacccaggaggcagaggttgcaatgagtcgagatggcgccactccactccagcctggcgacagagggagactctgtctcaaaaaaaagaaaggaagaaatggtttttgctttgccattatcgtcctgtcttgtgctaggtaaggtacagaataatctcagttattctacaatcacactttttttattagattattcttaagttgcatgaaatatttaatgatgatggtacttttctaatgttgcaaagtattttacctgctgggggtcttgtaccaaaggggagtactccacatatgtgatgtgatttttcttctttttgtgtattgggggttaggggctgatgaggaaatcacagaggctttatccctagccctaactttagtcccaaatttcaccattaagaaattgtctttgggttatgcattttcttctctactatcacactttggaaggtaaagatattgcattcctaatacctaagtgggagtcaatttttctttctcctaggcatagaaaggcctgatggtaggaagaggtaccaataattgacagcaattatttcagttttgccagcagccaaatttgcctgctggttcctaagaactaagatgtaagcctttttgctcctatgagaagatgtcctttgtatgaggaattgggtctaaaacgagcatgacatctccccaacttccttagtttccataagaatgagaatgtttttctccctctaaatatggcctagcagtcctattgggctctatgcttgtgcaccctaaggactcaatcagataggttcagggcacagcccagagtcaggcagaatgtagccagggagcttgtcagtttatctccagaagttaaccaacattccccaacctaatgatgacaattacgggaaaaaataagaaaccacacattgatgtgcagcaatttaaaagataagttgcaacaccatatgaacaatctcctgaaaggataactggattttaggcattaaattaaatgagcttatctgtcagtagttttggcctctgtctttccactttcgtggccaataccaattaatggccctgacagtgtaaagttgaacaagctctaattctctgggtttggtcacctctgtatttaatccaggcctgagggtttcgtataacactggtctgaacttccctgtggggtataagtaccaggaagaccttcctgcatggccttcctaatcacattgcataggtaaactaaccaaatggaaggtggggcaatgctggcagttttgttgctgaaggagagaggtgcctggcagggaggtgggaatgtctgagcagagggagtgtcaagtttgtgcaaggtctgccaggggaagggaggggagagactcatattcctcctgggactggaaatagagctggcaagttcaaggaaggcttctagcctcttcccacaggggataatgtctaatttgtgtttttccatgtttgaaaaactaataggttttatagccaggtagtctacttaatgtaaagcattttgctggatgaatagcctagatttattccctggggttatggagtttagagtctagttaggaagacagagtttgagtttttgttgttgttgttgttgttgttgtttgtttgtttgtttatacgacaaaatcatggacaagggggatagaaaggatttggagaacagatcaacagtggtttgcaggtggatgatgaaggaaataggaccaagtgtgatgtctaggcctttgacttgggctactgagtgagtgttggaactgtttacgagcattgtggttaggctcatggttgcttgggttgaaatctaggccttgctgcattcatgaagtgagatcatcttaatgccgatcccataggtagtgaagattcagtaagttaatgttcgtaaagcctgcaggacagcatctgacactttgtaggcatgaaatgattatttgctgctgtgagaaagactgagaaacaagtctggaggagaggcacaataattcgttttggctccgtaaagtctgaaatgcccaatagataaacagatttataggctgagaggacaactcagtgtaaaagtttaaggcagagatggacatttgggattcaactgcatatagataacatcgaaaactagatgactagatgagatttccctggggattacttaataaatacaaatggtcatgaactcactaacctttaggaatgaagtgaactttcctttgtagggaagaaccagtccctctctttaggaggaggcataagtctatcaaccatataatttggggaaagggtctgtccccaaccctttcttcttggttgttgagggaaggcagcggatcttaatcatatgtttggaggagcgataaaatctgtatccctctgaattaattaaacccctgctcttagtgctgtttatgatacccattccaggacaaaatctgcacctcatctgatgaaaaatttgatgtgaagaaatgatgagctatgatcaggttaggttaggtagaattagatttcaaagcactaaaaaaaatttttagctgtcagaggatgtgtgtgattcccagaggcaatactttgcatactgattaagcaatcatgacctatttagtttgatttataatgaaaagaaaatctatggtatgttaatgaaagatcttggcatatttcagtctgcagtaggattcaaattgaaataggccttgataagtaggaataattacacagcagactgaaattacctcctttacagaaagattccaggaatacaggaaaaggtcaagggatcatcggtatccagggtttcttgttgctgttgttcttgtcatagttttttacttgcctagatttgtatctaagaacatacaaaaaagtcctctccattttttggttttctgctgcctttttatgttgtctttagacttcaaggagacatgggagaggtgggtgactttggggtaaaggaggagaaattgaatctcttctgtaggcagaagtagaatcaggaaatacaactttatggtgggctattcaaagcagtgggcttcatgtattcaacaagtattctgctttgctaacccatgaaacatgaaatccccccactaataaacccctctgaatcgtgccacaatctaaatggtaagtcgacagagggcagaggttttggaaaggaatttaaactattccatctttttgaaagcttaataattttatcctacataaagaggacgaaaagcctcacattcagcattttaaaaacgcacagtgctcaaaaattgaacgttagtttatgatttatttactctttgattttgttcttctaagacttccaggccattaatggtcaggaattcttattatctctttttatgagggagcctggttgtagcactattgagttcaggagtgccagtgaagattaaagacctaattttaaaagatgtacacacccaatctctcacatggttgttcattctttttaccttcaggctttcatcttattacacaaggcaggaagtagattcttttcttctagattcaagtggtaaatttatgttctgataacatatttagggagcctttggaataaaataatcttaaatgtttttttgtatctttggtgaaatgctgcatattcaaccattaaaggaacactttcttttaaatctcataagaggaaatatattcgtgctgtaaaatatcttcttctaaaaagatgaattttttatttcttctagttgtatgtagaaaaatgctttatttaagtcaaaacaatttagaaaacaacatgctttctccttttgattattaacaccaatgttcaaattagtaaaacatgtcaagtggactttgcatgaaaagtcaacagaatgctttttatttggcttgcagagacccttacctcacactactgaagatcccctgttggcgtgctggtcaaacagctaacctgtccttgccaataaatgctatccattccagccaaattgagtttctgaaaagtagagcccactttcctgttgactttcattgaaaaacaggaagtttacatgtactcaacaccaaacatctctcagtaaacagtcttaaaggacttaatgcatatcaggtgctctataaacattagctgccattgctttaaaaaacattagctgctattgccattgctgccaaagaaaggcaaatgtttaactatgaaagtaatggcagctaatgttcagccctagaccagatttgagccttgttgggaagtgcaggtccctaaagcagtgttttctgctagaatggctttagaacacacaagggcaaatttctcttcactcacctgaaagcttcagttgttctcttgagttagaagcttcacattggaaactcctgattccgctcctgtagctgaagtgaggacaggcacagaacacagacttgaagcatatactttcaacgtttctgccacctaatgcacaactgacggcaactcaaagatatcttacacattcctgcttttacttaaggaaaacatattgttcctctgctctatcaattatgtaagtcagcaatggtgaacctatatttagcttaaagtaagagacctagcaatctgaaatgctaaatactatttctatttaagttacaagattgtcaagtcaatcaaggtattagtatttaagttgtttttcattatttgaatattattgcacatagttttatatgatagggttgaaaaacaatcttaagtattaaagatgtgccagattctatggcataataaagggagtaaaatgcaatacatcattgagtgccatggctcacacctataatcctagcccttcaggaggccgaggtgaaagaatcacttgagctcacgagttcaagatcagcctgagcagcgtggtgaaactgcatctttacaaaaagtgcaaaaaatcagccaaatatggtggcgtgcacctgtagtcccagccatttagggggctgaggtgggaggattgctagagcccaggagatggaggctgcaatgagccatgttcactccactgcactccagcctgggtgaccaagtgataccctgtctacaaataacaataataataataataataataataataataaaacaccaacttcttttggctgataggaggggtttttttccccaagactcaggctcctagcttctggatggggacctatcttactcatgcaactttaagatcaagttcaatcaggatgcagcataaggttacagggcctgtgcaatacgtaactcctgaggtaccatttgcttagaccaggcatgtccaatatctgggcttccctgggccacactggaaggagaattgtcttgggccacacataaaatacgctaaggatagctgatcagctaaaaagaaaaaaaagttgcaaaaaataaaaataaaaactcataatgatttaaggaagtttatgagtttgtgttgggctgctttcaaagctgtcctgggccacatgtgacccataggccgcaggttggacaagcttggcctaggctatggtgtgagtgctgctccttggtgcttttaagtacttggagcccaatggcctatttctcatggggtctctgattactttgttcttgaaaatcatttcccgacatataaccctttctcactgtttacccttttgaaatctctttcaattgttgatttccaagtaatgtatataaaatagcaactaactgttttcaagaaatatgatggttagctgggctcagtggcgcttgcctataatcccagctgctggggaggctaaggcagaaggattgccagagtctaggaattcgaggccagcttggataacatagtgggatcccaagtctatatatatataaaaggaatatgatgtttagcctaaggaagaggtgtaaaaatgtggggggaaaatgtgcattttagcattcttgaaatacagtattatttctctctctgaacactggtactgtagaaagctgacccaactcacctttaaatgtctatcatcttcaaggcagcaagacattttaatggaaagcaggcaccctggactaggccctagacttacctgtgtcactaagattcacataactcttttgggcctcagtttcatcatctgtaatctgaagggatttagctccagtgcccttcagatttaacattaaataattcttggaaataaggagtcctaaaatctttaacactgcattaaactacctgtatagctgaattttaaccataaaatttcatatagaaatagacttgcatttttcatggtggggacataaataatattaataccacactaaagtaatcagatcactgcatatgctcacctcccattttgctatagaaatgtgtttaaaacacaatgtagctatcacctattttcaatatatacttctctctagctagctatatttaaattatgcattaaattcagaatgtcacacacacacaaacaagtgtttaaaaaatcatatcttagttcaaaacattctcaaatatataaagttaaactacatggaaaagcttaaaagaaaattaaatattgggtctaattgtaagaattcttgaagaaatgtggaaccaacacaagaatgaattctctaactagtagccagtcccaacttcatgcaaaagccacagatattgcagaatatttatttacttttcccttgagtcacgtttcaggccacacagagtcagtggcaggtggttgctcaatagactttcttcctttcctccacccttccctggtttcctttttacccttatcactcccttctccctagggctcagtccattctgcaggcaccccaagtggccaaggccccagggacctctggccttgactagacagaaagaggttgcttttacagtcttctcaagggtgcaggcttaagtctttttaattcttcaaaatgggacatttaaaatacagcacaacccttttcgtgccatatttgatagcatcacaaagcagaacagctagagcagagaccctaaggtaggagggggcctggtatgttccagggacagtgaggaggctggaaggtctggagcagagtaagaagaaatgagaggggaccagactgtgtagggccatcagaaggcccaccaggtggactttggcttttcaccgtgagtattatgaggagatagtgcaaggttttgagcagagacctgctccaatttaatgctttaatgggtccctctggctgcggtgttgaaaagggactgtagaaggataaggtggaagtatggagtttagttaggtgattgcaagagccccggtgagtgatgatggcggcttgaactaaggtggagagtagtggaagcagtgagaaagtagactccacatctattctgaaagttgaaatgaaccaacagggctttcctgatgaatttgatttggagaatgaaagaaacagaaaggttaaagatgatgctagtctcctattttgggcattcaatagattgttctattttcttaccaaaacacataagtttttgcacaggaaagtttttcttgatgtttttcagaattatgatgtcagtagagtcctggattgagcctaattctgaatcacagtccatagtgtaataatgtttcatcagcatataatactgtactttcctcacttccaactcctttatttatttaatttatggcgcaatttcagctcactgcagcctctgcctcctgggttcaagcaattctcctgcctcagcctcccgagttgctgggatcacaggcatgtgccacccagccctgattttgttttgttttgttttgttttgcttttttagtagagacagggtttcaccatgtttgccaggctgatctctaactcctgacctcaggtgatccaccctcctcagcctcccaaagtgctgagattgcaggcgtgagccacgacgcccaggcttgaactccatttttaatgcccttttcacagatctgatttcattacccagttactacttactgaaaccttcatcagcatcctaaaaatataactgtggtaggaagtccagatttttctttatttatttgtaagtaagtcattttgttcttaaggccaagacactacatttacatcttgctttctgagtctagttaatccaagtgttcaagacactgctttggaaaactatttagtagcaggcttcttctgaagaattcttagcacatgacatttcaagatcacacctcactaaaatcttctaatgatgattggtgtttttatttctagtctttaacatttttagtatttttaactgtcttatcactaatgacaatttagataataattttttatctttttaaattttatttcaatagtctttgggaaacaggtggcttttggttacatggataagtttttcgggggtgatttctgaaattttgatgcacccatcacccaaacagtgtacattgtacccaaggtgtagtcttttatccctcacccccctcgaaccctttcccccgagtccccaaagtccattatatcgttcttatgcctttgcatcctcacggcttagttcccacttagaaatgagaacatacaatgtttggttttccattcctgagttacttcggtctccaactccatccagattgctgcaaatgtcattatttcattctcttttatggctgagtagtattccatggtatgtaggaatatatattaactagactcagaaagcaagatttaaaagcaagatttaaatgtagtagttttggccttaaaaacaagaggactttttacaaataaataaagaaaaatttggacttcctaccacagttatattttatatcacattttctttatccagtcatcagttgatgggcatgtaagctggttccatatttttgcaattgcaaattgtgctgctataaatatgcatgtgtaagtgtctttttcatataatgacttctttccctttgggggaaatcccaatagtgggattgctggattgaatagtagttatgcttctagttctttaaggactcttcatactgttttctgtagtggttgtagtttacattcccaccagcagtgtaaaagtattcacttttcaccacatcaacgccaatgtctattttttttaatttttaaattatggtcatttttgcaggagtaaggtggtatttcattgtagttttaacttgcatttctctgataattagtgatgtgaggcattttttcacgtttgttggccatttgtatatctgcttttgagaattgtctattcacgtctgtattagtctgttaatgctgctgataaagacatacccaagattgggtaatttataaagaaaaaggtttaatggattcacagttccacatggctgggaatgcctcacaattatggcagaaggtggaaggcacatcttacatggcagcaggaaagagagaatgagagccaagcgataggggaaccccttataaaaccatcagatctcatgagacttatttactaccacaaaaatagtatgtgggaaaccatccccatgattcaattatctcccaccaggtccctcccacaacacgtagaacttatgggagctacaattcaagatgagatttgggtggggacccaggcaaaccatatcaatgttttttacccactttttgatggggttgttttgttcttgctgatttgtttgagttttgagtttcttgtaggttctggatattagtcgtttgtcagatgcatagtttgcaaagattttctcccactctggtttgtctgtttgctgattatttcttctgctgtgcagaagctttttagtttaattaggtcccatatatttatttatgttgcatttgcttttgtgttcttggtcatgaactctttgcctaagccaaggtctagaagagtttttctgatgttatcctctagaatttttatagtttcaggtcttagatttaagtctcacattcatcttgagttgatttttgtgtaaagtgagagatgaggatccagtttcgttcttctacatgtgactttccaattatcccagtgccatttgttgaatagggtgtcctttccccactttatgtttttgtttgctttgccaaagatcagtttatgtaagtattggcttcatttctggattctctgttctcttccattgttctacgtgcctatttttataccagtaccatgctattttggtaactacagccttgtagtatagtttgaagtctggtaatgtgatacctccagatttgttctttttgcttagtattgttttggctatgtgggcttttttgggggttccatgtgaattttagaattgttttttctagttcagtgaagagtgataatgatattttgatgggaattgcattgaatctgtagattgctattggcagtatggtcatttttacaatactgattctacccattcatgagcatgagttttcatttgtttgtgttatctttggtttctttcagcagtgttttgtcattttccttgcaggtatctttcacctacttggttaagtatattcctaagtattttattttttattttttgcagctatcgtaaaagggattgagttctttatttgattctcagtttggtcactgttggtgtacagcagtgctactgatttgtgtacattgattttgtatcctgaaactttactgaattcattcatcagatctagtagctttttggatgagtttttagggttttctaggtatgcagtcatatcatcagtgaacagcaacagtttgacttcctcttttctaatttagatggcttttatttctttttcttgtctgattgctctggctaagacttcctgtactatattgaatagaagtggtgaaagtgggcatccttatcttcttccagttcttgagggaatgctttcaacttttctcccatttagtatgaagctggctgtgggtttgtcatagatggattttattatcttgaaatatgtcccttctatgctgattatgcagagatctttaatcataaagggatgccatattttgtcaaataacttttctgtgtctattgagatgatcatatgatttttgtttttaattctgtttatgtaatgtatcacatttattgacttgcatatgttaaagcatccctgagtccctggtatgaaatccacttgatcatggtggattatatttttgatatgctgttggattcagttagctagtattttgttgaggatttttgtgtctatgttcatcagggatatgttttcttttcttgttatgtcctttcctggttttggcattacatttggtgataccagcttcatagaatgatctgggaggatttcctctttctctgtcttttggaatagttctggtaggattggtaccaattcttctttaaatgtctgatagaattagctgtgaatgtatatggccctggacttttttttattgtcaatttttttattactgtttcaatctcgctacatattattggtctgttcagagtttctatttcttcctgatttcatctaggagggttgtattgatatatttccaggaacttatccatctcctctagattttctagtttgtgtgcatgaaggtatttgtagtagccttgaatgtttgtatttctgtggtatcagttgtgatatctcccatttcatttctaattgagcttctttggattctctctcttgttttcttggttaatcttgctaatggtctatcaattttgtttatctttttgaagaatcagctttttgtttcatttaacttttatatcttttttttgtcagtttcatttagttctactctgatctttgttatttttttttttcttctgctgggtttgggtttggtttgcttctgtttctctagttccttgagatgtgacattaggttgtctatttggggtctttcagactttttgatgtagtcatttaatgctatgaaatttcctcttagcactgcttttgttgtatcccagaggttttgataagttgtctcactattatcattcagttcaaagaattttttaatttccatcttgatttcattgttgaccaaagattattcaagagcagattgtttaatatctatatatttgtatagttttgaggcttccttttggagtcaggatacttgatatgaatttggttttcttaaatttattgagacttgttttgtggcctatcatatggtctatcttagagaatgtttcatgtgctgatgaaaagagtgtatactgcaattgtttggtagaatgttctgtaaatatatgttaagtccattagttctagtgtagagtttaagtccattgtttcattgttgattttccatcttgatgacatgtctagtgctgtcattgtagtattaaagtcccccactattattgcattgccatctatctcatttctcaggcctggtagtaattgttttatgaattttggagctccagtattcggtgcatatgtatttaggattgtgatattttcttattggactaatcctttcatcattacataatgtccctcttggtcttttttagtgttgttgctttaaagtctgttttgcttgatataagaatagctactcctgctcacttttagtttccatttgtgtggaatatctttttccacctctttaccttaagttgatgtgattccttttgtgttacgtgagtctcttgaagacagcagatacttggttggtggtttttaatccattttgccatcatgcgtcttttaagtggagcatttaggccatttacgttcaaagttagtattgagatgtgaggtactgttctattcattatgctagttgttgcctaaatactgttttgttttgtttcattttgttcttgttttataggtcctgtgagatttacgctttgatgaagttctattttggtgtatttcaaggttttgtttcaagatttagaactcccttgagcatttcttgtcaggctggcttggtagtggcaatttctctcagcatttgtttgtctgcaaaagactttctctctctttcatttatgaagcttagttttgctggatacaaaattcttggctaattgtctgccaattattttgtttaaggaggctaatgatgggaccctaatcccttctggcttgtaagatttctgctgataaaccagctgttaatctgataggttttccttaataggttacctgatgctttttcctcattgctcttaagattcttttctttgtcttgattttagataacctgatgactgtgtgcctatgtgatgatctttttgtgaataatttcacaggagttctttgagcttcttgtatttcattgtctagatctctggcaaggccagggaagttttccccaattatttcctcaaataagttttccaaactaaaatttttcttcttcctcagaaacagcaattattcttaggtttggccatttaacataatcccaaatttcttggaggaggctttgttcattttttttctttgtctttgttggattgtgttaatttgaaagccttgtctttgacctctgaagtttttttctacttgttctagtctattgttgaaactttccactgcattttttattttcctaagcaagtctttcatttccagaagttatgattgttttttccttatgatatatatttctctggaaaattttttattgatgtcctatatttgttttaagtttctttaagttagttttcagccaacttacctttctcttgtatctccttgagtagcacaattctgaattctttatctggcaattcagagatttcgtcttggtttggatccattcctagggagttagtgtgacctttcatgggtgttatagaaccctggtttgttttattactagaattacttttctggtttcttctcatttgggtagactatttcttaaaattgttcttgaatttatttttgcttaaaattttttttaacttaaatttatttattccctcttaaggattagactttaatgtttattttagcctaatttaattcttggtgcttgtagggttgaagactcagtatgagatccttagttacagaaagtttttttgtgtgctggctttcccttatgctgtttgtagttgttacattcttggtgagtgggtgagttcactgcctcttatggagttggaatggcaggtatctcttgaagcttatcttgttctctcatggtgtaccctttatttatttatttaacttttttcccactgttttatttactgagttgactttaggccattaggagaggtatccctggttaggcactggttgtggctaaggcaggtgggtagatgtaatacccaatggtgggctgaggtcccagccttgatgaagttggctggaggacctctcaattagatgtgctgaggtttcatcaaggtgaggagtgggagctacctcagctctcctgccaggtcagcaggaaagctactcacctcacagccttattcctgtcccagtgttctggctattcggataagacaggcacctcttttcatctatggaaatgttgatgttccaagtagggaagaattgtgactttgcctctcatgcaggcttgaatctggagtgtgttcctcctgtggggctgcactcaccctggattgttccagaaaggctgtctataggtgcctccattcttctgggggaagcccaactgtgtctgcagtagagtgccaggggaaacaaggaccccttctttaaggtcctacacaatcacaggggatgcctgccgtttggggtagaggtacagactttccctactgtgcccagcactgcaattgtgtctctgctatgagaaacttcccaccactggaaagatttggaactcaaggcctgctgttcacattcttttgtaccatagggtgatcctttgatgtagtgctcgcccccttcccttagaaatgggacatcctgagagctggactgcagtgattgttatttctcttcttagtctaaccacccagcaggactaccaggctccaggctggtgctggcaaatgtctgcaaaaagtcctgtgatatgaccagtcttcaggtctcccagctgtggataccagtacttgctctggtggaggtggcaggggagtgaagtagactctatgagaatccttgggtttaacgtgccggctttctcagatgctggttatgctagcagtgaagtcgtcatgtggacagactcaggacctctggttagccaggatgttacaggcagcagtattagctgttcttttcttcttcctgggatcagggttattctgtcatgagttgcagtaatggcctgagttggtctgcctccagccaggaggtggtgttttcaagaaggcaccagctgcagtagtaacagtgggatttaagcttgcactaaattgtccaagggaggtattctggtttctcaggcaataggtgggtccataaagctctcaagagtttatgtcttctgtgttctgctaccacggcaggtagagaaataccatcaagtgggggcagggatagactctccttgggcgggtcagactctccttgggtagggcttgctgcagccactgtgggggttggggggtgtggttctcaggccagtgaggttaccttccaaaggggattatggctgcctctgctgtgtcatatagtttatcaaggaagtgggggatacctggtagcaaaaggccccacccagctcccacgcagttggcgaggccagtctcactcctgcagtgctctgctaatagagccgagtttccatccaggcagcctgtgcacaatgaactcagacctgccccaggccataggcttccctgctgagaaagcaagcacagctttcaggcctcgcccctacctgtctgcccacagtgttggtagctcctgccctcatatctgcagcagtttccactcaccccccagattctgcttaagaaagttcacgcccagtggcaattattataaaattcagttggaagcttctttcaccccatgacccctccctaattccactggctgccttcctggaggcgctctgtgagatacagttatataccttccctgggctcaagctagagaaactgggagtgcctataaggcttttcccattgctgctactattgtatttcacccagatccctgaatccattccagctctaatttaggttaaatccctctcctgtgatctggattttcagattccctagtggaattcagaggcaggtggttcagaggcagtgggttcagaggcaggttttctctcctctcgcactctaggaactcagtttttcacccgtctctcagaatttgcagtggtgtgccactcctttcaaaggatctgtgaattctttcggtgttcctggtaagttcctatggtggttcttggaacaaaagttcatgatgtgagtctccacacactattctgtctgagcaagtgcaagatgcacattagccctgtctcctatctgccatcttctgcctgtctccttgataataatatttgatttcatgtataaactgcctgaaattccatggtttcatgtagtcaaaaaatgtttttccaaaattaaaagctaaaatcatgtagcaaaatgtaaaaataaaatttaatttgaatgagctgacattttttggaccttcagagaaaaaaagaaattaagcaaacttcctaaaagctgttcatttctttcatcttgtctcatttgctgtttgacccagtgccatctggcatccacattccttgttctcctcacacagtcctctccagagacacaaattaccccctagtcaccagattcttccttgacccttattctgcttggtcttttcatttttgataggaaatgtctgttcagtaaatgaacatttggttttatgatctagttaatgtatgtttttatacttcctaaaaaaacattgtgttaataaataacatataatgctaacaatattatagacagattccattctgctcacaaaaagaataccacattaataaagttatttctgtcctagggaagaccaaggcacatatttgaaaatattcactagagcctgagatcatacttaggactggatgacttgtgggagatggaaggggtagaggaaaaagggcagttcctacatagctgatttcatagggtataatgttttcttacagataccatatgcatgcaagtataacagggttttgggagaacttacctgggagcagcataaatcagaagaagacagcatatgcattttaagatttgagggttttttttaatgtgtataaaaattttgttgatttactattattcctcaagttatgtaccttttatttcccactttcataaccaactcagaaatttctcatccctataggtagcatcactgtccttcctgtcatgatgctcacagcctcaggacaacctttggtcttgctcttatttatcacttaccatctcctgttgaatctgtccattctatccctgtaatccatcatacctctttcttttcctagtgccactactcccagttcagagtcacaaaaggttgtcccttttgatatcacccactcgttcatctactatttattgagtttcttctttatccctttgtcagagaccagggacacaaagatgaatggcttccttgccctcaagtagtcaagtctagtatgacataggcttatcaacaaatattcacagtatatattcctaaaactgttttgaaaaaaagtcactatattatcttcagataatgtgcttttattattcccagctataaatactagaaaagtaagctaaataactagctgtgttttgcctttttctggcttattttacccaaattaacagtgtaagcttagatgtaccttcaaaacctaaacctgcattctctaatttctgtgtcatccttgatgcctagagctgtcattgacaagtgtctgttttagaactaatacacttcaagaacaacattctgctcactgagcagttccattatttgtcatgaaagagctgcacattcagatctgtatttgtatttgtatctgtatatacttcctaaattcagatttaatggtctgactttccttctgatgaacagcagccaacccatcatccccagacaatgaatggaaacagtggttttgtggatcttcttcctaaatctgttgaggaaaggacattttcaaagtaaggagtgagaaggaagatgaattgtttatgggagatcatgatataaaaaccatgttgttctgttttatttctagctacaagaaaacacatgaaaccctgagtcacgcagggcaaaaggcaactgcagctttcagcaacgttggaacggccatcagcaagaagttcggagacatgaggtactgtgggaaaataccatgggaacggcgctaagcccttggctttccgattgaagggagcactagctattagctgctcatctcaacatatgtatttttttattttaatggataaaaatgttatatggctgatatgattgatgactaagataaattttcacactgggacattttctgcctgaaggtcaggcttaggtggcctggtcccagagttgctgtttctactaggacccgacctggtaaaaatagaagatacagggtagtgaggcagatttgaaaagaatgcagcatgtgcaaattcttactagctgtaatataaatgataaattaaaacatgcatttagtggaatgcactcccataaactattctagattgcatatttgtatacatccatctagtatattttttctgtgttaaataggtacatatttatccttttattccataaaggtaccacacatatacacttctggtagttttctttcttcattttctaactattttgtgagtatgttaaatatttattgcaccttcatttttaatgaatttatctcccagtgcgtagctatagcaatgcttttagataagtaaccttgcacattttcattattttcaatatttcactgttacataaaataagggtgaccatcaaggttgattttgacttgagaaccaaaagttctcactggaggcaccaggaaaaaaaaaatgtagtattgcccatagtttttcatattatatacaatattatatacaatatattatataccatattatatagaggtattactcttagtttttgcttatttaaataccagtcatagttttattttgcatttggctgatatgccttggaggatttttctttagaaatcagtttcatttttccctctattctttaaaaacttttcgagcacattttacatttcttctttaaaaaaaaaaaatctctgcgtatttattttactggattcttaaactgttacttttttattaaaaagaaaaagctttgggctgggcacagtggctcatgcctgtaatcccgtcattttgggagactgaggcaggtggatcccttgaggtcaggagttagagaccagcctgaccaacatggtgagaccctgtctccattaaaaaatatatatatatacacaaaaattagccaggcatggttgtgtgtgcctgtagtcccagctgctgaggaggctgaggcaggagaatcacttgaacccaggaggcagaggttgcagtgagcccagatcacgccactgcactccagcctaggcaatagagtgagactctgtctcaaaaaaaaaaaaaaaaaaagaaggaaaagctttgacactgagaggcaaatatcttcctaactttacacttatagatacatctttataaattatattattaaattttatttacttcaaaaattgctggactgtccacaatattcattcactattttaacaactaggcattcacaaggacatgtgcatgaatctgagtacattgttttatcttcatttttactaatgccacaataataaaaagtaattgaaattcttcagaagcaggtgtgataaacaggtaaaccttctggattattaattacccctaattttattacaaataaaatttgtaataattttaacggcgttataacatttatctaaactaattaaataatcctttaaaataggaaaccctctataacctgttatacccaagaaaacatattttcccatgtttataaaattgattctcttcatactgtgttgaaatctttcacttgaaccctgggaactccagcatgacactgctaactagaatagtgcttctgcatctttaggagatcttacaaacacctctgaagcttgtttagaatacatattcttaggttgcacctctcagaggttgtgctcagtaagtctgaggtggagtctaggaatctgcatttataacaagcttccagataatttggcttcagagggtcagtttatgaggaagacagacatagcttagctcacctgtatctggggttttcactaataaaatggagataagaataacaatgtcactggactgttataaaagtagcagaagaaagtctgacatgtattatgcactcaaaaaattgcagttttttatctttaagtgaccagctcagttacaagatggccccacatggtagaaattagggagagtacattaacaggagcccactgtatttcataaaggccctgctcattgtttttcccaatagtgaagaatgaagactgtgtttcacatatgcaatatgttggcattcatattcaaacactaattgggtacaatgtcaaggttgtattgactgcctttcctcccgtttcaatgtggctttgtctagtatagtggatggcctattttccaggacttccaaactttccatttgttattatcccatgtagagggtacaacattttcattataaactgtggctaaaaatattggaaaatacaatctgtgttgctagataatcaaatacaatcctgaaatattttgaagagtttgaaaatttcagagctttatttatataatattttatgtgtatatttctctcaaactatatctaacatttgtatataaatgagaataactctttgtgaaagcaacaagttttacaaagatttttacttttaaattatgcccaaacaagtaatataaataaaagtcattttgaaagtgtttaaacttaataaaagaccttaaatgggaaaaaatagtaagctttgattgtttgttcaaaaactaatgtgccaatttgtaaatatggggaatatgttaaaatttggtcacagaccttttattttaaacttctttttggttaaaagtgtcatattagtctacatttttattagttacactataacatttttgtgcattctggtaacaaatttctgaatgtattcaaaaacattaccagcaaaattcagatagcttggaagaacaacagtacctctcagtttttctttaaaataactccaaattaatatttacagattttgtaaaacctagaatttgggccttttaatagctgaaaaaaaagctttatgttaagatttaatttgtatgttttgtaaaaataagttatatttttctgagctaagtaagattctcattttaacctgattgtcatggaattgcccactctctttctccatccataaaataacattgttaatacccacttaaccaaaatatttcctgtgaagttaaaatgaggtcacacttaggaaagtactcagaagaaatccaagcggttggaatcatttttctaataacattggcatcttctgggaacttctcagttaatttgttcaaactgatccactggggacaaaatgtttggagaaggcatgtcattttattacagtccaatcattgttatatacttataggaataacagaagcaaaacttgagttggtaaaatgatttgtcagagacattaaaaagtcagtgtaatcaagagtggtaaatgaagctaccctgtctgtgctctggggcccttgaaaggggaccaccaagggcagtgcagtgtttctctgcctcctgtttgctaactctgctcctgctcttctctcctgtgcttccgggctgcaggtctcactccatcgggtaagcgccacggggctgcgtgtggggctttccccactcccttgctgcccctttgctttccagggctccctgtttctttcacactgtgcctgaaccaacaaaactacactctgttttccagacagttcccgtgaccaggaagatagtttatagggcacttaatacatttgaacttattgaagtacatctctatctcatttctgaatcatttacaccatttcacttgctgagctctctctcaggagtctctttctctgcaccatttcttccggtgttgacagagcttcttagaattgaaaagaagaagaaaaaaaaacaaagtggagattgaaagttatatatgttttctgaaacttctagaaagtaaagttgagaaacaaaaacagattttctctagattgtcatgtttctctgaatttcttgtacccataatttgtgttgatgtttcaccttcaactttctgtgccttctgaagttgaagggaagaaaggtaccggaaaagcacgtacgtatgttaagaagtttgtgatttttaatcccaagcccccgaattaaaacttcttttagccggaatcttattatatacttttatttttttaattttttcctaagaaagcggtctatatttacagagatacaccaattggtaatgcagatgaggctcttttagtgatgcttttgaagtgtaatttctgaggaaatatctgcctaatagtttctaaatcaagtgtctagggtaagaccgtaagtatcccatgaatttgtttgtccttttctttctgtgttctagcaaagtgctacccatactaatgccctcagtggatattatgagggaagggtgacagatttggtccctgaactattagctccttgagagaagagaaagcagggacgctgttgaaaagtgtgaggtgggagcaagcactaggccaggaaaatggacccattgtgctcctccccatgcccagcctgatttctgagtggaactcaatagaaagtaacaggcaaccaaccagagggaagatgaatcagctactaggattaatgggatgagaagtttaaatctcttaaaattctcaggaatgtttgtgtttgtaccagatgttcttgacagtcatctagtacaaatcaatcatcttgacaatcaaaccagaatggatgcagaagtccctatggcctatgagaactgtgtttgcctggcatgtgcttccttgaaagtcttatgttaacttcttgctttcctctggccagtttctctaccatggaatgattagcttctacctgcctggctctatttcctggatactgccttttgctccttactgttttcctgagcagaagggagtagagacctaagttgggcctggagaagatgcccatgggctactgggctcacctgggagaaaccagacattctcagatttcctggcaaaaggaggctgcagaaagtaaaataatatgcaaccacggatccaccatctacttttcatttatacccttgaaagctgactatacccattatacccaacaaaaacaaatgtcatcttggttagatgggcagggaatatttcagatatttggaattgctgttttagaactacgaatagggagtttttcatgtacttatgtgtgctctcttcttttttcttttttcccctttaatctgcttttgctctgaagttactccattcgccattccataagtatgcctgctatgaggtaatgtgtgtaaaatattttatgtaatattaatatgaaatgtgtttaaggtgttattttatttatatttacttatggggttcctctgctttatgtgaaaggaaattgctgatggtcttcaaaagaaaaggctgacaattctgtggaagaattgcgtagcttgggcttttgaccagacatcctggcttaaatctagtctttcctgtgtgatccaagacaagtgacttaacctcaattcttttatccatatattgcaagaaataagacctacttcatatggtgtttgtgaggcataaacaaaggaacctacataaagcatttagcacagtgtctgaacatgccaagcaatcttgcaaaggtaaacttgggtttcttatttccgcagaattaaatgctagcctgggggcaagtttaaatgcaaggctaaagttctagagaggatatcattaggatttttaaggtggatattaaggtgagatgtttgttaaataataaaatgtcagtataattactgaccagataaaaactggtgagaaagacattcttaacttcaagtttgcatggcatagtgatgcaatcagataaaattaaactaatagcaagacaggaatgagtgttaaattgaaaatcagaaaatgcaggctctagcccagctctgccaaggattaactttgcactcttgggaaaatcacctcaatggtatcagcttcatcatatttaaaataagaggctagaaccagattagctgcttgtcaaagatgcccctccacccaccgagccctaaggctgcctagagatgaagcctttgggatcttcccccacttcagtcagagctatgcctcttctacctgctttatattgatgttgttgtttgaaggcattatagaaggagtttagttactttcaatagtttgagaccgccgaagccaaattcttcatatatataatcttttcctctgttttttaactgtcatgaagagaaattcttcctagggtcatttgcagtgctaaaaaagtttgtacatctgattaaatcttattaaagttgtacatctgattaaatctgattaaagagcttctccctgttctccagcatgtattctagtataatttaattagataaatgtctgttctattatattttatgaaggaaggctcttctacactggggttatgtggttaattggttgatttggaaattcaccctcagtatttagttctctgtatttggtggtaaacagagagtacagattcaagattgcttaattcatctttgaatggcttgctctccctagaataagaatgccccagttgggtagtggaacctaaggctctgttcccctttacttgtcaaattttaaatctgggtgtcagaagaaggctagtaaaaattaacatggttttcccctgtgaaccaggaattcatctagtagtggctaatgggtcaaatgtagtctgcatgagcttgcccgaaactaacttaaaaaaaaattattttgcttgtctaacatatacccatgaaccatttcctcactgtgggcctgtgtaactgatggatgacaggcagtcatgtgtgcaggcttggccaaataaaacctgcaatggaaatgaagtgccaataactatatactttttgagtcatgcaagtataattttactaacatttcatcatgaaacagcattacggaggatcactcataggaatttgactcgtgtttgagtcgtacacaaaatgtgatgccatgtcagggccctctgaattcaccattgttaatctgtacagcctgaatgcaggtacatttctgaccatgtggagcaccaaggactcaggagacaatccccaaattcactcataaacatctatgttcattgccttttagtagtataaaagtgatacttcattctgcaccacataatgaaacctatattctatagctgttctcctttataaagtttttctaggccattcctcttattttacttttttttttttgcactcaagagagaataacaagtgccttattaattcaacatttagttgaattatttgatctgaaaatgatggcagttgttgctgctgaaagctgacatggatacaagatttaaaatacacttagttcagttcctgtttctttagtaggagctggtggtatttttaatggtggtgatgtcattaaattataatatcatggggccaaatccaatacagaaaaccagaaagcaccaaatgaagtttttagtgcttaaagcaacaaaattatgtatagattatttaatacaatgaatgagtcacaaataaaatgccattaggggccaggcacggtggctcacgcctgtaatcccagcacttttggaggccgaggcaggtggaccacctgaggtcagaattcgagaccagcctggccaacatggtgaaaccccatctctactaaaaattcaaaaaaaatagctggatgtggtggtgggcacctgcagtcccagctactcaggaggctgaggcaggagaattgcttgaacctgggaggcagaggttgcagtgagtcaagatcagttcactgtattccagcctgggtgacagaacgagactatcaaaaaaaagaaaaaaaaagccattaggctgcaaaggttctatttggtaagagaacaagtaggtatatctatttgagaggaaaaataacgcatgctaataacctccattttgattgggcattaggtaggtaatgggtatgtttcatcttaaaataatgaaagcattaactttccaaaacaccacttcatgtaagttgtcaaaatgattatttttttaaggcatggaaaagaaaaaatatatgaacatttttttccttgcactatttctgaattgtctcacatttgctgaaataaataactttaaaaaatgccaagtggcaaaactcaaacatgacattcatcatatggattttccattgcttactaaaaaacctgagtcaggaagaggagtgttgtgatagaaacaataaatgctaaatgaaaacttaagctacccattgctccactggctcattggaaatgatttacagtgtaccatggaattattacagttgtgtcattgccaaataccatattatttactgtattgtgtactgatcattttacctagaaaaattccatgtcaggttatggtttctgaacctaacctaacagaagtgacatacattttaaaacgtggttggtgcaggtggcaagctgacaggtagctctgtggcagaggccgtgtttacagatatgagcagaaaaccaaacagcatggttgctaagacagctaggcctttggagctgacctctctctttttgttattttaggaattctcctactttcaaatcatttgaggagagggttgagacaactgtcacaagcctcaaggtacagatgaagtgaattctgtgtgagtgggtccattgactcaggacagcttagccattgctgcggttagtttaaagtcgaggcagggccaagaaggcaggcttgcatcaagtcagaccttttctttcacatataaatctatgaataaaaccactattgaatagtgttactatatccttagagttgtttgtataaaccattcaggggtgaattgttcattaaagtgaattggggtatgcgtttaccacttaatctcttaatgctatccctccaaaagtagatatgtgagagatgactgtggataggataaaggctatatgaattctgaatttagagtgtgagtgaaagttcaataacagctcagagctgctctggtttggacatggaccagcaaaaacaaactggggactacgtatccactacccgtcagctacctagacttgtttataaattcaggtactgagcacagcacagtatggctatcatagagggaaaattaaactgagtcacaaaatgcattttataataacacagtaatgcatttcatccctgggtataaattgaaaatgtgcctattacagagtgttttaaaaattcactggaattattgttctagcataggtaagtttgaataaaaagagtaaaatgaaatcagtctagtcttaaaattgaacttttaaaacaagaaaaatcattacaactactaagattatttttaaaggtatcacttaatgacttaattacatcttgctatcattatctctattttgtatacaatccatttctgtattttaccataactgggaaaattaagaatatacgtgatctttaaccagatcaaaaaccttcatatcccatgctgattattcagctgcctctgaatcctgtatcttcacgctgctctcacgtgtgctgcctgataagtatatgtgaggttgtaagttattccttactcgcggttccaggtgctcttgtggattttgacctggagagtcttttcttagggcagggtctttcacatggtctacttctactttattagacccataattaggtgtttaaggcccaggaatgaaattattactcagcatttaccatgccttcatcagtttcattcaccagaagtttccagttgtgcagtttcaccgctctgcatgccaacatcatcgcttattgagcgtacaggaaccaatgggagccgttaaacagccccatgagtaggaaaatttttttaaagggaagagcatccaatgttgtgaacatttgatcttcttgctagaagatcaaaatgaaaggctcaaaaatcccaggattcagtttctaaacatttggttttcagccttagacgacccaatgaggatgggttccattgcttgttagacaagttctgacaaaggacaagttgtactttttaggttttctttagaagaaggagatatgaagaagcaaaagaagaataaagaacaacccattttcatttgcttttaggaaactctggtaagctcatggctcacataggatttaagtgtttgatccacatgttcagcttctcacttttctcacctcacttggatagaaggtatagcctgccgtctccttcagacatgcacataactaacccagcccactagatactagcctttgtgaagacctcctgaaagtgattctatgcttgtatgactgttcatggtttaacaagactcacatgccacatacttcctatttcatggccaaagcctaattcctctttttctgtccacacaggcaatgcagaatagctgataattatgctttgtgtcaaacctcccacttcctaaataattacaaatttctctgtccttttttttcccactagactaaataatagatatgtataacccttttttatatagcttattttctgcagtttacttttgtgttctaagtcttctccaaaatgtctatattgttcattagttaaggatccttagactgttttctgctgagggaatgactcatgagtcggtaaagatgagtggaatttcttgcaggtctatgtgctgcatttccattcacatgccctgctttcaatttgatttttgaaaacactgctgataagaaatcatagtcatatttatgtcctgtgagaaaataaggttctgctataaaggtccactcctgccatcttctcacacaatctgtcatgtaccatgtggcacttgtaccaaatccatgggtctttctttacaccaaattctgtagtttgtttttccatgaaacacttttccaatcctataaaatttagttctgcctacgcccttacaatgtattacttgacactgcagctgatgtcacctgtacagtcactgagcatgcttcctatttcatccaaaacaaacaagtaaatgcagaacgaactcctgtgaagccacttttggtatcttctgccatctcccaatgagtcatgagtaactacatctcttccaaccattttgcatccatgtcaagcagaccatatttttagtgcacctactttttgataaatacattatatggcctggaccaaaaccttaaaaagaaaaggggggcaagttgcattacatgttttgtttctttttgtattatgagagattaggaagcccaactcagcgattcaaatgaaattctatgcaaagaacgattataatttgggggacaaagtgacaaatacttggatgaaaaacaattatgtagagaagggtccaggagaattttatcattcacatctttgcttaaggaggtccttacctaagatattgcagtaggcagtcattaaacctacgtggttaggaatatctttgattccataccttctttgccaaattgatttcttacaaagccattccttctttattttactactctgtttagaggaaatcaagaaacaggagagaataatgaaacaaagcacagaagaaaacgtcagtgatttgtattcactgaattcaatattgtgtgttacttctattgcaaaagagaatgtgaatggaagaaaaaagaggagagagggaactattaatagagtagattacattgaattaatcttatttgtttctctcagggaagaaataagcatagtgaaaaatcacacaatggaaaccatcccttcccctgacctgttcccagtgttaagataacagagggaaggaagatcaatgctctgccagaggtccacaaactaagctgaccactttcttttgaatggtacataagctgagaatggctttacattttttaatggttgaaaaaatcaaaataaaaataatatttcgtgacatttgaaaattaaattacataagttcacatttcagtgtccatacattaagtcttactgaaacacagccttggccaggcctggtggctcacgcctgtaatcccagcactttgggaggccgaggcgggcagatcactagaggtcaagagttcgagaccagcctggccaacgtgttgaaaccccatctctactaaaaatacaaaaatttgctgggcataatggtgggtgcctgtaatatcagctacttgggaggatgagacagacagaattgcttgaacccaggaggcagaggttggagtaagccgagattgcaccactgcactccagcctgggccacagagcaagactccgtctcaaaaaaagaaagaaagaagaaaggaagaaaggaagagaaagaaagtgagagagagaaagaaagaaaagaaagaaagaaaaagaaaagagagggagaaagaaaggaaagaaagaaagaagaaagaaagaaagaaagaaagaaagaaagaaagaaagaaagaaagaaagaaagaaagaaagaaagaaaagaaaagaaagaaagaaagaaagaaagaaaaggggaaggggaaggggaagggaagccacgctcattcacttaggtattcgctgtggctacttcctacaagaactgatttgagtatctgtgagagcaacaatgtggttcccaagcctaaagtatttactgtctggccctttacaggtagagttttctgacaccaagcagagtacaaaaattcaatttaataaataaatttaagaggcagagagagattttagtgacaattagagcgaagtgtgttttgtaatgatggaactgcttttgaaccctggttacatttttaaaaggtcaggccaggcagcacagacacaatccccagtgttgctgatgtctgtgagtgatcactttggtgacagtgaggcatcaacaatcagtttggcaatagcaacattatttattctatatcttctttttccttcaaagtgttttttctacattatgaaaaacaatgggagggaaggccagtgtgactattaataagacttgcactaagcattttgcatcttgtcaagcagaccatatttttagtgcatctactttttgataaatacattacatggcctggaccaaaaccttaaaaaaaaaaaaaaagggcaagttgcattacatgttttttttcctttttgtattatgagagattaggaagccagttttaataagggatttttagcagttttaataaggaatttttcaaaatacttagccttatttttaaattgtaagttaattccttcatgtttctatgcttagtcaataacaaatacacaagaaaaaagcctcataaaccatcataactgcattgtaaggaatattcatactgtaagggtgtattaattccatttcacgctgctgtgaagaaatacctgagactgggtaatttataaaggaaagagatttaattgactcacagttccacagggctgagggggcctcaggaaacttacaatcatggcagaaggggaagtaaatatgtccttcttcacatggtggcaggaaggagaagtgctgaacaaaaggaggaaagccccttgtagaagcatcagatcttgtgagaactcactcactatcacgagaacagtatggaggtcaccgcccccatgattcaattacctcctaccaggttcctccttgctaggattatgaggactatgggaactaccattcaagatgagatttgggtgaggacacagccaaaccatatcaaaaggcagttgcctaagatgatgtgaaatcaccagtgattaagacttgatccatcttcaattttcaaagcagaaaccagaaatcattttccattgagccactctgacttttcaaaagacatttgtcagaaatccagtttgccctgctaactcccaagtagaaaaatctaagtttaggtcatgtaaggatgtttatacatttgtacaattggaggaattaataaaaaatctaattccattttgattagatcagttctctgggtgagtggagatagctgttccaagtccatggatccgattatgctcctgaagggattaaaatcttagatacaggagagataaagagagggttgctaaaagtgtgcaaaattaaagtttggaatcctatccgagaacccaagtatgaataatattctagcactctactaaaggaaacaaacttctgtgcattcttttgtctctaaagatagaaagtatttctgaatttgaaagtaatccagcttttggtattcttataaaaacattacaaaaatgatagtaacaactaactgcatttttgtggatctgctcatttcagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgactttgaattcttaatttctttgtcttaaaagttgctagttatgattttacagatgcaattttaaatcaacttttagccaggtgcggcggctcacacctgtaatcccaactattttggatgccaaggtgagaggattgcttgaggccaggagttaaagatcagcctgggcaacacagaccctgtctctacaaaaaaagaaaaaaattagccagacatagtgttgcttgcctgtagtcccagctactctagaggctgaggcaggaggattgcatgagcctaggagttcgaaactgcagtgagctatgattgcaccactgcactactccagcctgggtgacagagtgagacactgtctccaaaaatagtaataataagtagtcaacttttactgctaatttggtgaacatgagagaggatatgaaaataaatattacctcagctatcctaggatgttaaaataatctccaattttaaaattctctccaatctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaattaatggagcatgacaatctgtgcaatctgtacacctaactgaaaatcaaggtggttcaggacaacatcatctctgaggcctggaatcttagcagagagaatggggctgtaaacttgaccagagtggacaaatgtagacaaagaaagctcactagcagggatgctggcattctcccttacttgtgcttccagcctgttggttgaagtagaggcaggaaaccaaccctgcccagctggttctcaggccgtgctggctcgcccaccacagcacacaagtactcagtctctgtgcccaatctatagctgcctgttgagtgtgaagtggctaacttgtgaaaactccctgccaccttctttttttaccatattcagcacaccgcattgtattagataaagttatggtactttaaacaaatatctccgttcaccaaccaatttctgcacaccatagtctcagccttataatctgaaaacacaatattagaattggatagaaaaacaatcaagaaaacttgtggtaatatcttaaagcttccaacacattttagctatttattttattccattcatcaaaattctgatttcattagtttggtaagaatcttatgcacatcatctctattcatctaaaagcttttcattattcactctgacctagaagtgatattcataatggccatggcataagtagcattttttatttttgtcataaaatgtgtgtgaataactcagattagataaatcaaacacttgttggtaggtgggcagtcttacctagtttaggcagtgagcctactcttagcttcaggagcatcactaagagctgcctggtcctccctcaccatgggtgtgcaagatcatcctgatgggactgattgctgagcttctcaattacatctagtgaggctcagttcacaagcagtagtttaaagtgtttcacaagtcctaaaaagtaattgcacacaatggacataaccttttactaacaaaccaaaatgacttcaggtcaacaccatgtgtgtatgaaaggatacctccacagaaaatgtacagttgacccttgaacaacaggagtttgaactgtg

SEQ ID NO: 13215 - DNA, 10160 bp, Human
gataattttttgtatttttagtagagatggggtttcaccatgtcacccaggctggtctcgaactcctagcctcaagtgatctgcccgcctccacctcccaaagtgctgggattacaggcatgaactaccacgcccagacataaattcctttttaatggcgttaatttaatatagtttttcaccttcacgatgtctgtctaatgcatttcaacaactgtctattttgtcctcatacggttgtcattcctgtggggcggctcctcccacgcacctggcctttcataaagggtttctcccacggctgtccaggcatcagcctgatgaaggggattgttgccgctgctcctgccccactcccccaaactcagtgtcagctcaagattgtgcccagcagcgatgggaccaacgccagcctcacactcacctgtggggcagacgcccatgtctgaccaccgtggatcgaatctgtttctcacacacaggggaggggctgagcgctgaccgtggcctccagtgagtgagcagagaccccccagcgcctgtccacacacacaggggagggggagccaccgcttccagcctcacccagagccctgacccctccctgcctgggaggacgtggggttcctcttctgtcccacatggaggtgggagcctcctcctccctaatgacgctcggtggtcccagacacctgtggccactcagcattgaactctgctcatggaaggggatgcgtctcaatgtgaggaactgtttttcctctttctctgcctgtggctgtgatgatctgcatatttcagacgtatcacaaggagaatttcatggtatttggagccgatgtgggctcttgagtgggggcgtcaatcatcctcctcgactgtggagcccagcaccaggatcctctcccgtccccaccctcctgtctgaactggtctggaaattcaccatggctgagcctcccatgtcctgggcaccactgacccccacagccactgtgatgagtggggttcatgacagcaggctcagaggtgacattcatgtccaaagtcacataaaccctagatgataatcaggaattaaatacaaatcagctcaccttccccagaatcagattatagattacaatgaaacatatatatatatatttctctttatcccctctatttctcctttttagacaggatcttgctctgtcgcccaggctggaaggccaaggggtgatcatagctccctgaagcctccgcctcccgggcccaagtgatcctcccacctcagcctcctgagtagctgggaccacaggcatgagcctccatgcccagctcacttttttcttttctgtagaaacagggtcacagtctgtttcccaggactgtctgaagctcctggcctcaagccatcacccgccacagcctcctgaagtactgggattccaggcatgagccaccacggtagaccctgcatttctctgtgctcactgctacacgcagctcagcctggactacacagccaggtgtcaggtgcgtctctgctgatctgagtctgcctgcagcatggacctgggtcttccctgaagcatctccagggctggagagacgactgccatggtaaggaccccgtaacgctgaactgatggacgagctgaaggagggagggagaccccatggggaggctctgagagggaggaggagcccacggtcaccctcgcctgaaaggggctgactcaggaaggcaccaggtctatttgcggctgtgtccccgtcctcagtgagataaagataaatcaggcagacagtggcccgggggcagggagaccccatttctctctgaaatgcctgcagagagcctggtgcctgcccccacttcagccctggggaaatcagagccaggttcctggggtggcagttcctcttcctgtgggctgaggatgagacaaccccatgacaagaaggacccagcctccgagcggccacaccctgtgtgtctctctgtcctgccagcactgagggctcatccctctgcagagcgccgggtcaccgggaggagacgccatgacgcccgccctcacagccctgctctgccttggtgagatttcaagatggggagggggagatccgagtcttggaggaaccccaccccacacacaagccctggtccatcaggagacctcaaaagctcaggaggcacccgggcggggacctgctcaggcttcagggcaaatgcctcacagggaactctcttccagggctgagtctgggccccaggacccgcgtgcaggcaggtgagtctgtccccagctgtcccaggtccctactcctcactgggacagggggccacccatgggcagctgggggaggagacagtagttctgggtgactgatggggatgatggggaagtcctggggctgggagctgggatctgagcgtggggatgtcttgggatccagcctctgatttccatctagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggtgagaggacactctggggtcccagccccaggctctgccctcaggaagggggtcggctctcaggggcgtctccctctcacagcccagccctggggatgatgtgggaggtgggagccccatttaacacggtgcctctttctctcctaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggtgagggagccacggccttgtctaacacactttcggggcagctgacaggttgtggggagtttggctggtgactgaatctggaaaggacccagagtgatgtgttgaaggacgggctgaaggcatgagggagaccccatggggaggctctgacatgggaggaggagcccttgaccacgttcacctggaaggggaggactcaggaaggcatcggtgtgtttgctgtgaggtcccagctctcagggagaggaggaaagatcaggcacagtggccagggctagggagaccccactcctctgaaatgactccaagacagccccgggtgagaaggaggccctggggtcagagactcagagcgtgagagacagtgagacctgcagggccaggacgggagaaggaaggggcgtgggaggaaccagccctctcagtcctggctcctctttccctccaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagcgaccccctgaacatcctgatggcaggtgaggagcccagcgggttcagtcagggacccaggctctgcacaggccctgccgggggagcccaggtggtgatggccgggatgaggggtgggggtcccaagggagggagagacagacagagacaggggatgggggggaggggagactcagagaaaacagggacagagacactgagggtcccagggagaggcctggggaggtgtcagctcagagcaaggtggggcagcccctcacccatccttcttctctccaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggtgagggcgctgaccccgtcctctctgagctcaaaggctcagctcaggcccaggcccccaggagagctctcggctgggatggaccgagggaggctgtgagggaggcttagccagagggcacccagccctcagaggggaggaggccaacaggggttctcctaggcgtggccacccgttctcccctgcctggcatgcagaaggcaccaggtgggcagagagatggttccagggaatccactgggcggaagcaggagagtgggagtggaagggtgcactccatggacggcccccgcccctcacccgcctcccgtgctccttccaggacactctggaggctccagcctcccacccacagggccgccctccacacctggtgagtcactgaggcctcgtggggagcgccgcctcccccagggcagtctgagtctcccaaaggatcccactcccctcccctcaaggacgggcttgtgtcccaggggctctgaggctgggctggtgaagagtggggggtcgaggcagagggagatgttggggcccagccaggaggaggagccgggctgatgtggggggcaagacagccccagccttcacctccctgtcctgacccaggaggtcctgaggaccagccccttaaccccccagggtcaggccctcagaatggtgagtgaggggctctgagtgggagatgggcggggtccaggggaggcaggggtgggttctgtcctaggttcaggctcctctggaggtggtgatgtggacaggcccctcccctgcctgggcctcagtttctccaagtgtaaaggagagaggcctgtgggtgggaaagttcctttcagctctgacccccagctgtgacctcctgggagaggaggcctcccagggaacctcccagacccgattccacaggggcctgtcccgtcccacctgcagcagtgacggtgacctggggcaggggaggggagcagggccgtggttcaggacggtcaggctctttccctgcagctccgggtctcggctctggtgcaggaacaagggctgcaggtcagactcccgggctcccttcccagctctgccgcttcctcgctggaggcctggggcaggcgactccctgctctgagcctcagtttgtgcatctgtgaaatgggttgtacgggtggcaattccatgttgcacgactgcttgtgagggttggaggtcacgaaggaaagacctggctcgcgcctgcacacagtaggtgctcacatcaatgacatcattcccactcctgacgtcctcatgtcaaggtctgggaagatacctggaggttttgattggggtctcggtggccttcgtcctgctgctcttcctcctcctcttcctcctcctccgacgtcagcgtcacagcaaacacaggacatctggtgagtagggaagcgggggacccatgggtcgaccgagggtgggctcagggcaccagccagagggaacccaaacacacaggggtgtcagtttagaaaaccggttccaggggcacgtaatttcaatacgcatttacaaacttcagtattcatgggagtttttttctatctcataaaatatttggaacatccatgcaggaatatttttagttttccttctttccctcaagttgcatgtgtagaatgggagttctaatgttcccagggctgagactctgtccatcttcacccagaccagagaaagactgatttccagcgtcctgcaggggctgcggagacagagcccaaggacaggggcctgctgaggaggtaattctgccccaaagaccacagactcccacccaccacagcccatacactgcccctcacactcccatgtcctcctccaggtccagcccagctgctgacgtccaggaagaaaacctctgtaagaggaagagaggggacaaatgggggtgctggagagacaggagtcccaaaatttcagtagcaacagggaggggctgggaagggtctggggctccgtggaagatggtcttgccccacactgtgggacctccctgcattcggtggccccatctgggagcagggcagggggccagcaggactgagaggtctcagagaaccaggagacgaaccccttgctctgccccagcagatgctgctgtgaaggacacacagtctgaggacagggtggagctggacagtcaggtgagatcccgccccgtcccaggcaccaaaggcctcctggtgccagatctaatcctgcaggacttctctgtcctccttcccccggctctcagcatcgtcacggtggacccctccttgtccagcatgctgcctcccgcctgctgtgacctcactctcttctgctgtcctgggacctcgtgggcctcctcccgggtccccttcctgctcctcatcctctgtttggccgtctggttgttagagctctccccaggcctcaggaggatgacgaataaatgaaccacctccgtcccctgggctcctcttcattcattcatccagcgagtgttcccagggagctcactgtggatggggctccccatgggagctgcagacacagcagggagcaaagccgcccccgcctcctgagctcacctcatggtgggagacaaaatgcaaataaatgcatcgtgtccaggagtgcaacgtgctgtaaggaacatacaccagggaaagggcagagagtgtggggcagtggggccagtctgaatggaaggggagggctgtctgctcagctgtcatctgagaagcctggacagagtggggcacatgatcctctgatggacgagcccctgcaggcagaggaaacagccgtgcaaaggccccgaggcagcagcgagctcttgcaggaaggcccgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccaggaggtcagggggactcaaggacaccccccaccactgtctctctccagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggtgagtcctttcctctccaggcccccaggcctcccccacccccaccacgttccttacctctcactctcccccgctgcaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccaggtgcagtggctcacacctgtaatcccaatactttgggagggcaagtggggaggatagcttgagctcaggagttcgagtcagtcagatcagcattgtgaggccccatctctacaaaaaataaaaccagtccggcgtggtggcacacacctgtagtcccagctacttgagaggctgaggtgggaggatcacttgggtacaggaggtcgaggctgcaatgagccgagatcgcaccacagcacttcagcctggacgagaccctgtctcaaaaaaacaaaacaactaacaagccggtgaaattatctgttgattagtgtttgcataatacatttttcatccttctgcttttttaatgtgataaaatataaacaacaggccaggcacgggggttcatgcctgtaatcccagcactttgggaggccaaggcgggtggatcacaaggtcaggagttcaagactagcctggccaagatggtgaaaccccatctctactaaaaatacaaaaactggccaggtgtggtggcaggcacctgtaatcccagctactagggaggctgaggcagagaactgcttgaacccaggaggcagtggttgcagtgaaccgagatcacaccactgcactacagcctgggcaacagagcaagactctgtctcaaaaaaaaaaaattccaatcttgtaatctctttttgatcacttatatttaatgtaatcactgatgacattacaaccgtatgtcacttaatgacagggatatgttctgagaaagccatcattaaaaaattttggccaggcgtggtggctcacgcctgtaatcccagaactttgggaggccaagatgggtggatcaccagaggtcgggaattcgagaccagcctgctcaacatggtgaaaccctgtctctactaaaaatacaaaaattagccgggcatcgtggtgcatgcctgtaatcccagctacttgggaagctgaggcaggagaatcgcttgaacctgggaggcggaggttgcagtgagccaaaatcgtgccatttcactccagcctgggagacagaatgagactccatctcaaaaaaaagaaaaaaaaaaattcaccgtcgtgtgaacatcatagagtctacttacacaaacctacgtggtataacctactacatacataggctataccatcacatatgaaatgtgtagtggagcgaaacatcgttatgcggtgcatgactgtgttcaggtgtgcctttttgtttgtctcctctgctgtgtgttgtttcccctttcctgcctactctaggtttttagaaatattttgatttgttaaaaacttatgattcccccctcgcccggccagccgccccgtccgggagggaggtgggggggtcagccccccgccaggccagccgccccatccgggaggtgagggg

SEQ ID NO: 13216 - DNA, 12708 bp, Human
caggctggtcttgaactcttgacctcaagtgagcgacccaccttggcctcccaaactgttgggattacaggcgtaagccaccgcgcctcgccgcaggggctaatcttgaaacaaactaggtatggaaacccagctgcaaaactccagagatcacctcaaggcgatcaatctacaacgtggccattgttgacttgacaccagcccatgctccaggtggcccgtgactcaagacagccttcggagcaagacacacataccttgtacccagcaccactcctgtatgcctcccattcaaagttcccctttttaagcccctctccccagcctaaagcttgaaatggtcttctaaagacattagcttggccatttctcatctgcgagcatttgatcagtaaagctgctttactttcaccaccccccacttcctctgcctctgagtagcagaaacttgagttggttacattatcggtctcttcccgcctccaggtctttgtacaggagtcccttgtaactaaagtggccctttccttcactttgttttttcttttcttttcttttttttgagaccatgtcttgctctgtcacctaggctgcagtgcagtggcgccatcatagctcacggcagcctcgatcacctgggctcaagcgattctcccgcctcagcctcccgatagctgagatgacaggcacgcaccagcacgcccggctaatttttaaatttttctgtagagacagggtctcactgtgttgctcaggctggtctcaaactcctgggctcaagcgatcctttcgcctgggccacccaaagtgctgggattacaggagtgagccatggcgtctggctctcctcacttcttagtagcccagcatctcctcagccttcagctctcacgttccacctccctgacccacacgccccactctagactacaggaggttgctttgtgataacgtgtcccgcacgctctgcgtgtctacagtaaggcacttcacacatttgtgattaatgaagtaattatttgataaagcctgtctgccaggcatcaaccaaagctctaagagggtagcgaacaatttttgctccttccacatccccagggccacaccatggtaggcgcatattaagacttttgggtaaacaggctgtaaaaggccgggagcggtggctcatgcctgtaatcccagcactttgggaggcccaggcgggtggatcatctgaggtcaggagttggagaccagcctggccaacatagtgaaaccccgtctctactaaaaatacaaaaaactagccgggcgtggtggtgcgcgcctgtaatcccagctactcgggaggctgaggcaggagaatcgcttgaatccgggaggcggaggttgcagtgaaccgagatcgcgccactgcactccagcctgggcaacaagagcgaaactccgtctcagacaaaacaaacaaacaactggccaggcgcggtggatcatgcctgtaatcacagcactttgggaggccgaggcgggcggatcacgagatcaggagttcgagaccagcctgaccaacatggggaaaccccgtctctactaaaaatacaaaaattagtcaggggtggtggcgggcgcctgtaatcccagctactctggaggctgaggcagaagaatcgtttgaacccgggagacggaggttgcaatgagccgagatcgcgccactgctctccaacctgggcaacagaacgagactccgtctcaaaacaaacaaacaacaaaaaaacaaaaaccaagctgtaaagacccgcctttttcctcacacacttcttctcccagacccaggagcccagcctcccgctccccgtggtctccatcacactcacctctcctctccgcgcaccactgtttctagcgttagtcgctcaccgatgacgtctcactctcgcgccgttatagaggcaaagctactctctgattggtccccgctcgcgatgttcctggccgcatttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggtatgtggctgagcccttgtgaaaaagtgcgaatcccagaaaacagtgcagctgcattgtgtgcaaccatatgagcttttacgctgaggtctgatgggggttgtagttcatgcaactgctttaccttagaacccttttatggactggggtcatcctgagggaggagaaggttaggggtttggactgctggatctgacagactaggaggttggaagccaggactcttgcgtctggttgagggttggggcttggactccctgggtccttggagagaaaaagtctggaggtctggactcttgcatcctgggaggagggggtcagggcttgaaccctgtgggtgctgcgaagggtgggttgcggacttggacttctgggtctgagggaggagggctgggagctggattctacggtctgagggaggaggggctgggggcctggattctaggatctcagggaggaggggttggggtctgggctcctggttcagtgggagaaggggctgggggtccaggatccagggcccctgagcctttccctgcctctcaggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtaggtgagtgcggatcccccggttttggggtcccctggcctaaactaccgccccccgcaatctctgcctttccacatgcccagcctttcttggcttgctgatatattcagtcatttagcttatatattcagtcatttagcatgcattatgtgtctggccctgtgccgggcccctggaagggccatctcccgtggagcttccctgacaacgcagatgggttctctgatgtctcccgggggcctctcaatgcgtggcaccgctcacaggtgaaagcccaagctcttcacatctcccatacccctgccaggattcactcctctcgactcattcattccgcctcttgagtgtctctggacccttctcctctcctccatccctatggctgccattgcaaactccagctgtctgggctgaatgactgcaatagcctccttgctgagaataaggatgggctgggcatggtggctcacgcttgtaatcctagcactgggaggctgaggcaggcggatcacctgaggttaggagttcgagaccagcctggccaacatggtgaaaccccatctctactaaaatacaaaaaaattagccaggtgtggtggtgcgcacctgtagtcgcagctactagggaggctgaggcatgagaattgcttgaacccggaaggcggaggttgcagtgagccaagatcatgctgctgtactccagcctgggtgacagagtgagactccgtctcaaaatcaatcaatcaatcaatgaggattaaacagcaggcagggctcagatcttggcaggccaggaacaccaggacaagaagtctggatatttttttttccttgagagtgaaggagccactgaagggtttcaaatgggggaggaacagcatcaggtctggatgcctgaaactctgaagacagttgtattagtctgcttggactcccagaacttatcacaaatagggtccctcaagcacagaaattcctgtctgacagttctggaggctagacatccaaggcaaggtgtcgacagggttgtgagaatcttccaggcctctcccctggcttctggaggtttctggcagtcattggcacgtacaaacatcaccctgatctccgccttcatcttcacattgctgctccctgtgtgtgtgtctgtgtcccaatttaccctttttataaggactccagtcatactggattagggcccacccactggcttcatttgaacttgattacttttgtaacgacactgtctccatataaggtgatcctgaggtactgggggttaaagcctcaacaccctcttttgggggaaataattcaactttttttttttttttttttttttttttgaggtggagtctcgctcttgtctcccaggctggagtgcaatggcaccatctcagctcactgtaacctccacctcctgggttcaagtgattctcctgactcagcctccctagtagctgggattacaggcgcccgccaccacacccagctaatttttctatttttagtagagacagggtttcaccatgttggtcaggctggtctcaaactcctgacctcaggtgatctgcccacctcagcctcccaaggtgctgggattacaggcttgagccaccacgcctggccttcaactctttttctctttcttgagacaggttctcactttgtcaccaaagctggagtgcagtggcgcaatctcagctcattgcagcctcagtctcccaggttcaagcagtcctcctgcctcagcccccaaaatagctgggactacaggcacacaccaccacacctggctaatttttgtactttttgtagagatggggttttgccatgttgcccaggctggtcttgaactcctgacctcaagtgatccactcgccttgacctcccaaaatgctaggattacaggcatgagccaccacatctggcctcaattcttaatgacagtattggggagttctgtaaggaggaaggctagaggccaggggcatattccaaaccctgtttaacagacagacaccaaggcccaaacggactcaactggagcctctgccattaatccacccccaggaatagattactactattttacaagtatagaaaatcaaggctcagagaggttaagtaatgcacccaagctcagagctcagcagtggcagatctgagatttttttttttttttgagacagggtctttctctgttgcccaggctggagtgcagtggcatgactgtggctcactgcagccccaacatcctggactctagcaatctcagcctccgaaggagctgggactacagccaccaagcccagctaatttttttggttagtttttgagtgttggggtctcactctgttgcccaggctggtgtcgaactcctggcctctcaaagtgctgggattataggcatgagccactgtgccaagccagagccaaaacttgaactctttttttttagatggattttcgctcttgttgtccaggctggagtgcaatgctgcaatctcagctcactgcaacctccgcctcctgggttcaagcgattctcctgcctcagcctcccgagtagctgggattacaggcatgcgccactacacctggctaattttgtatttttagtagagacagggtttcaccacgttaggctggtctcaaactcctgacctcaggtgatccgctcgccttggcctctgaaagtgctgggattacaagcgtgagccaccgtgcctggcacttttttttttttttttcttttgagacagagtcttactctgtcacccaggctggagggcagtggtgtgatctcggctcactgcaacctccagctcctgggttcaagcgattctcctgcctcagcctcctgagaaactgggattacaggcatgcgccaccatacccagctaatttttgtatttttctttttttttttttttttttagtagagatgaggtctcatcatgttggccgggctggtctggaactcccgacctcaaactcttgagtagctgagattacaggcatgtgccacaacatccggccaatttttgtatctttagtagagacggggtttcaccatgttggccaggctggtcttgaactcctgacctcaagtgatctgcccgccccggcctcccaaagtgctgggattacaggcgtgagccactgtgccccgcccagaactcaggtctttctgacccaggagcagcacctgcttcagccactgtctttgggtccctgtttggctgagtcacatctctccctccatgtctaggctggagtcctcagaagctgcgtgcagggctgtcccctcagcctggcatactttcctcctgtcacccctttgtctcctccttattcaagtctgggcccacgggccttctctgcaggtcgtaactaaagtcgcacctcctgccctaacctccagcatgtctgactctttggtattcaccaagcacttctcactttgcaaagtcattgattctgcaaatgttcatggaggatgtactacgtgccaggctctggttaaggcacgggatgtagaaacaagttgctgtcgtttttcagctcatgctctggctggagaggcggtcagtcagcagaataagcaaagaggcggagaggctgcgtcctgcctcctcagatgagcactaggaggaaataaagccaggagtgaatggccgggtggggttctggcatgggaaggggggtcgggtgtgttgcaatttttttttttgaaacagaacctcgctctgttgcccaggctggagtgcagtggggtgatctcaactcacttcacccctccacctcccaggttcgtgcgactatcctgcaggcacctgccaccacgcccagctaattttttgtatttttagtagagatggggtttcatcatgttggccaggctggtctcgaactcctgacctcaggggatctactcgcctcggcctcccaaagtgctgggattacaggcgtgagccaccgcacctggcctggtgtgtttcgacttaatgggaggttcaggctctctgagcaggtaacagttgacctaagacttggagtggggagtaagttgtgcggatgactggggagagggtccaggtagaggaacagcacgcggaaggcccccactggagggcactcaggactgtggcatggtgagaggggagccggagggatgggaaggtggaaggacctcaggccacgggatggtctttggccagtctccagagtttagtgcgtgccccattaaacatccgttaaacaaatgaacgggagccgtgggatccagctgatgggcgtttcccaccccataggtgaacgagcgggtcctgaacaggctccatcaggtgcagaggataactcggaggctgcagcaggaacggaggtaaccccttctccgtcccctctgggcctgtgagcctcagctcccaaatgctcccagcccctctgtctctcccacttccacatccacccaaccctcacaagccacaaggagaagccggagatgagggccgggggctgaggcaaacaaggaggaagagtgggattcggtgttggaggagagggctgagcactgggactgagggagggccgggtggagagggctgagcactgggactgagggagggccgggtggaagagggctgagcactgggactgagggagggccgggtggagagggctgagcactgggactgagggagggccgggtggagggcctcctccccctgaagggagggaacagcaggatggaaggcacacgagcacagacctgactgcaagtattttcttttttttttgctgtgtgactctaagcaagcagtgtcccttctctgagctgtttcctatcaactaagggcagcaccaatatcatgaggctgcggcagggttgtcggagcttgcaggtggtgagctgagctcagagcttcccactgtgtgtctccacagaacctgcccaggtggctgctgcccctgccactcgcagtgtccctgtaccagcaaaactggagcaagttttgtaggaatggctccacgttgctgagtcaaccacagttctcatctcagtccttggctcaggctcggcacagtggcccagggctatgtgctcttccctggagcccattcttgccatcctgggcacccagcaacctggggtctcctgcctttccggctgttccttcttggctgcctctgctagttcatcctccctccccaaagctgaaacctgcggctcccagggttcctctgtccgtacctgtgctgtccagcacggtagccgctggccacaggtgagattttcacttaagttgaaataggccgggcgcagtggctcatcatgcctgtaatcccagcactttgggaggccgaggcaggcggatcacgaggtcaggagatcgggaccatcctggctaacacggtgaaactccgtctctactaaaaatacaaaaaaattagccgggtgtagtggcaggcgcctgtagtcccagctactcgggaggctgaggcaggagaatcgctggtaccagggaggtggaggttgtggtgagccaaattcacgccactgcactccagcctgggtgacagagtgagattccgtcgcaaaacaacaacaacaaacctgcccaggtgctggtgcagaggaggcattccatcaattgaaccttaaggaactctggaggcaggggctggggaaaaaagagaagggggtgtttataagaggtgaggtcattaggaggagcgttctgtactcccctctcttcagttatcaataaaaattataactcacatatgaatgtttactaagtgctgacatcacattaagtacagaaatcgtctggtgtcactacttcagtgtcaccgctgcaacatccagccgagggtgtcatgtcgtttgcagagcaggaaactcagcctcagaatggttgccttgtcttgctcgaggtctcaaggctggtcaagggcatggctcccaggcctccagtgccagagctcaggaccgtctggctccaggacagctttggcgttgagtggagtgggagctgagctctatcctgtggcccttttccccagccgctaggagataagttattccgttggtggcttctccccctgagcaggttcctcatgagagtgctggactcctacggggatgactaccgggccagccagttcaccattgtgctggaggtgagtgttgggcctccaggagggtcaggaactgggagctcaggacccacccatcacctacctccccctcctccctgccaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcaggtgaggaaggcgggaactcaaggggagggactggggctccagagctggcgccagtgcaggtaaggaggggggactcaaggggaggggccagggctggggctgagttaggttcagggctcttgggttttggttctgcaccccgaggggcccagggctggggaaagttggagaagggaggtgaaccaggacatgttggaggcctaggatcaggcagggaagtagttggaaaaagtggggtaaaggcttgggtaaaaaggaggcaaagttggaaagggaaagaggaagacctggagaaggaaaaatagctagagaaggctgggagtagaggagaaggaaggatcagagaagacggagtgcaagggaaggcccagtgtggggaggaaagctggaagaacatctggacccaggaacactgggattgcctctgaggtgtaaggaggaaggtgactggcctgggcagacaagaactgtgaggctggccaggtgcagtggctcatgcctgtaatcccggcactttgggaggcctaggtgggaggatcacttgaggccaggagtctgagacctgcctgagcaacatactgagaccccatctctaccaaaaagaaaaaacatgttaggcttggttggcaagtgcctgtagtcccagctacttgggaagctgaggtgggaggatcacttgagcctgggaggcagaggctgcagtgaactatgatggcaccactgcactccagcctgggcaacagagtgagaccctgtctctttaaaaagcaaaacaaaatgaaaacaaaaatggtgaagctgatgggattttctagattcccaggcctgttaacaccttgttccttatctcctgcagattaaggttgaggaagactttggctttgaagcagatgaggccctggattccagttgggtttctcggggtccagacaaactgctgccctacccgaccctggccagcccagcctctgactgacgcatgcccaataaactgaccccacactcaccccggccaccgtctacttgttcccacctctgatcacacacatgctcacgttcgggggttggttttcacatttttattgggagccgtgggaggggccgcctctgtcagtggaggtgctcacagtttcttcagccactccaggctggggccctgagggtcctgggggtggctgggcacgtcgggcatgttcccatcatcacggacgggcactgtggggcaggaggtgggccactgagaccagcacgtctccagggccctggagagaagagctggtctgtcgctttatgttcagagagggaagggggaccccaggggtgagaggggaagggtcagagaatcagtgatgcagaaagaggcgggaaatacagagactgagagacacggaaaaccagagagatagcgagggagagatcccgcgcactagagagctagggtcaaaagagatggggaaacaggacagaaacctgagaagatggagaccaagaaaccaccacagatgggaacccagagagagacagaaatctggaaaggtaatagaaactcgaagcacaggccaggcgcggtggctcacacctgtaatgccagcactttgggaggccgaggtgagtggatcacaaggtcaggagatcgagaccatcctggctaacacggtgaaaccccgcctctactaaaaaaatacgaaaaagtttgcgtgtcgtggtggcgggcacctgtagtcccagctactcgggaggctgagcttgcagtgagctgagatcgtgccactgcactccagccttggcgacagagcgagactctgtctcaaaaaaacccaaaaaaacaaaaacgaagcacaaacacagaatagtatacgaattatatctcaattcttaaaaaatggaacggggggtccgggcaccactgcagaatctctgataactgcttaggaaagacctgcccataactgcccttacgccagcacagggaggctgggcctattccggggatccctgcctggcccccactcacctgggtagttgtagggcgtggccttgttgatcatgacggagtacttgaagtaggggctcaatgggggcagaattacagctgtggagagacacaggggtgaggcccaggggaaggtggctctgaagagaggggaagagaagctgagcctcggcaaagggaagataaagtgcgcagggggagggcagcagggagggccagcacgtccaggaggatccttggtaccttgggatccctacttatagacaggagggtttaaaactcttttttggggggttaagtggaggtaggggtcggagcctaacactcacagatacgtggggcctggaggaggcagcagtggggttggtcatggaatgagcacgtttgagtgtagggtcatcatggagcatcctgggggtagtgtcatgggactgttctggagaaatcaagactgttacaaatttggccgggcacagtggctcaagcctgtaatcccagcactttgggcggccaatgtgggcggatcacctgaggtcaggagttcgcgaccagcctggacaacatgatgaaaccccatctctactaaagatacgaaaattagccgggcgtggtggcaggagcctgtaatcccagctactcaggaggctgaggcagaagaatcccttgagcctgggaggcagaggttgcagtgagcccagattgtgccattgcactccagcctgggcaacagagagagactccatcaccaaaaaaaaaaaaaaaaaaaaaggccttacaaactggaggagaaagggttgcacaaacaacagtcactgaccacagtccatttagggtgggagccaggagtcctgggggatggggtacagttcataaaaggaatgttctaggccagtgctgtctgacagatggtaagagccaggtatataattttatatcttctagtagctacagtaaaaataagagatacagatgaaacaaattttaagaaacatacttggatgggcgaggtg

SEQ ID NO: 13217 - DNA, 28806 bp, Human
caaacagagagattcatagagccagagacacagattcggagagtcagagagacatagaaagagattcatagagccagagacacagagattcatagagacatagagattcatagagccagagacacagagattcagagagtcagagagacatagaaagacattcatagagccagagacacagagagattcagagtcagagaaacatagagattcatagagccagagacaaagagagattcagagtcagagaaacatagagattcatagagccagagacacagagagattcagagtcagagaaacatagagattcatagagccagagacacagagagattcagagtcaaagagagacatagagagacattcatagagccagagacacagagagattcagagtcagagagacatagaaagagattcatagagccagagacacagattcagagagtcagagagacatagagagacattcatagagccggagacacagagagattcagagtcagagagacatagattcatagagccagagacacagattcagagagtcagagagatgaatagattcagagagccagagacacagggagagtgaatcacagacacagagggacggggagatccccagaaacagaaagagattcatagagccagagagacaaatagagattgggtcagagagaaagggacagagacagagacagagaagagaagagggagagagattgggtcagagagaaagggacagagacagagacagagaagagaagagaagagaagagggagagagactgagtcatagacaggagagagacccccctagcatcagagagagagagagagagatcaacagaaccagagagggacaagtacagagaaacagatggaaccagagagatataggaagagacaaacaaaaacagagacggagttgcagaaccggaggaagggagagagacagagacaaaggcatttataaagacaggtgaaggtgaggagagagagggagagacaggggcaagcatttagagagtgactcccagagaggaagacagagacggactcccaaagagatcaagttgcagagggagggggagacagagtcacagcctgagagagaatagagattcacagagccagagagacaaagacagggaaagaaacaaactcagggagacagaggcggaagaatttatcagacgtagagggagagacagagggagactgattcacagtgaggcagaccaagaccccgagaagaaccacgacaccaagacccagagatggcgacagatacagatggagacacacagcagaggaaatagagaaatagaaagaaatagaaacagcatttctcggagacagggaaaagaaaacagatccactgagaggcagaaacagagacacatcgagaaagctcgctccaggaatagagggagagggacagaggtcacaagaaagacacacgcaggcagagagctacacaaataatggagaggccaggggaggaaataaagactcagccggcatcggagaaagtgagaaccctagcgccctgcctgtccactgctggacccctagcgtggagcataaagtttgttgaaggaaggagaggggcagggtcagacacagggaccccagggcgcccacaggacacacgaggcaccctagtgggggaggaacgcggggcaggatgacagattgcagggtggtgggggggagccaggctcagaggatgcccctccctccagccagcccccggagtgggtgtgtgcacgtgtggggggcggggagggaggacatttgtcccgtgtctccgggaggggagcgcctttaagccgaaaccccgccctctcggtcgtcctggcaacgcctccccccacccggggctcccacatttcagcaggtgccggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggctctgaggcagaaggtggtccacgaagtcaagagccacaagttcaccgctcgcttcttcaagcagcccaccttctgcagccactgcaccgacttcatctggtgagggaagggggctgggggactgggggacgaggggactaggggtgcagactcctatcacgccgacccctgtggaaggaagaaggagggggctgtagtcccgactcccaggttctaggatggccagggaacgctgggagcttcgactcctgggtttcagtgaggaggaggctggttcctggagtgctgggtccgagggaggaggaggctggaggacagaggtcctggagtcttgggtctgagggaggaagggcctggggggctgggagcctggattcctgggtctgaaggaggaagaaactgggggctgaactccagtctaagggaagaagggctgggggccaaaatttctgggttctagaaagaggaggtggccggggcttggacacctgggccctgcgggaggagggtcagagagcgcaggccccctgtggctcgcagaggttgggggtccaggtacccctttctgcactgacctaggatccctgactcttccaggggtatcggaaagcagggcctgcaatgtcaaggtaagagctggggaccggggctcctgggaccctcaggagggtggaggctggggccccacagctgaggctgcttgacacacgtgttctctggtccccagagaggcgcgggggagcccggggcggggggtgtggcagagacacagcctgtggtggggagggagctttgatggtggggccaccgcggaggtggtgctgggggcccctccctcggccggctccaggtggggacagatatttggagaatctgttgccatgggaacatggagatttggaaaaggggagctgaaggggggaagggggagggggctggagatgcaaagtcagagcccccccccaccccaggctgccgtcgccatgacaacaccagccgtcctaggcaggggcaggccgggtggggtcaccaatgggcgagtgggggccgggcggggccggcagttctggggggcgggagaggggggcgagtccttgagcaccagctgctactgctgagaacagagtgagtcagggtggggggcgggccggcagcagcgcccccagactcacttctgcccaagttgctgcttcctgggctgcgtctgaagatatttcggttttcgctctttgaatctgtctgcctctctcctggctttctgatctccgtccgtgggcctgtgtctgtttgtcaatgggatcctattttctttctctctttttccatctcccttccctgagctctgtgctctgtgtctctctgtaagtctctgcgtctctgtttctgactctgagcccatctcttgggtttctgtctcctgcttctctctctggcctccgattttctctctgttggactctctgtgttgagatccctctctttctggttttctctgtgtccgagttccgctctctctttccaattttctgtctgctggggtctcccgctggactaatccatgcctccgtctgtgtctctatgattttcatctatagtctgcagctttgtggttcatcgacgatgccacgaatttgtgaccttcgagtgtccaggcgctgggaagggcccccagacggacgtgagtgctcggacacctggttctcctcctcgggccgtgcccccgccctcaccccctcggcgtccgtcccaatttctcctgctatttttatggctgggaggggaggggggctggagagatagggggagctatctggcccagattccttgcccttggcctggaaagggggaatgcgagggggactgacaggctggggacacgggtggggcacagagaggaggccggggtgaggagactgaagatgggtgctgccgggggtgggctgtgatccaggggtgaagggatttaaaaattgagagctgaggggcacacggagaaaaatatcagtgcaggtgcggagatgccaacataagacagagggaatctcagggagaggaacagagacagaagaagacagagacctaggagagactgaagctgaggcagagagagagagagatggagcagagaaagaaccagggagaaagagaggaatttggaggcaccaaaagatggacagagaaactccaagagacggagacacagacacctggagaaagagactaaaatagaaaatggtggatacagacaacagcttaggagatgctgagaggagacccagggaagtcccacagtacacttgcacacatgtgcgtgcatgtacagatgcccctgtcatcacagatgtgcagcacgcagagacacacagcctctccccaccccctctctctccatcagaggctcacaagaccagtcaaccctgagtgcccattcccgttcccttttctgctttatctctgagcctcagtttcctcctctataaaatggggctgatgatctagcattgaccaacagaactgtttacagtgacggaagcattctgtacatgcactgtccaataggcagccaccagctccatgtagccagtgagcacttgaaacagggcgactgtggctgaggattagaaattccatttcgtgtcatttgaattggcttaaattttttttttttatttttattttttgagacggagtcgcgctctgttgcccaagctggagtgcagtggcgcagtctcagctcaatgcaacttccgtttcccaggttcaagcaattcttctacctcagcctcctgagtagctgggactacaggcgcatgccaccacaccccgctaattttttttgtatttttagtagagatggggtttcaccatgttggccaggctggtctcgaactcctgaccttgtgatccacccgcctcggcctcccaaagtgttgggattacaggcgtgagccaccgcgcccggcagaactgacttaaatttaaacagccacatgtagttagtggccaccaaatgggacagcacacatctggacacttccaggcttgttttgaagtcaggtgggttcagagtttcgcccagggtttgacacaagatcggagacagttttatgatgtacagatggagagagaggcagagagagagagatccacagaagtccatgaggcgttttaccaccctctcagctgaaaataacagaagtctacatagaagatgtgacttcatagaacatatattgagcaccactgtctaccagcacgtgtatgtgattgatgacccccctcgtccactcacctccgccaccaacaccagataagtctgatgcatccagtgctcattgggtacactcatcaagatttttttttttgttttttgcctgtaatcccagctactcgggaggctgaggcagaattgcttgaacctgagcggcagaggttgcagtgagccaagatcacgccactgcactccagcctgggtgacagagcaagactttgtcttggaaaaaaaaaaaaagatttttttttgtttttgttgttttgtttgattttggggtattttttagatggagtttcactctgtcacccaggctggagtgcactggtgcaatcttggttcactgcaacctctacctcccaggttcaagcgattctcatgcctcagcctcccgagtagctgggactagaacaggcatgagccaccatggccggctaatttttatatttttagtagacagggtttcatcatgctggccaagctggtcttgctcctgacctcacgtgatccacccacctcggcctcccaaagtgctgggattacaggcgtgagccaccgcacccagccgatttttggggttttttgagacagggtcccactctgtcacctagactggagtacagtgatgggatcatagctcactgcagccttgaattctccaggctcaagtgctcctcctgccccagcttctcaagtagctgggactataggcacaagccacaacacctagctaattaaaaaaaaatgtttttgtagagatggagtctcactcactatattgcccaggctggtcttcaactcctggtctcactcgattctcctgcctcagcctcccaaaatgatgggattacaggcgtgagccactgcacctggcctcaagtattttgtatacagtataggttggatccacacaacagcttatttggttatttttccctgtctatctggtttgaatcccagctccaccactttttggttctgtgacatttcctgagttaatttacctctctgcacttgttgaattccttgtttgtaaagtggagatgataattatgctcactatggattgttttgaagatttagtgagtcagacatttgggatggtttctgacacatagcaagagccaaaatattattttttattcttgttaaaattattattatgaccaatgaggaaacgagtgaatagtgagaaggagatctttcctctgcatcactcgggggtttttttgtttttgtttttttttgctgttgagacagggtctcactctgttgcccaggctggagtgcaatagtgctatcactgctcactgcagtcttgacctccggggctcaagtgattcactgctggcagttgatcttcttaaaagtaacatgcaggccaggcacagtggctcacgcctgtaatcccaacactttgggagaccgaggcgggtggatcacctgaggttgggagttcgagaccagcctgaccaacatggagaagccacgtgtctactaagaatacaaaattagctgggcgtggtggcacacgcctgtaatcccagctactcaggaggctgaggcaggagaatcacttgaacccaggaggcggaggttgcagtgagccaagattgcgccattgcactccagcctgggcagcaagaacaaaactctgtctcaaaaaaaaaaaaaaaaaaaaaaaaaaaaaaggtaacatgccttgaccaggcatggtggctcatgcctgtaatcccagctctttgggaggctgaggcaagcggatcacgaggtcaggagatccaaaccatcctggctaacgcggtgaaaccccgtctctactaaaaatacaaaaaattagccaggcacggtggcacgcgcctgtagtcccagctactcgggaggctgaggcaggagtatcgcttgaaccccggaggcagaggttgcagtgagccgagatcacaccactgcactctagcctgggcgacagagtgagactccatctcaaaaaaaaaaaaaaaaaaaaagtaacatggatcaagatttggcaagaatgatttcatttagtccccagggagggcacatgcccccacttttcaagcggtaaatctgaggctttgaaaaggggcaggcgtggtgaggccacctagctgggtaggggatagaggcaagatttgaactctgatgtatgtaaccacagcctccgtgctgtctcctttttaacagcgacgttcacttttgagaataagaacagcagcctctgtctgtggatggtttgtgtgtcaggcagcctgctgagaaccttcacacacagcatcttatttagtgcggcaggaaccctttgagttagggtcagcggagatatttagaagcccagcacattgaaaaggatcctggaaactgccaacaccctcctctacccaaatatatattcaaactagaaaccccactaacatagatgaaaatccaagaatggcctaaatgttcaccctgtgataatccttttaatggattcttagaatcaagttatttaacaagcagatattgtcccgggggtagtgggtggcaggggagaaggagaagcttcactgatgacctgcattcttgcttaatggactctggaaatttagcattgcttcaaaatatagattatttatttccacttgacagaggaggatgctgaggctcaaaactgggaatgaacttgccccaaatcacacagctgagaagcggcctagctcttacttacattcagggctatgtagggacttcaataaaatccctaacaataaccacagtaatagtattgggagcatctaacgtggtaggcacagctatgttttgtacaccaattattttatttaggcctcctgggttcctattataactgagaggtcatgttctccattccacctggagctcagagaaggcataccatatggacactgacagaagctgccagtgaaggagctggggttcagggtggcccacaagtcctcaaataataacttgtgggagttggggggatgggaactatgggaggttggaagctcctgcctccttcatgttctgcccagatatcatttggtcagcgaggcccccctgccactccccctgcacacagttttgttgttgttgttgttgtttgagacagaatcttgctctgtcatccaggctggagcgcagtggcacaatcttggctcactgcaacctcggcctcctggattcaagcaattctcatgcctcagcctcctgagtagctgggattacaggcatgcaccaccatgtccggctaatttttgtatttttagtagagacagagttttgccatgttgcctagcctggtccggaactcctgagctcaaggcaatccgcccacctcggcctcccaaagtgctgggattacaggcatgagccaccgcacccagccaggaccaccgtatttaaaatttcaatcccccaacttctggtggtccccatccctgcctcattttttctccagagcacccattaccaaccatcaaactatatgttttatttatttaccatgtttacattctgtatccctccattaggaagtaaactccatgtgacaaagaggtttttttttttcatttgtttaatgctgggtccccacaccaagaacagtccctggcacacagcaggtgctcaatgattattggtacatagagtgaaagagatggagcctcaggctgacctagagagcaaggcaggaggaaaagataaaagggcccctcccctggggttttaggaccctcccaacgccccctaagccagtcttctctgcccccaggacccccggaacaaacacaagttccgcctgcatagctacagcagccccaccttctgcgaccactgtggctccctcctctacgggcttgtgcaccagggcatgaaatgctcctgtgagtgacctgggccttgccagggcccttccaaagcgcccggtctgggttccgggaaatgcccgggatggggtggggggtggagtcttggcttgggggcggggcctgaggtgctacccgcagctttcccctccaggctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactggtgaggccccgccccctcgcctggccccgccccctccccaagtgtgaggcggggctgacccaaggcacttgtgctggcccagccctaccccaaagatggggccacgcctctttctatggtcacgcccacactcctgaccccaccccaaaggccgagcacacccagccataccccttttggctcgaagccccgcctccaacctggcttcttgcaactttctgcacctgttaatgactttgactttctttttttttttgggacggagtttcgctcttgttgctcaagctggagtgcaatggcgcgatctcggctcactgcaacttccgcctcccgggttcaagtgattctcctgcctcagcctcccgagtagctgggattacaggcgcgtgtcaccaagcccggctaattttttgtatttttagtacaaacggggtttcaccatgttagccaggctggtctcgaactcctgaccccaggtgatcccctcgactcggcctcccaaagtgctgggattaacaggcgtgagccaccgcgcctggccaatggctttcttttttgtttttattttatgtttatttttttgagatggagtcttgctctgtcacccaggctggagtgcagtggtgcaatcttggctcactgcaatctctgcctccggggttcaagggattctcctgcctcagcctcccgagtagctggaattacaggcgcctgccaccacatccggctaatttttttttttttttttttttgagacaagatctcgctctgttgcccaggctggagtgcagtagcatgatctcagctcactgcaacctccgcctctcaggttcaagcgattctcctgcttcagcctcctgagtagctgggactacaggtgcatgacactgcacccagctcatttttgtatttttagtagagacagggtttcaccatgctagccaggctggtctggaactcctgacctcaggtgatccgcccgcctccgcctcccaaagtgctgggattacaggggtgaggaccgtgcccagcaatggctttctgggtataaggatcttgagaagggagagtacctggttctgagggaggctgtggttcagtactggtgacatggccagggtccaaactctggttcctaatggagagaagggctctggatctgatttcagggtcactggttgcggaaagggctctatgccctgtcttctgggttctggagaggtaagaagtcatgagaaacgagactgagagcttggaattcttttttttttttttttgagacggagtctcgctgtgacgcccaggctggagtgcagtggcgtaatctcggctcactgcaagctccgactcctgggttcacgtcattctcccgcctcagcctcctgagtagctgggaccacagacacctgccaccacgcccagctaatttttttttttttttgtatttttagtggagacggggtttcaccattcacaggatggtctcgatctcctgaccttgtgatccgcccgccttggcctcccaaagtgctgggattacaggcatgagccgccgtgcctggccaagcttggaactcttgattgctgactggaggagggctgggagccccttcctggatctctaacccgtcacactcttcctcactccccgtttagttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttgtgagtctggggtgcagggaaggcaatgacagctgacagagaatgatctgagggtcctagtggcccccagagagcagctgatgggaggggttaggatagagggaacccagaaaagggcagaagaagatggtgggaaaagggaatagagtgattgagggagtgggatggagatacagaaacggagagacagccagaccactgtataattagtctccattgaagcccccaactttagagttagacagagatgagagagagaagagagagtctcagaagaggcagaaacccaaagagagacacagatggagagggaggggagaagatgggggatggcagggagacagagatcagttgacaggaagacagagtgatagagacccagagaggagagaagggtacagagactcagagagagagatctcgagagacaagagacagagatgggaaggggcggagaatgcaggaggaagggagaggaagagctctctaggtttacttcaggccccaaagccctagctggagagagagcccggctgggaaggtcagaggtcggagaccgacaaagcaggagaggagccccagctggctgggtttgcccccacctccagcaccaaggatggggaaccgaggggagccatgagctcggctctgcaccccatccaccccaccttcctgcagcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtgaggagcagggctggggcctggggatggagcgcaatattaccatctccatctgtgtgtggtctctctcctccaggccactgtccttccctctgcctcccagcatgcgcacacacacacacacacacacacacacacgcacacacacgcacacacccctctctctctattcttctcttcttctcccctccctttctccctctccctctctttttatctcactctttctctcttccatctctgtgtccgtctctctgtgtctctttcctcccttccaatgtctttgcctctcccatgggtgccccatccccgctgcccgcctctggtctccgtctgtatgtcaggtacaagttactgaaccaggaggagggcgagtattacaatgtgccggtggccgatgctgacaactgcagcctcctccagaagtttgaggtacccagaccctggcttcctcaagggagcccagcccagcctcccacggttcagagctggcctttccttccacccctgagtgcccgctggtcctgggactacagttcccagaagaccctaggactccctcctctgctcttctaggggactcgagccccagggtctgatgggaattatagttcctatctatcgccatggcttgagggtactaggggccaccagcccctgttctagggcgatcccctgcatctcttgggaccctgactctctctttcttttctcccaggcttgtaactaccccctggaattgtatgaggtgagtagaaccagggcgttgaatggaggcagtttttgcctacttctctgatttcttattcctcctctgacttctgtcttcaattccccacacatgagttgagcacacatttgtgctaggcctgtcttgtgcttgctgaataatccaggatccagagatgaatctgaccctcaagcaactctccaaggtagggacacagtcacagatacttaaaatacaggaagatgtgctaaattagaggtagcccagggcactgaagaggcctaacggaggcactaatccagcctgggggagggtggtcagggaggacttccctgaggaggtgacgcctgaattgattcttgaggttttttaaaattttttaatttatttttatttttatttttatttttatttctgtcgcccaggctggagtgcaatggcacaatctcgcctcactgcaacctccagctcccgggttcaagcaattctcttgcctcagcctcctgagtagctgggattacaggtgaccgccaccacacccagctaattttttttttatttttagtagagatgggatttcgccatgttggccaggctgatctcaaactcccaaactcaggtgatccgcctgccttggcctcccaaagtgctgggattacaggcatgagccactgcgcccgaccgattcttgagttttttattttttttttgagacggagtctcgctgtgacgcccaggctggagtgcagtggtgcgatctcggctcactgcaagctccgcctcctgggttcacgccattctcctgcatcagcctcctgagtagctgggactacaggcgcccaccaccatgcccggctaattttttgtatttttagtagagatggggtttcaccgtgttagccaggatggtctcgatctcctgacctggtgatccacccgcctcagcctcccaaagtgctgggattacaggcgtgagccaccacacccagccgattcttgagttttaaaaaatctatcaagcatgatcatcttaatctctccattcattcattcactcactgaatatccttctttttctttctttctttctttctttttttttttgagacagaatctccttttgtcacccaggttggagtgcagtgatgcagtctcagctcactgcaacctctgcctcccagattcaagtgattctcctgcctcagcctcctgagtagttgggattacaggagcgcaccaccacacctggctaatttttgtatttttagtagagatggggtttcgacatgttggccaggctggtctcgaactcctgacctcaagtgatccacccgccttggcctcccaaagcgctgagattagaggcgtgagcgaccacgcccagacgaatacccattttctagggtgtcataagccaggccctgttctgggaatagaatcaggccattccctggtggagctcttcttctagtggaggacaaagttacaaacccagacattcacaacgaggagcaatgctgctgtaatggagacagcctcaggcactggggcgtccctggcacagcctgagtcagagaaagcttcctagagaggtgagacctggtagaagggcgggatttcccaaaggagagaccagattttcaggcaggaggaagtaatgctctctccctcatttaccctttcaaaaaatactttacagagcatctttgtgtgccaggcgtggctctactcactggggatatagagaaagcagggaaagaacaaacaaacaaacaaaaaagttcctttccttatgggatttacaccgggaggaagacattaaacaaaatatataagcatatgatagactgggcacgatgcctcatgtctgtgatcctagtaaggcgggcggatcacctgaggtcaggagtttgagaccagcctggccagcgtggcaaaaccccatctctactaaaaaatacaaaaatcagctgggcatggtggaggcgcctgtaatcccagctactcggaaggctgaggcaggagaattgctggattccgggaagtagaggctgcagtgagcccagatcgctccactgcactccagcctggatgacagagggagactctgtctcaaaaaaaaaaaaaaaaaaaaagaagacaagaatcttcaagattcaacaacagcaacaacatgttatagtctttactggactcttacagaaactttcaccagagtttttaatgttgtgtgtgggggttcacctgcatcagaattcctagagtgcttgcttttaaaagcacattccccagcctttctgcagacctactcagtgacgatctctctgatgcctcaaatgtctgcctactaaattaattcctcaggtgatccttttgcaaagttaagtttgagaatgggctctgcggccgggcgcagtggctcacgcctgtcatcccagcactttgggaggccaaggcgggtggatcacgaggtcaggagatcgagaccatcctggctaacacggtgaatccccgtctctactaaaaatacaaaaaaattagctgggcgtggtggtgggtgcctgtagtcccaggtactcaggaggctgaggcaggagaatggcatgaacctgggaggtggagcttgcaatgagccgagatcgtgccactgcactacagcctgggtgacagagcgagactctatctcagaaaaaaaaaaaaaagagagaatgggctctgcaggagacaagggtaccagcgggaggacattctgagccaaagaggtagagtcttttgagatcagcagggatgatcctcccgtacaaacccaagaaacccagcagggcagatggtgggcaaaggcctagaggcagggagtgtagggtggtgtgtgtgcctgttgtggctcacagcactctcccacagttcagcaggcaccacttaatattaccaatgaacaccaactctgtgccaagccttgagctaggtacggggctaacaacacagcaaacagaaacagccctgattattattattattattattattattattattattattattatgtatttatctatttgagacacagtctcgctctgtcgcccaggctggaatgcagtggagcgatctcagctcactgcaacctctgcctcccgggttcaagcgattctcctgccttggcctcccaagtagctgggactacaggcatgtgccaccatgtcctactaatttttatattgctagtagagatggggcttcgccatgttggccaggctggtcttgaactcctgacctcaggtgatctgcccacctcggcctcccaaagtgctgggattacaggcatgagccaccgcacccagccctcaacaaatatttatgtagcctcaatgaggtaggcagtgttactgtgtcttagcgaacaaagcagacccctgccttagggagctcacaggcagaaagcagatagtcacacagatagatgtaaattactaagaataaaagtgccaggaaggtgctgtccatggtgaccaaggggtggtaagagaggcatctgacccagtttaaaaagtcaggcgaggcctctatgaagtgatgcttgagtcaaggtctaaagggtgtttgggagacaactaggagggaaggggaggggagagctttacaggaagacctaacggcacatccagaggccctgaggtgggagggaggacaatgagtgtcaggccagggtggctggaccatggagcctgggagagagaagaacaacctgcagtgtcagtctcagcctggctctgcaagtcatgtggaataaaatcttaacacagagggagcagttaaagggtttacaagcataggggagacatgacctggtttatttatttttaaattggctcctgtgcctgctgagtagagaatgcattagaaagggcagccgtccatgtagagggacaagtgtggaagctgtgacagcagcttagtcttgggccccctccctggggggccgaggcaggaaaaggtagagaagggaccctagctgaaagccaggtgtgctccctggactggcagcacccatgtcacccagaagctttttacacataacgattctcaggtcccaccccagatttatagagttagaaaatctggcagtgggacccagcaatctgttttaccaaaccctctagggaattccggcttagaggctaagagcaaccagattctagagctggactgcttgggtttcatttctggctctgtcctttacctgctgtgtgacttggggcaagttacttaacgtctctgtgctagtctcctcttctgtaaaatggaaacgatagcagggttttctggaaacagcatatgataagctatctaaaaaaaaaaaagaagaaaaaaagagctaagtgtttgttgaataataaataaaccctccaggctatggggagtcagagaaaattaagccaaggacagggtaggagggtggccattttcctctgtctagcgattctcatcctttcctttcttgggtgctgtgtctcttgggagcatttccttatcgctgtgtaaggtctaactgcctctggctctttctttctcctttccacagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggttggattcctggggttctgggggaaagggaggatgtctgtgggaaggtcagatttctggttcttagggaggaagtgggggtgggaagagactgggctcctgcatcttcaaatatggttaggttgggccgttcaggttcctggagaggagaggtttacagatgtggacactctccttgaggggacgggcggcaagtcagggctgtcagtcccttaagagatggaggaagggcctgggatcccgtttccctgcgtcccttagggagggggcaggtcctgtaccactgggttcccaacatggactggcccttttggaactgtgcgcataggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggtaaggatggagggggcggaggctgtcctccgggccctgccttatccagttctggacatctgcgttgggattctgagtttagggcgaggcaagagaactttgtgctctctgagtgggcgaggccaggcggattgtctcctcagggggcgtggccggggggggggtccttggggggcgtggccaggcgaagggactcatcggggggcgtggccaggcggaggggctcaacggaggcgaggccgggtggaggggctcctcgggggcgtggccaggtggagggactcatcgggggcgtggccaggcagaggggctcttcgcggggcgtggtcaggcggatgaaatctttgggggggtggtttagaggggcgggctttgtcaggcgatgggatcattaataggcgtggccaggcagattggctccttgggggcgaggccaggcagacgagattatgaatgagcgtatccaggcaggtagattcttcggagggcgtggtcgggcggatgagctcctcgggggcgtggccaggcggtgagttcctcggtggcatggcctggccaggtgaatgggtcctgcggaggtgtcgtgaagcggttgagttccttgggggcgtggccaggtggatgggctcttggggggagtggccagatgcctgtttccctggggagcttggtcttgagtggctgtagccagtgctctggaattttcagcaaaggggcacagtggaggagggtgccttcctagtgggcctgcccagaattgggctccgagtgacggggtcatcacttttggattctgactgaaggacacatcagaaacaggacattatttccttaggattgcgacttaggggcagagagtcagaacctgcaagattttaagagggcgtgactttacttccaggggctccgaatgagagtggccagccacctggattaaaatatatgtatgagcaactttgattcctttttttttttttgagaaggagttagctcttgtcccccaggctggagtgcaatggcgcgatctcggctcactgcaacctccgcctcccgggtttaagcaattctcccgtctcagcctcctgagtagctgggattacaggctcccgccaccacactcagctgatttttgtatttttagtagagaccgggtttcgccacgttggccaggctggtctggaactcctgacctcaggtgatccacccgcttcggcctcccaaagtgctgggattacaggcgtgagccaccacgcccagctgcaactttgattcttagtaggaagccagaattgcatctgtgtgtgagtggctgtggaaagagattttggtgttcccggatttcgagcgaatggtgggcttcagtcttcaattctgagaaggcggggccagaacacgtggtctgatagttggcggtggtctggcgggtggagattctgaggtagcaggattagcaccttagggccctcccagggatgtggctaggtgctctgaatttctggttgggtgcatctggaaccttccacgtctgtcctgagtgatcaggaaagaaattctcctactctgggtagatggatcccgcctctaagcccatgcacttctccgcaggaccgcctgtatttcgtgatggagtacgtcaccgggggagacttgatgtaccacattcaacagctgggcaagtttaaggagccccatgcagcgtgagtctcggccaacagagaatggtcggggtggtggaagggggcaggatccagccactgaccttctgacgtccccacccaccccgtcctccaggttctacgcggcagaaatcgctatcggcctcttcttccttcacaatcagggcatcatctacaggtgagcagccccaggaatttccgtggaggaaatcacgcccctggaagggaagggatttgaatatgtggctctagactgctgaactcaacacttcttgcaattcctgccccacacccctgcatcgtccagggacctgaagctggacaatgtgatgctggatgctgagggacacatcaagatcactgactttggcatgtgtaaggagaacgtcttccccgggacgacaacccgcaccttctgcgggaccccggactacatagccccggaggtaaccccaaccctgctgctctggtcacgctttgagatcccttagagggtgtagctgatggtccagtattcaccacgggtgaggcctgaccctcagaccttgtcatgagttgtggccttcttacacagccagtcgttcctccagcctccagcacaggtgagcttggcactgagcctgccaggtgggcccagctgggtctctaaataggtaaggtgggcagcacctgtgggtgaatgttccaggagagtgggaccagctcgtaggaattccaagtaggacctgaccctggatccttctgagaaggggcagacgatttctagtgtactctgagtgggtgtggcctgtcccctgccaacactgaacatgtccggactatcttctgaatactttaaactgggcagggctctccctggagtattcagttggatggaagcttatttcctgtgttgtacgtgtttctctgatgtaagtggactggacttctgtgctgcatttttcaagagggcaggatcagctgggcgcggtggctcacacctgtaatcccagcactttgggaggctgaggcaggtggatcacttgaggtcaggagtttgagaccagcctggccaacatggtgaaacctcatctctaacaaaattacacaaattagccgggcgtggtggcatgcgcctgtaatcccagctattcgggaggctgaggcaggagaatcgcttgaaccggggaggcggaggttgcagtgagctgagatcacaccactgcactccagcctgggtgacagagcataacttcataacttcatctcaaaaaaaaaaaaaaaaaaaagccgggtgcagtggctcacacctgtaattccagcacttgggaggctgaggcgggcggatcacaaggtcaggagtttgagaccagcctgactaacatggtgaaactccatctctactaaaaatacaaaaattagccaggcgtggtggcgggtgcctgtagtcccagctacttgggaggctgaggcaggagaattacttgaacccgggaggtggaggttgcagtgagctgagatcgcgccactgcactccagtctgggcaacagagtgagaccctgtctcaaaaaaaaaaaaaaaaagaaaaagaaaaagggcagggtgagatccctaaggttctgggagagcagatgctgtcctatgagtattttaagtgggtggggtattacccgactttgttaaaggggtggggctgatgttctgaatgtacgtatagatggataaagcacatgcctgtagtcccagctacttgggaggatgtgcctgactcgtgcccaaataatcaatgtcagtgatcacaaaacctggctggtaatcagaatcatctgtagaaaatttgaaaactgaggccagacatggtggctcatgcctgtaatcccagcactttgggaagctgaggcaggcagatcacttgaggtcaggaattcaagaccagcctagccaacatggtgaaaccccgtctctactaaaaatacaaaaattagctggacatggtgatgtgtgcctgtcaacccagctactcaggaggctgaggcaggagaatcacttgaacccaggaggtggaggttgcagtgagccaagattgcaccactgcactgcatcctgggctacagagtgagactccatctcaaaaaagaaaaaagataagaaaatttgaaaactacacacatattcctgactctgacacaaatattctaggtgggtggaaccagtgacttggccgttaggtagtctttctatttgaggccaaatgaatgtttgaagtaggtatgctttgtttccagaatattccaaaagttagatcgctggccaaaatattcagagtggaggctgggcgtggtggctcactcctataatcccagcactttgggaggcggaggcaggccaattgcttgagtccgggagtttgagaccagcctgggcaacatagtgaggacctatcttcactaaaagtgcaaaaattagccaggtgtggtggtgcacacctgtagcccacctacttgggaggctgaggtagaagaattacctgagcctgggaagttgaggctgagtgagccgtgatcacactactgtgctccagcctgggcaacagagtgagaccctgtcaaaaaaaaaaaaaaaaaaaaaaaaaacgaaacaaaaaatcacctgatgaaataaatattcagagtgggaagagcttgtgctgaaagcacttaacgtgggtagcgctcccagggggtgaggccagaggggtcctaggcttcctaaagaacgcatcatgattccctgccttccacctcccctagatcattgcctaccagccctatgggaagtctgtcgattggtggtcctttggagttctgctgtatgagatgttggcaggacaggtaagggaaggtggggagaagctggcttggctaaaagagacagagaggggcacctggatctcaggaggagccagttagaaaggagcccagaaggttgtgctcgaatagcgctgtccatggttctgaagtgttgtcttaatgtagaccaggtgttttgttttgttttgttttgtttgttctgttaccatggattctttctccctagatggtaaagtagcagtctggttaagcctatggatcccttctcagaagaatgtttttcaatgcacaaaatagaataatacatacgcagaaaaccaaggttcaaatcctcactttgccacttactggctgtgtcagcttagacaattacatacattctaaatcagcttgattggattcctggactgctgagtgtactacaactaaaaaaattggttaccacactcttgatcatcttcttagctggctatggtagtgggcacctatagtcccagctactggggaggctgaggcaggagggtcacatgagcccaagaactcaaggttacactgaactatgagtatgccactgtgttccagcacaggcgacagagcaagaccccatctcaaaagaacaaacaaacaaaagaaatcaatcattttgaaagatagtcaccaaaacttttaaaatttaattgaatctaacaaccaactaaattcaatgtatacagttgtctaaatatttaaaattggaaaatggacatatgtgcaatttcttattaattcattaagtagtaagttctaatggtagtaaagtaaaaaggagctctaacagtaattttgatgtagcaatgactaataatttggaatatctgcaactctcatgtgatgagaaaatacctgtgattactattgataatgaagccacaagcactgctgctgcctgcattcataactgaagggaatgctaaattttagttagaagttaaaaaaaaatttggccggacatggtggctcacgcctgtaatccaagcactttgggaggccgaagtgggcagatcacttgaggtcaggagtttgagaccagcctggccaatatgatgaaaccccatctctaaatctttgccttggtatcattttttgtaacctcagaagactgtgaactactcatccaaccaggagaatgcttttagggtgtttcctgcagtttttcctctcttctatttaactgacatgttgcataattaacagcctgctgatttacatagcagataaagagaggcagaatagtacagagatgcacagatctgaggcatccgagataggaaatgagagaacctgagaaggagagagatcaagctttggtggtttggtctgatctctcctgagggtgtggtcaggtgtgcatgtggggcgtgtgatgggtcaggcatgttcccggtggggtgaggagggtgtggaaggtttggggaaaggcagttgggcatgtccctgactctctatcccctccactttgatagcctcccttcgatggggaggacgaggaggagctgtttcaggccatcatggaacaaactgtcacctaccccaagtcgctttcccgggaagccgtggccatctgcaagggggtgagagccccctgactcccagcttctccaggctcacaaccacacaccccattgctgtctctgtgcctattagaaaaatgctcccattcctgaagtcactttacttccatctgttggaaaagttgatatgatgcataggttttgttagaacaatgatttccagccctgttgccacgaggcctggagatggcctctgtctcatccttctctgtgactcccactccccagctccctgcttgcaggaagtgctgaaagtccagggtgtctgtctgtctagaactgggtgggtcaggtaaacccaacttctgcagcttttcttcctgtgtgaacttgggtgagtcaccaaaactttgtgagcttaactctcttcaggggttatggagttgacacagaagaaagcacctggcccatagcagattttcagcccatgtcagcaccttctgcgtctagctgctctctctgcatctccctgacagtctctctggtttctgtctcatgcctcccctccatctgcatacgatggggctctctgtgtttcttccttttctctgtgtctccttctgcatctctgtctacacttttgggcctttgtccaacccccctaccccccatctctgtcccctcctgtgtccactctcatacacacacatgctacatctcaccctcctctcctgctggctttctgtcctcccttttctctgggtctctgtccccatatttggtctttattcctccctctgggtgtgtgtttcctgggtctctatccttctctctttctgaatctctgtccccctgggtctcctctgtctcctcccttctctgagtttctgccttcttacctggggtctctgtaccaccctctgaatttctatttccccttttctctgggtctgcaacctctcttcccccattccctccctcttccccttcatctcctctacccttccctccctccccctaccgacctccctctgtccttcactctccccttccctccctccccctacccttccctctccccgtccctctctccccttccctctctccccctaccccttttccctctcctcttctccatctccctcatgatttgttctgtttctctgtgtgtccctgggtctctgggtatgaatttcatctgctatcattttcatgtatcctctccttcttcctgtctctctctctctctctctcactcactctcaccctctgtctctctctctctctgtccctcttcctctctctctcctctctgtctctctctgtctcgctctctgtctgtctccctcctcctcctcctccctcctcctcctcctcctcctcctcctcctcctcctcctcctccttcttcttcttcttcttcttcttcttcttcttcttttcttctctctctctctcctttcttttcccttcctccctccatttgcctgtttcccctggctgttcttatctctccggatctcatgcctgtgtctcttggttcctccatctgcctgtctctgtccctctttctctgggtctacctgtccggcactctgtctgtttgtctgtctgtctctctctgtgtttcccacagttcctgaccaagcacccagggaagcgcctgggctcagggcctgatggggaacctaccatccgtgcacatggctttttccgctggattgactgggagcggctggaacgattggagatcccgcctcctttcagaccccgcccggtcagtcaccctccaggcaacaaaaacctggtccctgaaggggtggggttcccctgggcctcaatatacctgtatgtgggggtggggttccctctgcagagccccccgcccccaacaaaaggaggtgcagacaccatgaagcatgaatagagattctgcaggagacaggagatgagactggggtacacagagggacacccgaggagccctcggagctgcttaactttccctcccccacgtctcccacagtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgctgaagtgtttggatattttcttgtaagcttggagaatgaacggggtgtggaggcgggacagtgactgtacatagacacaaacagagaaggaaagcacggagacccacaaagtgagaggggagacacccactgcaggggagcaagcagagaagcgcgcgcagacagaggcaggagacccagacagacagagacagggagagaaaatatcacagagggcaccaacgtggacagtgcacagcgagagaggggcacggagatcactgagagtgccaggtggcgacccccgcgcagagacccagcgcgtccgtgttcaccagagcagccacgcaagctcacatgcacccccaggctcagacaccggggagaagtccttcccaagcggggagatcacagtctggcctcttcttgagagacctagagacctgatcagaggaagagacccccacgccagagcaaccaaaaacagccagaacccgagagcctaggaatcggcgacggaggcacacggcaggcagacgcgccttctgggcctctttcccttgacccacttgagagtctggggagtgccggggaccgtgcagatggactacatttccccgcaggcctcgcggcagacccttcccccaagtgcggctccttgccgccagggctgatgggaaatgtagtctccggtcagggccagaccagtggagcggtgtgccttgtctgtgtgtttggaggggactgagccccaaagcttcgcagtcttccttgcggacccgggcacgtcttcttccctgcagtctcctgggtttccatgacccggtccgggtggatgctggggctgcccctctctccctcatcaccgccgcgacacccccatccagtgcccgcaggccccagcccccgctccgaccctcggcgggcggcctgcccctttaagagtggccccgctgacatcacggcggggggggggggggtggcccggctcctggctccgcggcggctgcaggacccgactccgctatgcgcccgcccgctgctgtagggaccccggcccgggacgccccctcccgcttcctgcagccgtccagaccccaggctccgccccaggcctggctagagccccagtcctcgtcaggggacccccaggattgtccctgctgtctctccttctcagagtctctctctgtctctctctgtctctctgtctctctctctctgcctctgtctctgtctcttctccaagctcaaggtctctgggtctcagcatctctcagccccaggcctctgggcgtccccctgtctctttctgtctcttcctggtctctgacctctccacttcccaggcctcagaatctctgcgcctaggtggtgaggggtggtcttaaactctgtctctctccctctttgtctctctctgtctctgtgtctccttcagtctccagacctgagtccctggatttctcggcctcaaggtctcggc

SEQ ID NO: 13218 - DNA, 11105 bp, Human
attaagaaccacatttcgttaatgattaaaacaacagtgattgatttaggggctcagtgagcatttaatctgtcctgacttcaggtaccatgctaaaggagcacaatgcctgatgctgcaggagaaacattaggtaactatttaatggagttttaattttctgttattatttttaataattaattgtgattttgactatttggaagctacaggtatattttgtcctccttttggggtggtgttattgccctgccctgttttaatcagtggttcttagagaaagtgaactcaggagtgacttaaaatgaaggaagacggactttggctaaaattacaattaaataatcaaatcattttcaaatataaagggagcatgcagatgatctggcccaatcctttcattctgcagatgagaaaactgaggctcataggaatgaaaagacttgcccaaagccatacagcttgtttctgttgtttggtgcattaggccaaaagacctaggcctaatagatggaaaatatggcaggatgtcttggccttgctctgacagttgcttctctgatctcagatatttcccaccctttgtaatctgtgttccacacaggaagtagttcttgttttttaaatatcgaaggtgtataaacgtaaagtttttatagatgagccacccagggccaatatctgtttaagtaaagacctaaatgctttgcagagacagtaaagtgtcatgtctgtcccagggaaagaaatccaggacaggaaatgctcagtcttccagcactcctctggctacctggagctcaggctatgagcctcaacccctccctgaagcattagctctggagcagaggctgtgatttacttcagagatctgggcaagtccctttaacctggtagtccttcctttccttgtttgtaaaacagagagatgaggctgatagctccctcacagctccatcagaggcagtgtgtgaaattagttcctgtttgggaaggtttaaaagccaccacattccacctccctgctaatatgattactaaaatgtttttatatgaaagggccaattcctcatctcccctcttcctttaaaaacagaccaaggggcatcttttcttgtctccctgtggcctaaaaggttactgcttctgtggttatctccttggaaagacagagtgtcaggactcttaggtacaccaaaaatgaacaaaaaaatcaacaacaaccataacaccaacaaaaataactgctgtgtcggttcttaagacggcttctgagctagaaacagatttttctaactgtaaaaaacgtggccccagcctgtctgcaggccacctctgtctttaggccttggggggaggagggaagtgagctcatttactggggtctacctcagggtcatcaccaaggtgttctacaaaacgcactttaagaatgttttggaaggaaattcaccttttaacagcccaagaggtatctctctctggcacacagttctgcacacagcctgtttctcaacgtttggaaatcttttaacagtttatggaaggccaccttttaaaccgatccaacagctcctttctccataacctgattttagaggtgtttcattatctctaattactcagggtaaatggtgattactcagtgttttaatcatcagtttgggcagcagttacactaaactcagggaagcccagactcccatgggtatttttggaaggtacggcgactagtcggtgcatgctttctagtacctccgcacgtggtccccaggtgagccccagccgcttcccagagctggaggcagcggcgtcccagctccgacggcagctgcggactcgggcgctgcctgggcttccgggacccgggcctgctaggcgaggtcgggcggctggaggggaggatgtgggcggggctcccatccccagaaagggaggcgagcgagggaggagggaaggagggaggggccgccggggaagaggaggaggaaggaaagaaagaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggtgagcaaggctacctggtgaggggagacaggcagagggggtctaggagcctccttggggggaagaagctggtcacaggctgtgaccgaggcaaaaggtggcctaattattttccaatagtggtgctggaggtggggatgctggcgctgaaagacctttaaatatcggctactgcccctgcccaggccttctctgtccagcagtccctgggagattctcacctttgggaagtgcggggcaggagagcagaaacaagagaagcccttggtaggggggtcgttgggaaaaactgtggggtcttgggctgaacgcgttgcccacgggctggaggttgcgatccccggacggaaagcgcgggaggaggaaggagagaaccggctctgaggtccagagagagtgagggggcagagcgacggcgagatggggagagaacacctagctggagcaggttctgcggtagagagcgcagtcctgctggcctctggagagtgcgcgccgctacggaggctgcgtcgaggggagtgtcacccaatctggcccccagctggcggggcgccctgagagcttgcgaactgcagttgcaggacgcgccttctccacgagctattttcgtcgacttgcggaacccaaggaacctcgcctctatcatttcacggtgtagggtccctagagacgacagccaagatcccaggggctcccaggacgcttgttcctgcggtgtcgtgtcctatggggagttcctggcgggacgaaaggcggacgcgcggctcttcctggccctccaggcccggaaccgacgggaaaggttcccgtgattcccgagtccctgcaggcttcttccagcgggagttggtccgggggccttagaggcctccaagcactgctttggaggatggtttccaaggatcgcggtttgtgagttgaaggctttgtgagaggttaaacccccaaaagatacatacttggtaaactgaggctacctgtaaacacatttcggcattaggagaagattcgagtagggaagtgaaggacaaccaccccgagttacattcctttcccccaataaaaagctctggggatgaaagttcttttggcttttatcttttcgatttaaaaatttgagaagaaaaatgtgactagagatgaatcctggtgaatccgaaattgaaacacaactcccccttccccttcctatcctctcggttttagaaccgcgctctcccgccccaggagattccttggggccgagggttttccggggaacccgggcgcccgccccttctactgtccctttgccccgcgggcacagcttgcctccgtctgctttctctacttctggacctctcctcgccgggctttttaaagggcttctgcgtctcaaaacaaaacaaaaaaaccctttgctcttcccaaccctttcgcagcccgccccagcggtggcgcgggaccagcaaaggcgaaagccgcgcggctcttgccgggcgcggacggtcgcgcaggggcgcccgcggcctccgcacccggacctgaggtgttggtcgactccgggcatccacggtcgggagggagggctgagctgttcgatcctttacttttcttcctcaaagtctacctgccaatgcccctaagaagaaaaccaagtatgtgcgtggagagtggggcggcaggcaacccgagttcttgagctccggagcgacccaaagcagcaactgggaacagcctcaggaaagggaggtcgggtggagtgggctttggggcaggagtcatggggcccgggccccggggacgacctggcgctcccggccctgctgaacgctgagttgcgcctagtcgggttttcgaagaggcccttgcgcagagcgacccacgcgcgcggcagcatcttcgattagtcaggacatcccagtaactgcttgaactgtaggtaggtaaaattcttgaaggagtatttgctgcgtgcgactctgctgctggtgcaacggaggaagggggtgggggaaggaagtggcgggggaaggagtgtggtggtggtttaaaaaataagggaagccgaggcgagagagacgcagacgcagaggtcgagcgcaggccgaaagctgttcaccgttttctcgactccggggaacatggtgggatttcctttctgcgccgggtcgggagttgtaaaacctcggccacattaagatctgaaaactgtgatgcgtcctttctgcagcgacgcctctttctgaatctgcccggagcttcgagccccggcgtctgtccctcagcctggcatggcttcttcgggggtctgctttgcatggggagaggggccacgcagcggcggactaggtttggggattctcggtaatggacccggagcaatgactaacagccgctccctctcactttcccacagcgatcaccctctaacaccctccctcccattcccggccccgcgcgtgacaaggtcggctgctttcagccgggagctagatcggtggcccggctcttcggagccttagcaggcgttcgccaaggggtgactggctgtcattgggagcaatatttggccttgaggagaccctggggaggaagtggcggggagctcgtgtttgcttgtgtgtgtgtgggggggtgtgtgtgtacacgcgcgtgggcagggtccctctgcgctttcctttttaagtgcctctcggtggtgaggctttgggcgggtgagactttcccgacctcgctcccggccccacttaagccgggttcgagctgggagacgcagtcccttcagtgcgccccaaatcctctggcttcaggtggcccggcgcgggggcccagcacgacgcaccgcgccgagaaccgggttctccgtgcgctgcgccagtagccctgggagcgcggcggccgcggggcaccggccgagggctctgccgagcgccgccgggagctcctcccggaccgctgaggctcgggcggcgggcgcggaggttggcctcgcctggaggggcgggcccgcgaggggcggggggctgtggaggaggggagggcgcgcaggccctttcgccgcctgccgcgggaggggcctcggcgctcacgtgactccgaggggctggaagaaaaacagagcctgtctgcggtggagtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcagtgagtagacacctcttccttccccctccccggaattcactctgccctcaccacccctgctcgccggctgtcccttccgtcggacctcctttacaatatccacactctgctccctggcagcactgtcgctcccttcttggcccggcagccggggcgctggaagcgtacgggttccttttaaagtgctgctagcgcgcactcgccctctcagcgttgcaagaaaggggagcgcgagggagctaaagagatgaaagcccggggttgtaccttgagggctaaccactcccttcccctatccaacttgtctgggagagcccccagtgtctccgtggcgcgttcccactctcttgtcaaaactcacagaggtctctccggaatcgtctctcaccccttccctggggatgagcgggcacgatcaggcacttttggctgaatatttcaaactcatcggccacaataaaataagccctcaagccacccggttagctcccagaccaccttctcggcttctggaccctgtcgccctctgtcttcgcccagcccctgcctctcactttccctccctctggctctgaaccaactggaagttgtgaaagttgggctctgagggtggaggaaaagggagagaagctgaaggtctaaagtggagagcaatgccattttaattctccctcccccaccccttttcaccccctcaatgttaactgtttatccttcaagaagccacgctgagatcatggcccagatagcagttaggacaaaaaaagattaacaggatggaggctatctgatttggggttatttgactgtaaacaagttagaccaagtaattacagggcaattcttactttcaggccgtgcatggctgcagctggtgggtgggcgggtggtgtgagggagaagacacaaacttgatctttctgacctgctttccatcttgcccctccatttctagccctaaatgcatatgcagacacatctctatttctccctatttattggtgtttgtttattctttaaccttccactcccctccccctccccagagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaaggtcagtctcttcccccagtctgcgtgggggagggctggtgggactggctagaggggcagtgaaagccctggggaagaagagttcgggttacatcaaagccccagtccaggaggctgaggaacagagctgcttacctccaagaatttgcagagctgccgccgaacttattttttggagacagagggggaggtgttcaggggaaggggaatgacagcactcagacgtgggctagccccagcggtgtgtttttgctatatcaaagccttttctgctaggttttctgcccgtttttttcaaagcacctactgaatttaatattacagctgtgtgtttgtcgggtttattcaataggggccttgtaatccgatctgaatgtttcctagcggatgtttcttttccaaagtaaatctgagttattaatccaccagcatcattactgtgttggaatttattttcccctctgtaacatgatcaacaaggcatgctctgtgtttccaagatcgctggggaaatgtttagtaacatactcaatagtggaagagggagagggtggttgtctgcatgtttcctcctgcctgtgctctgttggcccctctttttctttacaaccacttgtaaagaaaactgtggacacaaagccaaggtggggggtttaaaagaggagtctgattgtggtgccatagaggagttgacacatagaaattattagacatatcaaggaggctggatatagtttctgtctttggtgcttgagaaatgctagctacattttgctggtttgttagctgccccacttatctgctccttcaaattaaggggtatgcttattttcccccagtaggtttcccctgcataagcagaattcaccattcattgcccaaccctgagctatctcttgactcttccatctttgaaaaaagttcatatgctttttcttttccccttccttcctaactgtgcctagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaatcatgatttttttttctccttaatcctttctcttttccttcgggctcatctcttttgaatgaggcttttttctgttcaggtgagttggaggctggatggaagtcaaaaggtggtacctggaggtggttaagttgtagggacaggaagtaaactgttggcagagagagatggtaattgccagcatgaattgttttctatttctatttaatgttaacaaggatgcagtatcctctcccatctggatgacacatgccttggagaaacactgggatgaaaggagtgtaggtcagattaaagacttcatttcaggccccttgtacatcttctgtttcactcacctgttgaggtgtatcacagctgagcgtgatgaggtctcaaccctagaaaaatgatacccacctctgctttcatgatacctcagggtatctccagttattacaggtaccaatgtgatatttccaaatcaaaactaatttgtacactaacatcataatgtgtgtgtgaaggcatgtttttaaacttattttttttttctccaggtaggactcttttgttttttcttttgtctttttttttttgaaacaagttctctctttgttgccccaggctggtcttgaactcctgggctcaagcaatcttctcatttcggcctctttgggattacaggcatgcactgctattttgtctttttttttttttttgtaacaaataatgtaccctaccttcaaaaagtttgatgactactgttttaatatgccacttgatagaatttcccattgtttcttgactttttcccttgtcctcttttcccaatgtgaaggccttcatcaagtttaggatcccaacagattgggctgggtgggggttgacaatggggtcagatactaaagggtcagaatttctaagcaggcactgtgaaggtgtcccactattatacagaaatctcgagtcaaatgtcaactctccttttcgctctgtactgcctccctcacaccctcttccctggacttgggcagaaagaggtagatctgatgttctgtgctagggtttcttaaagggaaaagctcaatttttggacaaagttaataaaaaggaggatgctaatgtaccctcagttaagggctcccagcaggcagataaatgcctttctggaatgacaggtgtagggattaagaggagcagaggagaggcctttgctttttcttacttgccaccaacaactaaattaagccttgaatcttggtctgtgctggctcatttcatatgtgtgctgagaaaattcacacatatgaagtgagccagcacagaccaagatccctttggatccctttggagcagaaacatttagtgtctttgtatgttctctgtggggaaggctgatagcgcatttctccatcatgaaggtgtagatatgagcggtagtattgctgttgctggtggtgtgtgcacccaaagaatgtgtgtggtgcacactcctggcgtttgcatttttctaggtggggtgtgcacccttgcattcttgtacacactttcttacatacgctcctgggagtggagtgggtgaagcaggattcatttttgtttttaattactgaagtcctacactcctccaaaaggagcagcttagtggaaaccaataaaaattgaagcggggtggttgccaaaaccccagctccccggagagcgcaggtggagagaagacatcagagcctcaggcaaaggcagcaagactacacagttcctccaaaactccccgcaaaaagggatccttcccccacccctccaaccccccaggtcgctgcccctttgattaatggtatggagctcaaataaatcatttagggaagccccttatagattgccctcaggcagcctcattttgttttgcccaatttctagcaactttctgaaacgtcgatgtcattgaaaaggaaccagtagatctccagtacttgaacaaattatcctagggccagtactgagccct

SEQ ID NO: 13219 - DNA, 20354 bp, Human
  misc_feature (1)...(20354): n = A,T,C or G
ggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggtgggaaggaagcccttcggattggactaaggttttaatcattagtggtgggaggcgggaggatatgcagggccttaaagaacggtagtcttagagaacaaagaattacagagcacccacaaatcgtaatctcgcccaaagcactctaacaggataatttaaacaaggttaggtagcctgcgacctttaaaaaaatggcatcccactaacccgcatggaccccatagttgcgtggttcgtgctacaaatcactggggtggtttcatctctcttagtatggaaactaatcagcaacataaagtgatgaaagcaaacggatcaatatcagtggcactaatcagtggggggtttatttgtaaagtattgaaagtttaaccaaaattccttaaaaggcaaattattccttccctgcattgctcttgtatcttaatttaaggattactgtatattgatgcaaaactctggttgttgatgccaaagaatggagggtggaggaagggactactgcttttcttggatacaaatttgcatttcttaaaacattaaacagatgtatgcattcccttgagcttttacatatatcaacctgcccttaagaaaatatacaccatatgaggtgacagtgtttttctttaatgtactgagtctaaatatatactgaatcaactatttgggtgagtgagtgtggtgtggtatgactccctgcccacacccccctctcccattccaagcaaaatacataaatatagctcccatgttttaagtgttctgagggcttattttttcaaagacactctttaaaaaataacatttctcgttacaaggaaggacttttctgagcagttttggggttagaggatactattaatatttgaaaagaaattataaattacttttaatattatagcaaacgtcaagcagtttttgctacctggacctttttagtggcattaaaaactttcaattcagtggctacaattttttctgctatttgctagatttcatgcttggatgcgtatcagtatatcttctccctttaaaattaacactgaaaggatgtgtttttgttttggcatcctacccctcccccatttaattgtttcctttgagaaagaatggagcaaatgagaaatgaaacttgtaacacagcaattggtactaatttgttcagctatttatgccttacagtgagactgaagtgctatttcgatgcaattttagtcaaaaatggtggtgcttcaaaattataaataagggtcttgattgtgttgcttttttgatatcttctcagtgcagaatgtatcttcattacagtataatctgagattcttaattgaaaagcattatattctcagataattttttcctcctcttgagctatagaatgtctaaatgttactctgaaacatttaagaaaaccatcaccaaaaaattaagatgataaggggtgtgtttgcatcttgagtgttaatgttttaagtaatttagatgtataatttttggtctcttgcatattatataatttggtccctttttggtgtattgtaatgaatgtttatgatgaatatggctaaattcagggttatgttggaaaatccattttctcctttccccatggaattaacttgtttttaagttctccaaaataaatctttcaagtcaacaaacatttattgggtgcctttttatactattttataccatgtactccattgattaagaatagtagtcaaaattatacaagccctctttaattttatgagaaaaaaagcctataagtgatacatttgatgtatttttactattgatagatgttaggtcctaatagatgtttatcttttaggttgaaatcacaaagattagacaccttttagataggtgttcttcagcaccactgacaacacggttctgacagtatttcatgacagtaagtatattttaccattttggttgttaattagatttgaatagtaattggctggaaataaaattgtaaccaatttatactggaggtgcctggtagaatgaatgcatttcaagtctagacagacagtacctctgctcattcctgttgcttccttattttcagcttcttgcatatattatttcccatgggtccctaagtgctgttgaggctacagggtagcctgtcccagctgtaaaggggctgtctgtttagccaattaattgaatacttaggggacagttatgcccagaatggaaaatgctaactcttaagtgcagtagatatgggaagaagagaggcatggtgagcctgggtacttgggaatgtcacagagggatcctgcagaccttgaactgagccttgaaatagagggtgggagtggattggtgaagggtgtcaccaaaagcaaaagcctgatggcaggatgggcaacttaagtttaggggatcgggagtagaggtgcatggtccagggtagatctcaaaggataatgtaggaaagagaaagcacttgtcccctctggatatttaattctggatgtgctactatatctgtaacctcgggtgtgttacagcttctttgagctgtggtcgcttcactcctaaaatgaaagaagtgcactcagtgatccctaaataaagcacattctagcacaaagatttttattaaccatgaagatagagaaaagtaggaaacaagtttggttaggttaaatgtgcgatctgctcatgtgaagtcatgaaaatgaggtttggatttgacacaggaagcctttaggaacctttgagaataggttcaagagtatagaactggtgttgtggtgagattagtcttataacaatatgttaagatgggctgggtggtaatccagtggaaataggaaagggaaagcatatctaggagacatttttaaagaggtaatagatgaggtagagcttgaaggagatggaagaacctaagatgatgctggtatatttggctgggcagagtgaagggctggtattcttcttagtagaattacagtagtggaaagggaaatctccctcctttccccgttgcagggaatggggcaaggtgaatttcatttcccaatatcttaaatttgccgtgatgagatattagacatgccctacaggcatgggttgcttgagtggcaagcagaatattggttgtagatttggcatttataagcatagaagtgatatttagtgagttcattaagaaaataagggaagaaagagaaggataaccttgggtgaaacaattagggggtggggaggaaaggatattgctttggaaatcagagtaggagagaattccaagcataaatgtgtggcgagtagtagccagcactacaaagaacagtcaagtaggatgaggacaagatcactggcagcttttaagagtggtttcattctgggttggggttaaaaagtacatgttcaggagtttaaataggaatgaagaggtgtcttaacaactgtcagggcaagaatggtagctaggcaagggtatggggcagaattaagattttatatatctctgtgtacttctgtatgcttaatgagggagactaagcatgtttaaggaagagtgaaggagctggtaaggaggattgaagatacattatagaagaggaatctttgtattatttcttatcctcagatagataaaaggaatgtaacccagaaaacaggtaaaagggtaaattaagagagagaagaatctctgcctggaagaataatgagaaccgtatttgagggggcaatactaagattacatttgttaagttcttactatgtatcttgcactttgctaggtgctttttatacaatagcttcctcatagcaacatcactttaaaaatggggaagctgaaaacacaaagagagctcataaatggggagccaagcttcaaacccacgaaatcggtcctaagagccagtgctcctcaccgtcgtccagggtgcacttcttaaccatctcacaaacaccatcctggtttgagaagctaatttcagtgttttcagtgtataatcagtagccttagaatgtaaaggggacaaattaaagaagtaggtgtaaagactgtatgaaaaactaccaggcaggaatgctgtagagagtagttggcatctgaggccctggatttcagtcccatttactgtgtcacctcaggcaaatcattagcctcatgtacctcagttttctcacctgcgtcacaggcttgtgaacattgcatgagatatttagaaagtgttcaataaatgtaaacattaaagagggcagtatttgtttgtggaacaaattattagcatagtttaaatacggctacatcaaaaaaataaagatttattagcccactacctgtttatttcaaataatattttcaagaataattctgtcaattcaactaaataatgagaatagtcattaaaatgaatttattgggatttaaccactctttgtccatatttatcagttccttgagtctaacgattcatcactgtccgtgtccccttgtcattatcctacatgctgtgctcttccagcctcattacctggatgaaatccaacactttggcttttgtagtctcatatcaggcctttcaagtgtcacactggacatactggcaccactgtaaactcacggtcattagcttcagctaggcttacactgtccagcactcccctccctttcctttcccattctctgcggtgacagctgtctgtctctccagctgcaagaatcccagcattatccttggtcttcctgtatctctatcagtcagtcaccaagtcacctactaaaaagctgtctagttgttctgcttctcttgatctccagcgctctcacccagacctgatgctaaaatgatcattatcttgcttgaagtcatgccctgactgcagcattgcagtcctcactggtcttctgtgcctatttgtgctcccctccaggtcggtttctgtactgaactgtagccagagggatttttttttttaatgtgatttgtgctcttctgcttaaaactctttgatttcctcttgtccaccggacactgcttgatctagcccctccttagcgccttccaatccaccagtactgtatttcttggttttctctgcctagaacattcgtttcccacctttctttttgcctgactgatttctgtttatctgtcagtctcattttcaatgtcatttcctaagatagcctttcttgacccctcagactagtgaggtcccttttggagtaaactcacatagcacataacaaaacatctttgtttttcttcgtacttggcactagcaattacttaattatttgtaattattttaatagctatatataccacttactgagtatgcccattgtactatgctgtctttacatggattagctcctaacctgtacaggagcctgggaggttaagtcttgttctcatccagtttgttcacggtctcatggtaagtggcagggaattcaaactaggtgattcgattccagagcctgtgtcctggaaggactaataggctctgttctctaccccttcaccctgcctcccaggttatgtaacatttgtcctgcaagctgaggacagagaccttgtctgttgttgacagctacgtgaccagcacatagcatgaacctggtaaatactaagcgctcactcagtaaatatttgttggctggcttactgacaatctacagtctgttttataagtttttataggatgttttagacctagaaaaaacctttgggatgcatctagcaagtttttttccatcattcttatatataggcgaatggctggcatattctaagcatcaaagattaggttgacttattgagtgaaaggtactaagtgccatagagctttaaagaacagaacatttgtttttgaattgcagaaaggataaatcagaaagattaaaggaggatagagaacactgggattaaagtctggggcaggattttaatggtagaaagacagaggaaaggaagacagaaggcgtgaaatgatagaaagctaaaacttgcagaactgaagacacatacagttaagcagatgatgtgcggcttctcttcaaaggagggaggatgagatcgaatgtctgtggggtacactacgtgccaaacactgtctttagcagctttctagtctttatttaattctgacaactctaggaaatacttttatcttcacttttagaagactgaggtttagcgaggctaatgctgttagtccaaatgataatcatgttgctaattccagtgcatgacaagataatatgatttaaacttttttcctttaatacttttgtttgtgttatatttctaaattaattcatctcccagatccgcctggttatttgaacagtgtcttgctcatagccaattttaaaagacttaatggtatcatgtaaacactcattcaggaaagaatttctgttattcttcccaacccaccgcctgccctccccacccccaaccaaagtttgtttccaattgtaggctctgaaacaaccactttggtcctgtctcctgcaccttgatacttccttaggttattgtaaaagctagtcaactcataggtatcataattgatcattcttttatggctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaaaaaattggccaggcatggtggtgcatgcctgtagtccagctactcaggaggctgagatgggaggattgcttcagcctgggaggtggattctgcagtgagctgtgatcacgccactgcactccagcctgggccacagagtaagaccctgtctcaaaaaaataattaattttttaaaaaagaaatataaattctcttttagtaagcttaaggctatgaaaagtataattgatgcatcatcctgtgacagtttataagtgttgaatctgttacgtttgttagtactttgaaaagtattgaaaaactgtttttctcctcatagatggatggtgacagttctacaacagatgcttctcaactaggaatctctgcagactatattggaggaagtcattatgttatacagcctcatgatggtaagcaagccacaattagaaccaaattctcaagttgaagcaagttagaaagtggacatttcattaatatggtgttctaggctacttgtgtctttataggaaaatttacaatcttgtgttacggttcaatgagaaagtctaaaaaggcgtaccatgctatttttattagaaatagtcttcaaaagaatgagtccttgaaaagacttttactataaaaatacaccttgtctaaaatctgtacagtttcttttaaaatttgttatcgacttcctgtttaaatgttaaataagaaatttataatcaattgatagggtaactaaaataattatttagagggtgagttaaatttctagctattatatttcttgcacttatgatttatttttggttttcattcaatattaactttgaactatgtcaggtattagaatggtagtgttggctcagtgtggtgctcacacctataatcccagcagtttgggagggcaaggtgggcagatcacttgagctcaggagttcgagaccagcctgggcaacatggtgaaaccccacctctacaaaaaaattaaaaaattagctgtgcttggtggcatgtacctgtagtcccagctacttagggggctgggggctgaggtgggaggattgcttgaatctgggaggtagaggcttcagtgagccatgtttgcaccactgcacactccagcctgggtgacaaagtgcaaagtgagaccctgtctccaaaaaaaaaaaaaaaaaaaaggcagtgttatgttggcctatcagaaataatttacttttgtggcattttggtttgtaaaaaaaattttttttttttttttattttttattttttttgagatggagtcttgctctgtcgcccaggctggagtgcagtggcacaatcttggctcactgcaacctccgcctcctgggttcaagcaattctcctgcctcagcctgcccgttagctgagatcacaggcgcccagcaccatgcccagctaatttttttttagtagagacagggtttcgctgtgttggtcaggctggtctcaaactcgtgacctcagatgatctgcctgcttcagcctcccaaagtgctgggattatagtcatgagccaccacgcctggcctgatttgtaaaatttttaaaaattgagatatatttttagaagaaacttgccagagggattaatttcatcctgaaacggatattcaaataaattaattctgataacatcattttaaacacataaaaacgtaaattgaatcaacttaagtgccttgcctccttacttagtacatatgaagagtgggcagtttacttacaggatactgcatttagtcataaaaggatgttattggtactgcgcaagcttcagttatagctaaatttatataatttgaaaagtccctttttgtatgaacagttggatcactgctctagctttgttcaaaaactagttacattagtaagccaactggatcagtaataatcaagtccagtttttccattctttaaagaattttatataaactttatacagacaagacaactttatatcaactttaaaagttttatatagacttttacataaatgagtttatataaacttgggtttggagaaacatacaacctcttaatctagcagtattgaaggagccataggttacggtctgtaagttttatagctaagtcgtataataaatatttatgagtacctactctgtggaaggtgctgtaccaagctgtaggaaacacaaagctgattcgtgacattaagtagcaaaaatctaataggagaaatgaggaataataaaaattctaaaaatgtgtaagagaaaaggcatagagaagcacttacattttatgaaagaaaagatcatttttgaaggtggtatggagatgttatttgagatttttggagaatgggcaagtaggattttagcaggtatatttgaggataaaaagtgttctaggcagtgagtctgaaattaataaaaaaaaagttcagttctggctctgtaaaaattatgaagagacttgctatcctaatccctaaataatggttaagaggtgaaccagaatgattttattctggatcactttggtagttttttctatcttgaaatagaaataataagaagctttacacctaaatatttttatttctttagatactgaggacagcatgaatgatcatgaagacacaaatggttcaaaagaaagtttcagagaacaagatatatatcttccaatagcaaacgtggctaggataatgaaaaatgccatacctcaaacgggaaaggtaacgtagaggagaaatttaactaggttttttcaagggaaacacgaaactacatgaattcataggtcatgggtacagttagctgttgatttcaatcattcaggctttcagcaaatcaaatatttctttcatgtctacatacacagttactgaacagtgtcccattttcaattctgtcatgtccctaaatgttctcctctctcccacttattggaggcagataaaatagaatttagactgttttttttttttttttttttttttggggacagagtttcactcttattggccaggctggagtgcaatggtacaatctccgctcactgcaacctccgcctcccaggttcaagcaattctcctgcctcagcctcccgagtagctgggattacaggcgtgcaccaccatgcccagctaattttgtatttttggtagaaatggggtttctccatgttggtcaggctggtcttgaactctcgacctcaggtgatccatccgccttggcctaccaaagtgctgggattatagacatgagccactgtgcctggcccgactgttttaaaaaataggtacgttgtcagaactatcaggtttgggtgtatgaagctgtaacttttttttttttttttgagacggagtttcgctcttgttgcccaggctggagtgcagtggcgtgatctcggctcattgcaacctccacctcccaggttcaagcgattctcctgcctcagcctcccctggtagctgggattacaggcacgagccactgtgcccggcctgaagctgtaacttctcccatccaagtactaaccaggcccgaccctgcttagcttccgagatcagacgagatcgggcgcgttcagggtggtatggccgtagactgaagctgtaacttctataatgttgcagtaaatttaggtcgtattggtctgatataggtgtaataagaattttccaaaacaaatcctggtatttggaaacagctatttttacataattatagatactaagatacatttaaattgatatttttttttcttaagtagttttgtcttcttagaacttttaaaactcattgtcattgctcatcacttggtctgaattaaaattcacacgttttatatcattttctattggtaatttttctgtcattttatagtttaaaaagacttatggaagtaataaagcttacaaataaatatgctattaaaatacatcactaagcttagaacttacagtttgagaattttgtccttatgttttaaggaaaaaaaagcacaaatgctgattattgcttacataggctatgtatgaccagctatgccgctggtcagtaccatagccacaagccatgtgctcaggagcacctgaaatgtggctggtctgaatggagatgtgttgtaaatttgaaacaccagattttgaagacttagtatgaagaaaagaattaaaatttctcatttaaaaattgattctatgtttaaatggtaagaatttggctatattgggttaaattaaatatattaaaattaattttattttattttatatggctactagagaatctaaactgacatatgtggctcacattatattatcttgcttgactgcatttatgcagttcttgtttactttctccagtatggaaaataggcatggcggtgaaagacagtgtgtttcggcagggagtttgagtggtattgctgttacaagtggctttgcaattgcttgattaatccattggagtttcatttttagaccccagacccttaagggaaaaattgtttttataatgaagtggcagatgtgtgcttctttaggcaggctttttagtaaactcaaaacctgtatctgacactgtgtatcccaaataataaaaaagtcaaagtcaccgtatgttatcatttctctcttttccaagccttatgtgaattcagttttttagttcctgttttgctttttgttttctggtgtctttattcatggaaatgctagggcagagaagtggtacttatgtcgcccacaaaatatgcatggtggaatggattttccaggggcactgggttattaagagttttcatcctctgtggggtggtaggaacatccagtgattgctgttttatatctttttaaaatttttttaattttttttttgagacggagtctcgctctttttgcccaggcctggagtacagtggctcaatctcggctcactgcaacctccgcctcctgggttcaagcaattctcctgcctcatcctcctgagtagcagcaattacaggcacctgccaccacgcccagctaattttttgtacttttagtagagatggggtttcgccatgttggccaggctggtcttgaactcctgacctcaggtcatccgcccgcctcggcctcccaaagtgctgggattacaggcatgagtcaccctgccaggcactcttttacatctaaattagatttgtttctgtaaatagttgtcaaggcttctctcacttgtatttgagcttttattctgactctgaggtgtggacttttgatagcacacattgtgttaatgttataacatatatttaagagattaaatagtcataaagtgaagatgtgttcttctgaataggctttcatttttgtaggttgttaggaaggtgatggttatagtttctgtaatttacctatgattttctcttcagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggtaaataaaatatctcccattgtgcttttttttttcttctttttttttttgaggtggagtatcgctctgttgcccaggctggagtacagtggcaagatctcggctcactgcaacctctgcctcctgggttcaagcaactctcctgcctcagcctcctgagtagctgggattacaggcgtgcaccaccatgcctggctaagttttgtatttttagtagagacgggggttacaccatgttggccaggctggtctcaaactcctgacctcaggtgatccacctgcctcggcctcccaaagtgctgggattacaggtgtgagccaccatgcccggcccccattgtgcttttaagaaaataagagacattatttattttaactttgtaaatgtattacttgttttaaaaattcattttgtagtaaattatgtaacatttctcagaagtatttaattgcttatatcagcagtcctcaacatttttggcaccagggacctgttttgtggaaagcaatttttccacgctctggggtcaggggaggggtgcgaggggtagatggcttcaggatgaaactgttccacctcagatcatcaggcattagttagattctcataaggaacgcacagcctagatcccttgcatgcgcagttcacaatagggttccagcgcctatgagaatctcacgtggccgctgatctgaccgaaggcggagctcaggtggtaatgctggattaccagaccctcacctcctgctgtgtggctgggttcttaacaggccacggacactcatcagtctgcagcctgggggttggggatcactgacttatattacagtacttaaatagaaagtcctttctttttccctttgtttattactaactatagcatagttatataatgatttaagggcacagactttgtattcagactaccaggaggctgaatcccagctctgccacatgcaaattctgtggccttggacagattatttaattactttaggccttggtttcctcatctgtaaaatgaggctaatagtacctatatcatagaattatggatggtactaaataatgttcagtgctcattaatgttacttcttgctgctattgttaatttcaaagaagtagcattaaaagtagtaaggttggagtcttttagataataaaaagaggaaggtataatcatatgtcttattattgattgaattcttctatatttcttaggtttatctttgcctgtaggaatggattttgtgaaaagcagttgagttcagcatatttatttccacatgccagcttaggtgtcagattcacattactttcaaaatatattcttaatatctttagtgtttgaatcccattaaattagtgatatttgcatggaataattgaagtaggaaaagaatgtgtaaattcctgacattatttttacagatcttcagtatcataggaacctagaagtatttggccaaattaatttaggaatttttaactctcagcttgctacagtactgcccagttggctgagagacatatatatacttaagtgatcacttggatcatttgtagatttataagctcaatattggtggtgttttgcagacttcttcatctgtaagtagagttacccctttgatatgatgtggaattagaataatttatttttatctgtaaatactttgctttctaggtcattactaactctgtcttgttaatgattacagcttatattaaaagttagccttctgaaagccttcttcatatgtaattaaccagaagtgttaataaatactctgcttagagtttgtaataatagaagctcctaattttaggcaataagtaagcatttgcatttggaagacaatttcatttgaatatcagtgactttttttttttccttcctcaggctatgaaaggagaaaagggaattggtggagcagtcacagctacagatggactaagtgaagagcttacagaggaggcatttagtaagcattgttataatacaagtcatgtagattgttagcaatgattcatactaagtatctaatggtatttttggaatgtcagcagtgagtattttgacaaagcactattttaaatagttcttatcagttcatgcccttttatttgaagtcagtgagtgataagtgtagaaaagtttaattctgtagacattataacctttcactgatagttctgactgagttctgtagcccctagtttttggtgaagatttctattgagataggaatattaaggagaagtttgtaatataaaatcttatgatttaaataaatttcaactcagttttttttaaattgagtatcatgttgtcatattggtgaaataaaagggctatgttgagtaaatttctcattatatatatttctcatatgtaaactatatgctgctcagttatatgttgctcctagccaaacctcatggtgtagtgtagtttaatcatgaatcagaaacttcatccagtctgtctacagatttgtacacatgggcagttagctaaggtacatgttagagataggaaaattgaaaaacgcaatataaaataatgtggtttttagggaacattttttaaaatggaaaattggaggatttattattttgtccaagactacatcattgataccgggcagaattgtaatgagacattaatggtacaaccttaagatacaacccaagaaagtagatatagttcatttccctctttaactaattttttttcttttagctaaccagttaccagctggcttaataaccacagacggtcaacaacaaaatgttatggtttacacaacatcatatcaacaggtacagtcctttgtattttaaatgcttaaaaaatttgattgtatcgacagggccccatggctcatgcctgtaatcccagcaccttgggaggccgaggtgggtggatcacctgaggtcaggagttcaagaccagcctggccaacatggtgaaaccctgtctctactaaaaatacaaaaattagctgggcgtcatggcgtgtacctgtaatcccctctgcttggaggctgaggcaggagaatcacttgaaccctggaggtggaggttgcagtgagctgagatcacaccactgcactccagcctgggcaatagagtgagactctgtctcaaaaaaaaaattttttttttattatatctattgatatagttaatttcaacatgctattaaggacctgataaagaaggttattaaaattgtgttttctcaatgtagataacagtatatagtgttctcttaatagttaaaaataagcatatgttcatatttgcataggagatttctagaaagatacacaagaaatgggaattagacttgttattgtctttttattcactgaatttttataatatgcatatggtacttttaatctccttttctttaattctgctcaatttaaattttctaatcttagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaagg

SEQ ID NO: 13220 - DNA, 77586 bp, Human
ataatgttttataacaaaaacatgaggtatatcaaagtccagaaatgagaaccacgtaaatgggtaaacaagtccataaggatgtcctaattttgggatttcattctaaaatattacactagaaagctaattatacagactcatttgaatctgaccaaacaaaacatcttttaactacccttcctcccattctggtatttctttactaatccatagaaagtttttccaggtagtcccccgcaattctaaggatttttagactttatgactcacctcagtaatcactgagatgttctgttttcttcagcacaactgccaaaaaacccagtaattgttaagtcacacaatcattttctagttatgggcgccaccaatatagcagtagggtttaaaacagaggtattgagggtaactattaggatctatccagtgtgactaggtcactcactagaaatgccaacatgcatttcacgtttttatgaatacttttgagcaaaattactgttacgaataaaaaactgattctgctcggctgttttcttactgagaaaatttagtccacgtggattactgacgatatgtcacattttaaaaattactccattctataaaactagtcaattttatactccaattccgctatttaaaaatgtgtgtttcgtttaacagaatataagatgttaacagaaaaagatcaacgtctatcttatcggggacgtccttttgtctaagatgttttcagtccctgcaaaaccactgtttgctttcaaaaagtagcataagcctcgtgcagagtgacagacccttgtctaaggtcacagaagaagcgtctgcgctggcaagtaaattcctcagcatccagaaagccagcgctttctccagtttcctcatagctttatcccgtgaggagcacgcggaaacctctacccatgcaggatgtttctaagaaccacttcttccctgtcttaactaagaaggctcccacagctggtgccaatcaggtggagaacatggcaagtccccgaaatgcacttccaaagacaggaaagattgcagtgggacagaacccagaaaatctctcacattctcgaaaacccgaaagagaacctccaagaaagacgtttgcctctcctccacctctttatctcggcgggagaggaagcctcgcccccattcatcccgccccttctccccaccccgccgcagggagaagtttaccatggctgcctgcggccccttcacttccggtgccggtgccgctagggctgcgccatccccccagtcaatcggacaaccatagcctccaactgacctttctgacagctctgagactcctccggccacgactaggtgctgtcctggaggaaacggtggaggacggccgcacaaaaaccaatctacctgatgaaaactccgttcccttctcgccagaaacataaaatgcgatggagctacggccaccgctgccgagacaaaatggcgccgacaagctggtttagcgcaagcgccttggacagaccctgccccgcccccgtgcaagcccctggctgcaattctgggttccgtttccatgggacactccgccgccaatcctcgtgtcgaactgctcttcctgacccctcaattcaccaatcagtgcccagtcaagcacatccggagtcgtctctaccaatcatttctcaggacttgcttactcaataaccaactctccaataaagttggttttcggaaaaagccaatcataagtggaagatgtcctacctgctgtttttctcaccaatccatgaagtttcacagctacatccaatgaggacggcaggtagcgaggtcctatccgaagctcttcggcgtcatgagcagccaataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttggtaggtggggagaggggaatccggggatactgaatggacgaagtggcagtagcagcagctgctgctgcccgaggtcccggtgcagttggaagctttggaggtggggagagggatgctaggcaagtggcacggcgagcgcaagggaaggggccagccattgaccagcggcagcaactgcaggaaccgccgccgcagttgcagccgcctcctcgtccgcttcctcgggttcccgggaaaatggctgtggggctggccgcgccgctaagtttgcttccgcgcggtgaagagcgggctgcttgggggagccgtcccccaactccgcggcgcgtccacctctgcggagtccgtggcaggactcgaggggctacgagctgatacctctctgggctgtacaaaaagttgaggcgggcgctgggaggaggcagcggctgctgcggtgcggctcccctcccctcccacaccctgtccgggccacctcccctcctcctcccctccgccccccgccccctcccccacgcgggtcccccggggctctggcggctcccggctgaaggccgcggcccctgcccctttgggtgaaggagcgcttctcctttctgacatggtgcagagcgaaggaaggagagcaatggcgccgtgacactccgctgccgccaccgcgggcccggggcgggccgagggggccgagcggcggaggcggggcgcgggccgaagtcggggtatccgggggaccgcggagcggaggctcggcggtcgtctccgcgggggacctggggaagcccgaagggagctctggccttttccggagctatctgtcctggagctccgagttgagcattccgggtcaaagtggccagcgaggcgggggcgcggtgggccgctggcgagctccggggcggaacgggctgccctttggcgctcgtggggttctcgctgccccctcagctcctgcgtcctggctgccctcgtaaggggtcttgtcccttggctggtgaggattctgcccctccccgctggcgtttgtttactttctttcccttggtcgctccccgcagttgactgattatgtctgtgcctgtctttccccctccccatagttctagcgactgcgaagatagctcgctgagctggaaccccacagatcaccaacaaaaatgaaggtaagtggagtcaactctgccccgatcctcgcgccctggacactgccaatcctaaggctagtgccgtggaatgtcatttgttttgctactcaaaattgatgttcctactgatcagcagtttcggcataggaggatgtgttgaatgggtgaaaaatgatctgtgtgtctaaatgcggagtttaggccctctctgtagcagtactttggaaaggctggtgcagcctttcaattgttgtccattcggatagtatttttaaacacttcctgtgttggcagcaacctttgcagaagtaaagcttttgtcctgctttggttctttgggggattttttgtaaattttttttcttcccgtgtgccaatgcgattttctaaaagaaagaatacgtggattaagtaatgaaggtatcatttcttctgtgtgtaaaatgaacttatgtggctaaaatatttgaagttgaagtataataatagttttagttaaatctttccaataagtattttaaaacatatacttatactaaaaagatacatattctactgaggatgactgcaaatatcagtatgtggatggttaaagggaaaggatctcatatagcgttcttgaatgctgtggccattgaatgtttcaggtcagatttttgtttgccaaaagcattcctattcaatttgtattttttgtaaatgcacttactttaaaaggtacccaattcctgtcttatttactgtttcagcatattaagctctgaaatatagcattttcccaaactttctcgtggttttctattttctcgaagtaaatgacatatttaaccttctttaatattacttgggaaaacttattagaaaacaaaaaatcattttctacttcaaaacgtatctccaaagtgtacactgttaactttgcacttaacaatgttaagttgaacttgtatggatacactttaacttccggaaaaaaaaaaaaaaggtaaaatgacagattgagatagcaatcatcctgttactgtaaaaattaaaatgagtggtagagtgacatttcttacatctttctatgtatcattctggtcgtgtccatttgctgaaagtagatgtttcttagtaacgcttatttttttatactaagaagattagtgtggtaaactaggtatacctacaagtctggagccatcagttcatatctgcattcatcggctgaattcagacttaaaacctttcaagtgcagcttttagcaaatgaattttccaaatgatactttccttatgaaaagatgttacctttatgtggctatgtcaataaacaattatgtattgttagtgttaatattagtagcaatatttcttttaatttgaaaaatttcaggaagctataaatgaataacttagttttatgatatgtgtaatatgaaatattttttctgtttttttcttatctttctgcttatataatagaatttttgaaaaattttgtatcgagacaaaacattattaatcactgataattttgaattacaactttaaaacattttatcatatcaggacatcagtctataaaatgaaaggttgctaatcaagtatttagggtatttttcaaattttcaatgatattaataagcaagtcattttaatattcttaatgcttcaaacacaaccttttaatgagacttgaggttggagtagggaggcatagtaatgacattcacagttttatgttcctttcaccaggcggcagatgagcctgcctacctgacagtgggaaccgatgtcagtgccaagtaccgaggtgccttctgtgaggcaaagattaagactgtgaaaaggctggtgaaagttaaggtaatatttgtttttatgcaatagttttattaactctagattgaagaaatttggggagagagagactgcaaatcagcattttattgagtcattatatgaaaaccctttatataccaaacttaaaggaaaagcacatcaaaaataaagaaataaaaaactcaaaaggagaaattattccaaaatgctaccatcaaaataccatgctcatgatatttcctgtcatttggctcttaactatttgtggtagcatacttggactgtaatctattttctcccctcatttaatgttcaggtagagacaattttagtgtttaggacaatacaaatacaacaggaattatgttttcaagacagtgtaaaaaagcatttaaaaagtttattttgtgactgggcgtagtgtctcatgcctgtaatccaagcactttgggaggccgaagtgggcagatcacttgaggccaggagttcaagagcagcctggccaacgtggcgaaaccctgtctctactaaaattgcaaaaattagacccggcgcggtgactcacgcctgtaatcccagcactttgggaggctgaggtgggtggatcacctgaggtcaggagttcgagaccagcctgaccaacatggtgaaatcctgtctctactaaaaatacaaaaattagctgggtgtggtggcaggcacctgtaatcccagctgctcaggaggctgaggcaggagaattgcttgaacccgggaggcggaggttgcagtgagccaagatcatgccgttgcactccagcctgggtaacagagctagactccatctccaaaaaataaaaaaattaacctggcatggtggtgcacacctgtagtcccagctactcgggaggctgaggcaggagaatcgcttgaacccaggaggtggagattgcagtgagccgaaatcacaccactgcactccagcctgggtgacagagggagactaaaaatatatatgtatatttttggctgtgtgaagtggctgacacctgcagtcccagcacttgggaagcctgaatggggggattgcttgagccaaggaattcaagaccagcctgggcaacatagtgagatcttgtctgtccagaaaaaaagataaaaagtattagccaggtgtggtggcaggcacctgtggtcccagctactctggaggcagaggtgggagaattgcttgagcctgggaggtcaaggctgcagtgagctgtgattgtgccactgcactccaggccggatgacagggcaagaccctgtctcaaaaaaaaaatttttttttaagatgcttttactctgaaataacttttttttttggtggttcctgccagtaattttcttatatgaatatatttttaatagtcttcgttactttatacttagatacctcctatgcttattataaacatttttaacattatagaggtatatcatatagttaatgaagtcctccttaaaaaattttatttaagttgatgaataataattttacatattcatgggctacatagtcatgttttgatacatataatgtatggtgattaaatcaagataatttgcatatctatcatctcaaacatttttcatttctttgtgttgggaatattcagtatcctcctcttagccatttgaaacaatgtgatatagcattgttaactacagtcatcctgctgcggtatagaacactgtgaaagtcctccttgatacgactccaaagagatttgatgtggtcttccagattttttttactgtgccagtcataaaattattgtcattggtattggatcatgctgtattgcagtttgctttattcacttatatatctgatgttttcctaccagaattaagcaccataaaaggaggaaacgtctgacttgttctatgcccaacacatagagtagtgcctgatacatagtggaccctcaaaatttgttgaatgaatcagtgaactagagcagtgattcctaaagggtcgctccagaccagcagcatcagccttacttgggaacttgttccaaatgcaaattttccccaccccagatctacttcatcagaaactctgggggtaagatccagtaattgtgttttaataagccctttaaatatttctgatgcatgttaaaagtttaagaatcaggttgggcacggtgggtcattaatcccagcactttgggaagccagagtgggcagataacttgaggctagaagtttgagacccacctggccaaaatgttgaaaccctgtctctagtaaaaatacaaaaaattagccagacatggtggtgcaaacctgtaatcccagctacttgggaggctgaggcacgagaattgcttgagctggggaagcgaaggttgagaccctgcctaaaaaaaaaaaaaagtttgagaaacattgactagaggagtgtgatttgtaggttaaatagatgtatctatgattattataaaatttatgtttcagttttcttgatgaaccttcaagtattaggataggatgtcaattgacattcatttctttttgtttcatacagtgtttttatcatgtcagctatataggatttgattactctatatttatttgggattctttaacaattcaaatttggtattgtggctcttatttacttaaaattaatacaatgattgttttaggaggtcttaccatacattacctagattttgaatttatttggaccatctattatttggaccatagtaaccagccatctgttacggatggttactttatgtctttagatgtgtagtagaagggagcacttgtttgtatcagtgcatattacgattattgcttagcttcactttataaaggatcagagttctggttttaatttgtttacctttcatataggcaatacagtttgatactgttgtttttctttgtgtacttggtggcaatcagaaccttttgtgacttgataaaaagcaataaaggcagtttttttttacagtaatcattaaagattattatatagttcatttagtaaacagttattaagtgctgataatatgcattgacacttgctaactgttggggatatagcaatgaagggaagactcagccctcaaggagctcacagttaataagagaatgtaataagtattacattagcaggggtcaccacatggtgctaagaaagcataaattaaagacattattgttatagtgttactataaatgtatttgttttaaaagtaatatgcaaattattgtgcaaaatgtttttcaggtactcctgaaacaggataataccacacaattggtacaagatgaccaagtaaagggtcctttaagagtatgtatgttgtacggtttaaaatctgaaataatcatagatttataccatatttactgaatttacatttctacatagacttaacattttatgagaacgttaatcagaaaacaatacatatgaagggtttaaatataattagtataaattgtgatattgcaatggctgtattctgttttagatactaaacatcttctagaagggtaatttaatatatataaacatgttaagtttttcacctacctttctgttttgaattcttgaactggatacctggctttgtttttcacattgttgctgtatctgaggtgatgtttagccttctaagttgagtatcataaccatcaatctttggttgttctaatttaccaagtaaactatgttcacttcctaattcaatttaatgaatacctagattatgttttccatgcatttctggccatttgtttatgtaataaatctgttatatcagagtaccactttggttaatatctgatatacaaaggtctggaaactgaaagaaggtcaactggtccatccctatctctccaggtgaacctttatctaaaaggtaccttaaatacaaatgctgaatccaatattcactatttctgtgaaagaaaatggatgctattttggttgtcttataattttacagttcttcgatttaattttcttgaaggcaatgtgatatagtggaaaagctctaaagtaagatttaagagactgggctgtcatgctggactctgcatattattttctctttctgaacggcaattttcagtgtgtaaagtaggggtaataatagctacctaacttttgtcaaagtgttttggagctcaaattgcataataaatagataagtactatgaatgataaagatctcagacagtgtaagatagaattatcataagtatggtgtttatttttcttagctagattatatagttggtgggagtgatttggtttatttgtttaaatttggtaaggaaattgggatttcacattttaggttggagctattgttgaaacaaggacatctgatggatcttttcaggaagctattatcagcaagttgacagatgctagttggtataccgtgggtaagtaattaagtaatttaacacagatttgatttggaggttgcatgtatctgtgttttgtggatacactgaatcattgtgttggtggagaaatatatattatttcctgtcagtttactggatatagctgactaaaattctaagaatgccctgtaggtaacaaaaataattatctcttacagtaagttggccacttttgtctatttcatccaaaaatgtacttctattttaggttactttgatgtttcttttcaagaaagttagatcacatgattgtgatcactttttctataattacaattaaaattgcatagttgcgatcgttactgtattgctacatattttatacaagggtaatgtagatgttgccagacaatttacagatttaaaaaatcctgaccatggtagattcaagaataggtgattgttaacttagtttttgatttttgatacagtgtgggtgctcatattaacagctttcaaggtcgggcatgttggctcatgcctgtaatcctagcattttggaaagctgaggcgggtggatcacttgaggtcagaagttcgagaccagcctggccaacatggtgaaaccccgtctctactgaaaatacacaaattagcctggtattagtggtgcatgcctgtaatcccagctactctggaggctgaggcaggagaatcgcttgaacctgggaggcggaggttgcaatgagcccagatcatgccactgcactccagcctgggcgacagagtgagatttggtctcaaaaagaaaacagcttttaagaaaaatatagatgctcctaatatgaatgcatgaatgcattcttaacattccatgcataagcttatactggctttagataactttattgtattaatagtgagaagcaacaagtgtcataatacttgtaagttaaaaccttaaagtagtacttaaatagttgctgtcattatgttgatgagaatagcattaagtaacatttccaaatctcctctcagtactttcaaactgcacaatcctgtggataacatccaatctatagcattgttggtttttatacttatttcttggtttaagtggtataattattttgtggttttcttgtagaaataaaagaatgaccatttaggtttacttttagtttacttgatttgttgctttgggtaaaaatcattcacatccagttgatgctcagtgttgtgaagaactatgctttggttaaaaatttctctgtcttaccctgtaccttctattagtagtaccaatttgctgtgtgtaagtacttttttcaaacctctttgatgcttcttggacttactagaatttagtgttggttcacagtggtgctattattctgaactacatatttttaggaagcttagttgtggctactgatagttgttaaattttaaaaactaagtggccagatgcagtggctctaacctgtaatcccagcactttaggggggcgaggtgggcggatcacctgaggtcaagagttcgagaccagcctggccaacatggcgaaaccttgtctctactaaaaatacaaaaattagctgggtgtggtggtgggcgtctgtaatcccagctactcagtaggctgaggcaggagaatcgcttgaatctgggaggcggaggttgcagtaagcctagattgtgccattgcactccagcctgggcaacaagagcaaaactgcgtctcaaaacaaataaaaactaagcttaatgttaactcttagagattaagtaaatacatctttgctttatcaaactaagacctgataaaaattacaggtgtgtgtagaatcaccggaaaatatatgatgcatattcagatatttatattgcaccttatattttaactcactataaaggttgtactcacgttacttatgaagctttactgataaaatgcgcatgctctatagaaggattacttttcaggttttctcattttgggtttctttatcccagagtagttattcaattatgaatagcaacctttgtcctctacatgagtagcgttttagtgtttctaaaaactagtcactgctaagcattctctatggtgattttctgtgttggataattacagaagaaattgtataattcttgttctcaaagagctttagaatcttaattgcatataattgaggtatcaagcattagtggacataagaatcacttggtgcttgcttagaaaaatgaggatttgaggaccccaagcctctccaattagtaggcctggggatggcagtacaagaatgttttaataagcatgtcagtgattctgatgcaggtagttcacacttataaaaacagggaaaaacagatttatttgggagaaaaattcaaaatattaaagatttttgcacttacgtgcatgaaggaaattcataaaaagattttgaaaggcactgttccattcagaaaactcaagatagcactgctctaaagaacgtttagatattgaaggaagtggatcacataaagaatgatcagagtataatgacctgagttaccagttggtttaaaaaaaacagtacaatgaaatgtaaaacctcttgggtcatgaacatcctgtatttttctttcagtgagtacctactacctacctattaggtgtaattgctcttttctggaattttttttgatttctagttcctagcaaagtattacatgggtatagtcagaaaattattcagagtgtttatgacgtgtgttaccttttttggtttcatgagataccagaaattatgtcagattattaaaaataaaacaagaggataccacattgctggtttggatcaaataggagttatgatcattagtgatctaaagttatcattagagtcagtgatattaacttcttcttgcataatacaggtatcaatttcccttctgttaaacatgattaaccaattttgaaagagattatggatatagtatgactcagtttttaaaaaatctggtaatatcttaccctctaatggtttatttcttgtttgtttgttcgttttagagacaggatcttgctctgttgcccaggcttttgttcagtagcactattgtagcttcctgcagccctgaattcctgggctcaagcagtcttaccgccttagcctcccaaagtgttgggattacaggcatgagccactgctctcagcttcccctttaatgttgaatagtaaacagcaccaactcaaggggatttttttgtttctgttttttgagcaatagaaatatttcctcttcctaccattcctaccatagtttactcattgatagttgttatccttgccattaaagataaggaatctgtaatatgtggaagtgtgttatctgttcagtcattcaaaaggtgttaaaattgggattagaattcatacctctatccagcccaaatctctagttatgttttttaaaaaaggaattaatatgtccagttaaatgttaccactaactcctggtaaatacaactgtcagtaagacattttgaaggtactctctgttttgcctttttgtaatataaaaacatatacttgaaaagtaaggaaaagttaaaggatagaaatttcagtaattctagtaattaactttgaaaatgtacacacacagatcatttatcaagtttagcactaaaatctatcatctgtattaatgtttttgtaacaagaagtgcttaagattcagattattttgtaccttgtagttactgttttgaacatcggttatatcagattttgtgtaagttctagttaatattgagtagaggaggtttagattcaactggtgaattaattaaattttgtagaatgtcctgcaggtttataaggtttttaatgtagtcagactcgcttatgacaaatgttataatcaaaatcaaccacaaaatgttttcaaacccaggtggctcttctactgactagaagataattcattaagaaataaagtagtaaacaaaaaaaagtgtttaatcctatcataggctttaactcattttttaaatggccttccctaagacttagtattcccatgatattttcttaatgtaattatgtatttgagtgttaatttcttaaattttcagattcctggagtttttttttgtttttttttgtttttttgtttttaccttagctgctgagggacttctatagttatcacagttgattctatgaataacagaactattgaagctaaagcaatcttgatcaagaagaacaaaactggagacataccacctgatttcaaaatatactacaaagctatagtaatcaaaatatcatgatactggcacaaaaatagacacatagatcagtggaacagaatagataccccagaaataaatccacctatttatggtcatttgatctttgactagggtgccaggagcacatactggggaaaggacagtctcttcgtaaatggtgttgggaaaactggatatctacatgcagaagaatggaagtagaccctcatctcactcgatatacaaaaactaactggatcaaagtggatcaaagacttaagacttgaaattgtcaaaccactagaagaaaacataggggaagaggctttatgacactggcccgggcattgatttttttttttttttttaatgaccccagaagcacaggcagaaaagcaaaactagacacctgggattacatcaaactaaatagcttccacacagcaaaagaaacaatccagagagtgaaaagacaaccttcataattggaaaaaatatttgcaaactctgtatttaatacggggttcatatccagaatttataaggaacttaaacaactcgatagcaagaaaacaacccaatttttaaaatgggcaaaaggctgggcacggtggctcacgcctgtaatcccagcactttgggaggccgagacaggtggttcacttgaggtcagaagttcgagaccagcctggccaacatggtgaaaccccatctctactaaaaatacaaaaattagctgggtgtggtggtacatgcctgtaatcccagctacttgggaggctgaggcaggagaaatgcttgaaccctggaggcggaggctgcagtgagccaagatcatgccactgcactccagcctgggcgacagagcaagactccaatctaaaaaaaaataaatgaaaataataggcaaaggacctgaatagaaatttctcaaaagcagacgtacaaatggcccacaggtatgtaaagaactgttcaacatcagtaatcatcagggaaatgcaaattcaaactacaaagagattttacctcacacctgctagaatggctattatcaagaagataaaaggttacaagcactggcaaggatatggagaaaagggaatccttgcccgccattggtgggaaagtaaattagtatagccatcatggaaaatagcatagaagttcctcaaaaaattaaaaatagaactaccatatgatccagcaatcccactcctgggtatataaccaaagaattaaactagtatgtcagagatgtatctgtattcccatgtttattgcagcactattcacaatagccaagatatgggataaatttaagtctctatgagcagatgaatgtataaagaaaatgtgatatatatacataatggaatactattcaacttttaaaaagaaggaaatcctgacatttcttacaacatggttgaatccaggggacattatgccaagtgaaataagccaggcacaggaagacaaataccatatgatctcacttaaaaagtcaaactcttattagagagtagagtgttggttatcaggggtgggggcagcttggttggggtgggcggggggtgagggattaggtaaatgtcggttaaatgatacaaaatttcagttagaaggaataagttcaagagctccattgtacaacatgatggttttagccaataacaatgtattgcatacttgaaaattgctaagagagtagattttgagtgttctcaccacacacaaaaaaataagcctgtgaagtgatccacatgttaattagcttgcttagccattccacaatgtatacatatttcaaaacatgttgtataagataaatacatactattaatgttaaatttttttttttttttttgagatggagtctcgctttgttgcccaggctggagagcagtggcgcgatcttggctcactgtaagctccacctcccaggttcaaatgattctcctgcctcagtttcccaagtagctgggattacaggcatataccatcaccctggctaatttttatatttttagtagagacggggtttcgccatgttagccaggccagtctcgaactcctgagctcaagtgatccacctgcctctgccttccaaagtgctgggattacaggcatgagcctccgtgcccggtgaaataaataatttttttttaaaaaaactactggccttacctagggcatccgtatgttttaaattttaaaatgtttgcttcattatgtgaagaattctataattttgttaatcataactgctgtacatggatataacaataatgatacttaattttccaaagtcagaattcatgacttctttcttagacttcattttatacttctgtttcatgcctattatgtcttttgatatccccttaactaaattgtagctcatcagttaactttctgattctgtttctttacctataaaaggaggataatggttcctactttgtagaggctgttgtgaggattaggacatggtagaagcttaataagtgatagccaattatatttatagacagataaaattaatttactgttattattttactatctttcagtatcagtgctgtgataacagggaaatgggtctttgtatttagtagttgatcagatccttttatttgaattctagctgattagggttaggatttgtgtgtttgtttgcattggcattactttgtctaatgtgtttagtatggttggtgttactgtgaaagtctcagctttgtcattttcctcttaatagattttaatattttaatccctattaggattctctagagagaaccaataagatatagatagatgatagatagacagattgatacaagaggggatttctgagagcagtggtccccagcctttttagcaccagggaccggtttcgtgagagacaatttttccatggatggaagtgctgggggatggtttcgggatgaaactcttcctctttagatcatcaggcattagcatctcataaggaatgcacaacctattggtagatccctcgcttgtgcagttcacaggcatttgcgctcctatgagaatctaatgccactgctgatctgataggaggtggagctcaggtggtaatgcttgcttgcccaccgctaacctgctgtccggtccggttaccaacaggccatggactggtacaggtttgtgacctgggggttgcagaccccagtattagagaaatttgctcatcatactatgaggactgagaatgaccatgacaggttctctgtaagctggagacctgagatgccaatagctaggctctatccaagtcagaaagccttagaaccagggaagctgaggatataattcttagtcccaggccaaagccttgagaagatctgagggactgctggtataaggtgcagagtcccatagccaaagagcctggagttctgatgtccaagggcagaaggagaagagtgtcccagctccaggagagagaggaaatccctttctctcattttttgttctgtctgggcctccggccaattggatggtacttgcccacagtgagagtgaatcttccccacctggttcactggcacatgtgccagtttcctctggcacacccagaagtaattgctttaccacttctctaggtattccttaattcagtcaagttcacatctaaaattaactgtcaaaatacctaacatagtaacagagataccacttttggttatatgtatgttctgctagactcaatgaacaatctattcaaaagccatttttggaaaatataagacatttcatagaattattaaatccttgtagtctgactttttttcctcttagcatgctatagaagactgaactaaaaagaagctagacttgctatatacaacattaattatttcactcttacaaaaattatactcttcagtgcctacaaatgttatgttcttttagatgagagctctaagatggaagttaagagaggaactttcttttagatggagcttcttcatggttttgatcatcagggatgtcatgattgataagttcataatgttgttggttttataaaaaacatagaaatatagaatcagggtctcactttgttgcccaggctggactgcagtggcaattatagctccctgcatccctgaactcttgggatcatgtgatcctcctacctcagccattcaagtagttaggactacaagcacctgccaccatacccagctaatttttaattttttttttgtaaagacggggtctcgctgtgttagccaggctggtctccaactcctggactcaagggattctcctgccttggcttcccaaagcaccaggattacaggtgtgagccatcacacccctgccccccattgttgggttttctatttctctttcagaaaatcttgcaaaattacaaatttataaagtacccaacatacatttgtataattttgtgaattaaaaaaatcttagtctgggttcagtggctcacacctgtaatcccagcactttggaaggccaaggtgggtggaacacttgaggccaggagtttgagaccaacctggtcaacatggtgaaaccccgtctctactaaaaatacagaagttagccgggcctggtgacgtgcacctgtaatcccagctacttgggaggctgaggcacgagaatcacttgaatctgggaggccgaggttgcagtgagccaagatcatgccactacactccagcctgggtgacagaatgagactctgtctctaaataaataaataaatcttaaattatttctttttgttcacttaaggttgggagggttcctatataaaactgtaaaatagttgtttgtatcataatccccttttgagcaatctctttttttaaaaaaaaatttctatccatgataaggtatatttaagtgaaatgaatttttccttccaaaaatctgattttatttcaaagtgattattgaaatttttgaattgttgaaattcaaaaattgctgaaatattttgtttaaaatgttgaaattgttgaaatttttcatcagaacattttggtttagggctgccattgattaatgataaaacattatagaaaatattttgttatataaattttggagtgttggtcttacattcacattttcctttttcatacctccatttaaatgtgtgtgtgtgtctagtatcgtcatctttggtattgtaggcattaagaaaagttgaaaacctttcaggttttattctttttgaaatcttatacttacagatactaatactaacaagaattatattgtttggtttgtgataatttaatgatttaaaaactttaagagaacagtggttaattttttagacttgacactatatgaatcatagtttttatatcaaatatttagcaccctattactcaagtgcagatcagtgatgtaatcattggaggatgttgtgttttaacctgtcattgtgcctgcagctagtcattaatttctggatcattgactgtgtatagcacagctgcttttttagaatcatggttctttgagtatgtgcttcgggagtttttaattttttccacattgtctcctgcatgtaaaagaatctaagctaggtatctgtagtctaagagggagaactgattgaagtaaataaatatttaacatgttgaaagcttttatataattttctttcaaaaaacttattcattaaaggtaagcgtaggatttgaaggcaaagtgtttgctaataaaacaaccttttcagaaaataattcaggattataatttcataggtaaccaattaaaaaattctaagatatcaaatgaatgtaatgtagaatttctttttgttaacactgacttattctgttagaatggaaaaaagtatctagaattgtgaaaattagtactaaatcttgataattgtttttgggtacatatgtatgctttcttgttaagtgaatatggatgttaagtgtctgaagtaaagattatatcttattttattcataacctggggcaatgaggtaccttctgagagcattttctttttaataaactataaatgttggatgctaaaatcagaatacagtctcaaaagttaaacctatacaattatcaaaataatatattgttagtgattaggagaatattagggataaattgtaaaattccttaccccatttccttgaaatgtttaaatatagtcaagtagtacgattttgtttgtttgttttttttagacgaagttttgctcttgttgtccaggctggagtgcagtggtgcaatctcggctcactgcaagctccgcctcctgggttcacgccattctcccgcctcagcctcccgagtagctgggactacaggcgcccgccaccacgtctggctaattttttttgtatttttagtagagacggggtttcaccgtgttagccaggatggtctcgatttcctgacctgacctcgtgatccgcccacctcgcctcccaaagtgctgggattacagacgtgagccaccgcgcctggcctaaagtttctttttaaaaaaacctttatatttgtcttttttttttttttttttttttttgagacagaatcttggttttgctgtcacccagtggcacaatcatggctcactaaccatggttgagccttggtttttcgcggctcaagcaatcgttccaccatggcctctccagtagctgggaccacaggcatgagccaccacgcctgccctacaaacttttatctttctgtttccttatttcaacctttatttctaaacttctcagctgggtacagtggttgatgcctgtaatccgagcactttcggaggcttaggcgggaggataatttgaggccaggagtttgagaccaacctgggtaaaatagcaaaatcctgtctttattaaaaaaaaaaaaagtttttttaaacagactacttacatccttttctaacaaaagaaagaacttgtatcttatgactttagaatttggcagccggtacatgtgtagtaggttatcatgcaaataaatagaagcagtagaataattcaatagcaataccaggagtcagtttctggaagttaggggtactctaatattaaacttttgtggaaaaatccataatactttttttaatcaggtttttgttcattcttctaggattgcagttaatttaatatttatgctttgactaggttgctaatgagttaagaaggtggttctgtagtgatagaaatcaaaaaagcagatggaaatacttaagcagtcgtgggcagccatttaacctgtgtttttggtatctgtagaatgaaaaatatggcatggtatgctcattgtaaaggttttgaaaaatgactaaaataatggttcttacaaatattaagctctaattaatagcaataatagcattctgtgcttttaagtttttatttcattagtgtgcataaattctctgttatcttttgcttattatagtgtttgatgatggtgatgagcgaacattgagacgtacctcactttgtctgaaaggagagagacattttgcagagagtgaggtagggtgacacggatggacgatttggattgaactacaggtactgatctagaggtaaaacgtaatttaattaatctatttcttatacagacacttgaccagcttccattaacaaatccagagcattttggaactccagtaattgcaaagaagacgaacagaggaaggagatcttctcttcctgtgtgagttttttcatatatggtatcattttaattacaattattataaccttaaacaagggattttgttaggatggctaaattcatttgggtaagctttccatagcatattgtatccttatgttagacattttaccctgagtggaccttgttcttaattattcccaatatttgcccaggaatgataacaactcttacttctaatagattatttttgttttaagttactttgccgaagttttttttgttttgttttgtttttgattttgttttttgagacggagtctcgctctgttgcccaggctggagtgcagtggtgcaatctcggctcactgcaacctccgcctcctgggttcaagcaattctcctgcttcagcctcctgagaagctgggactacaggcatgtgccaccacacccagctaattttttttttttttgtatttttagtagagatggggtttcaccatattggccaggctggtctcgaactcctgacctcgtgatccacctgcttcagtctcccaaagtgctaggattacaggcgtgagccaccacacccagcctgagccactgcgccaggcccaaagtttttaattgatatgatgatttttctattttaagtgagtatatgttttttatcttttacttcaaaaacatttcaaacttaaagattgcaagaataatacacgaatatctgtgtatgaatgtctatatactctttttttttttttttttttttttttttttttttttttttggtgagatggagtttgtctgtgccaccaaggctggagtgcagtggcatgatcttggctcactgcaacttttgcctcccaggttcggtgattctcctgcctcagcctcctgagtagttgggattacagacacaccatcacgcctggctagtttttgtattcttaatagagatgaggtttcgctttgttggccaaatgggtttcgaactcctgacgtcaagtgatttgcccgccttggcctctcaaagtgctgactgggattatagatatgagccactgcacctggcctaatgtctatatactctttatctagatttaccagttcttaacatttttcacacatttgctttacgattccctctctatatatatactaatttttttcttttcttttttttttttttttttgagacggagtatcactctgtcgccaggctggagtgcagtggtgcaatctcagcttattgcagcctctgcctcccaggttcaaacgattctcctgcctcagcctcccgagtagtcagaactacaggcgcgtgccaccacgcccagctaatttttctatttttagtagagacagggtttcaccatgttggccaggatgatctcgatctcttgacctcatgatccacctgcctcagcctcccaaagtgttgggattacaggcgtgagccaccacacccggcctatactaattatttttatattttgtaataattttatttttctgaactatttgagaggaagtggcaagcatcatgatcctttatcattaaatatttaggaacaaggagatgttcttacataaccaaagtatgaataccaaatttagaaaatttaacgctgatagactactatcataatatatggttaatatttcaaactttgtcagttgttccaataatagcctttatagcgtcccccagttcccctgattacaggatccaattcaggatcatgcattgcatatagtttatatggttcttgagtctcctttaatctaaaaaaattctgtagccttttttcttccatgacattgactttttttttttttttttttttcccctgagacggagtctcgctctgtcacccaggctggagtgcagtggctggatctcggctcactgcaagctccacctcctgggttcttgccattctcctgcctcagcctcccgagtagctgggactacagtcgtccaccacgacgcctggctaattttttgtatttttagtagagacgggatttcactgtgttagccaggatggtctcgatctcctgacctcgtgatctgcccgcctcggcctcccaaagtgttgggattacaggcatgagccaccacgcccagccgatgacattgacgtttttgaagaatacaagacaatagtcttgtaacctgttccctaatatgttggattgttttctcattgttagattcaggttatatattatactccataagtgatgttgtgtcctgaaggaaagcacagcaagaagtattatcagtttgtcccatatctggtgatactaactttgattaaggtggtgcctgccaaatttctaaacttcagaattactatagttaccgtttttcccctttgtaaaatctgtgtggagatactttgagactatttaaatattctagtctctgtcaaactttgattcacaaattttatcatgtactaataattcttgcctgaatcagttagtactattatgatagcaaaatgctgatttttctaatttttcattcttgctacattttttggttatcgcttagctataatgaaattcttttcctaacgctatggattctaattttacttaatgggttacaattcaggttgttccagatttagccaagggagcctgggagcctttccaggatggcttctgtgttcttttgatatggcctcaccatttcttgagcactttttcaccttctggcatgacaaggtatcctaggctcatgttaattttttcctgcgccaaccctggaattggccatttctacaagggtccctcatttattttagtgggaattaatatttagaaaccaagatcctggtattagatatgtactcactgctgctggggagtatataatgagtatttttaaaggcaaagtcagataacacctaagctgcaaaccagaaaataataaaagacctccgaggaccctaaatggaaatcccaactcagccatatactagatatatcactttgggaaaattacttaacctctttaaagttaactacatttatgtacattaaatcttcacaaaaacctgcaagatattattattctcaatttatagctgaggaaaatgggaacagtaatgtcttgctggtttttgtattagataatgtatagaattttcttttttgttgttgttgttgttttttttggttttttgtttgtttgtttttttgagatggagtctcactctgtcacccagactgtagtgtagtggtgcgatcttggctcactgcaacctctgcctcccaggttcaagtgattctcgtgcctcagcctctcgagtagccaggactacaggtgtgtgataccacacctggctaatttttgtgttttagtagagatggggttttgtcatacttgccaggctggtctccaactcctgacctcaagggatccacccgcctcggcctcccaaagtgctcagattacaggtgtgaaccactgcacccagccgataatgtatataaatttattagtgtgtaataagtactcaggacatgatatatatttaataattcaatacccagtattttatttctaagctaactccatagacttctactgaaaactccttcatacttattttataattttaacaagttgagttatctggtttctcagagtgcagcagattggaagatgtgtcaaaaggaaatacaggaaagatcagtagatgcagtcaataaagaaaactgtggagtctcacagctgagaagtctatgacaagaaaaaaaggactaaaaccataaaaatataatgaaccaagtggttttgagccatttaataagagttaatagctctgcatactttaataaactccaacattatcaatatattgcaggatgtcttaaaaatgtaggcttggctgggcacgttgcctcacacctgtaatcccagcactttggtaggctgaggcgggcagatcacttaaggtcaggagttcaagaccagcctggccaacatggtgaaaacctgtctctactaaaaatacaaaaattagctaggtgtggtggcatgcgcctgtaatcccagctactcaggaggctgaggcaggagaatctcttgaaccccaggaggcagaggttgcagttagctgagatagcaccactgaactccagcctgggtgacaaagcgagactccatttccaaaaaaaaaaccttcatatatatatatatatatatatatatgcttaaaatttgttgaaacttaagggtaaactttagttacccagataagttaccttaagtaaaccttatgggtgttttaatgagatattttcatagccagttagaaaattaaagttatatgttatattatctggcataaaaatagaagggcaatcttaaaaaaaaaaagtatttggcacaataagtatttaatggtggtgtaattaggtttttctgtcccagctggtggtggcatgagagcctaagtctaagcactcattgatctggcgaagtggactcagagttaccatagacaactcaggactacatacctctgtgaggctaaggaaggacccatgtcttcagttacaataagaatggagaggctactactttagggtgtagtccattagaaattgaattgactatattaaattcacaatactctgtatcaaataattgtttgtgttaggataatgatcaagttattctaacttttagtactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaagtaaagtttctttgcagagttaatcagccgtctaaatatttgttttaaatggatttttttaaaagcatttaaaatattttgaaagtattaaacaaatttggactttattggagattttttaattgaataatcatagtcaggtccataatacttcactgtcttctttggttattctttctttaattctctgtaggcttttattgagctcttttatatttcttccctcataatatgtccaatggctttttactctattcccattaccttaggttcccttttttttttttttttttttttttttgagatggagtctcgctctgtcgcccaggttggagtgcagtggcgcgatctcggctcactgcaagctctgccttccgggttcacgccattctcctgcctcagcctccggagtagctgggacaacaggcgcctgccaccacgcctggctaattttttgtatttttagtagagacagggtttcaccatgttagccaggatggtctcgatctcctgacctcatggtccgcccacctcggcctccaaagttctgagattataggcgtgagccaccgcgcctggccttaacttgattcttgaattctttctttactgttaattcagattaattttccagtactaacttttatagagaaatcgttttttcttgctgttgtgacagggtctcactctgtttcccaggctggagtgcagtgacgtgagcacagctcactgcagcttcagccttttgggctcaggcgttcctcctgtttcagcctcccaagcagctacaagtacaggagtgtgcctccacacctggctatttttttattttttattttttgtagacatgtagcctcatgatgtttccaggccagtctcaaactcctgggctcaagcaatcttctcactttggcctcccaaggggccgggattacaggtatgagctggtatgcctggctgagaagtctttttaaaatatcatttagtcatgatagtcccattctcagaaatagacaaccttcagcgagtctgcctaattgatcagttttgcattttttaaatggatatttgaggccatccctggctctcaatttatttcctatttttaatgtaaactctactcaagttctttaactgccctgtatttaagatacatcactcctctaagcatttatccctgccttaaattaattagtatttactgaggatctgcagtgagttcagctttgttctaagctccttagaagataaacaaatacgaggctttaatgtattgccctcaagaagcttactgtagacatgtaagagattacatagttattaaagattgtatagtaaattaaaaaaaacaatttggtactgaatggagtaagaaaggaggggttcacctaaaatttaaggaagattttagaaatgacaagttttggatgggttggtagagaaagctaatttttgcttacacagagaaggaataagaagaagcgatacacaagagaattatttcagagaggaataaaaaatgattggaaattaatgccttttttcttctcttcctactcctttacttcctcctccacttcttcatcccctcttaaatatctcttaaagttcagctcaagtcctacattctttgcaaggtttctcttaaatactcttgttttgttttgttttgttttgtttttgagagaggatctttgttgcccagactggagtgcagtggtgtgatcacggctcactgcagccttaacctccctgggcttaggtgatcctcccacctcagcctcctgagtagcttgggaccacaggtgtacatcaccacacctggctaatttttgtatttttgtgtggagatgtggttttgccatgttctccaggctggtctcaaactcctgggctcagacaatggccttggccttccgaggtgctggaatcacaggtgtgagccactgcgcctggccctaaatattcttaacataagtatgcccctttgatttttggtatcacttatctctaataataattgtggcacaaaatgtatcccaaattagactataatcctgtaaagagctgaaagtatatttttaggtttctatgtgcatgtaaatatattactcagttcctagataatagatttaatttgtatggggaaattctgaaagtcccttgaacctttcagttgtatagaaaaataagtaatttggattcagaatattcagattgtaggtttgccaagagtttttttttttaataacaaattcttttatttactcagatttatcatttaccaggggatattgaaaataaaaaataagtaagacactattcttacatttgacgattttatgtataatgtacagaataattcaagtaacagtaatataaaatagtatatgttcaatattaggactccctggcctgagagattacatttatttgaggaaaatacagaaagccttcacaaagcaggtgcttttgaggtgagctttgaaggatttaaagatagtaggcaaagcttcactagaggaaacaaaaaaataggttaaaaaaatagcatgcctgtaatcccagcactttgggaggctgaggtgggcagatcacgaggtcaggagatcgagaccatcctggctaacatggtgaaaccctgtcgctactaaaaacacaaaaaattagccaggcgtggtggtaggcacctgtagtcccagctacttgggaggctgaggcaggagaatggcatgaacccggaaggcggaacttgcggtgagctgagatcgcgccactgcactccagcctgggcaacaaagcaagactctgtctcagaaaaaaaagtaggaatgggtttgttcatggaactgtttgctctgggaatccattttggctaaatattagatgcgagtgggggaataataggaaatatagctgtgaacataatttgaatctagggcagaagggtctttaaaagttcatctaaagaatttggacataattctgcagagaattttccaaaagagtgttgttatttgagctacatgtttaggaacgtgaatgaagaatggcgtgttactagaaagactggaggtggcaggaatctatttgaaggccattaaatagttcataggtaaggtaattagaccttgggttatgcctactcatcctttaaaatttaccttaagcttttcctgccacaccttttccttgcccaggttaggtgaaatcttcctccttgatgttttcatactattatgtgcctagtggtatcactgtacttatcctccattgtgttctttttgtgtatctttttatgtttgcccctccagtatactgttagctccttgagggttggcacagctatattattagtctaataattactggcaccaagcaaacaaacaaatacttccatctggtgttaagacagctgatgtgactgccaagaatattcaattatctggatatacactattcagtatgataaccatgaaccatatgtggccatttaagtttaaatgtaacttaattaaaataaaatagaattaaaaattcagtctctcagttgcaccagccacatttcaagtgtttagcaccatgtgactcactgctactgtatagggcagtgcagatatagaacgtttccatcagtgcacaaaggtctgtgaatggtgctggaatgtagcagagagaggctagtgttagggagagcatgaacagatatatttaatcagcttttaaaaaatataaagttctataaaggatacagagagtatttaccaattatattgttaagatactattttcagaagttaagaaattaaaaagttctttgttcatgttttaacttgttttaattactaaggattgtacatatcttggttaaaaaaggtaacatagattttttttttttaatgaccagatttcaaaaaagatccttattcaagtatatttttaaaaattatatgccaaattttcatcacagattatacattttattttttggacaataatttagcttagaataaatcctcatatttttaaagtgctggtcacatttgaatttatatttcttttctttttgaaatggggtctcattctgtcacccaggctggagtgcagtgttgtgaatttggctcaccgcagcctccacctcctgggctcaagtgatcttaccatcccaaccttttgtgtagctgggactataggcacacaccaccacaccaggctaatttttggtatttttggtagagacagggtcccactatgccacccaggctggtcttgaactcctgagctcaagccatttgtccaccttgacctcccaaaatgctgggattacatgcatgagtcactaggcctggccctgttatttcattaattattcactttataatctaatgactatggataaattaaatttctaggcaaccaatgtgcagacaaaacatataagggtatatttttttgtatgcaattcattaataataggagctatttataatgaagctgttttttgtaaaatataatctatttgagaagttaggggatccagaattgttcttttgaaaaatactgtttttctgagcacaggaaataggaatcaatctgttcttattttatatttcaggtaatatctcccagctgtaatgatgacatcacagtgaaaaaggatcagtgtttagttcgatcatttattgattctaaattgtgagtaatgaatcctttaatgatgttacgtgggaggaaaaaaaaaatagaattacaatgatagacacctcccccaccaaaactttatttttaaaagtctaatcattcatgaactgagaagttgttacctaataggttttgactttttgtaatgtagggtatttttcactaataaattttatataaaaaatgtgaacattatgtgagaacaatattaagaacagttttttttttagcaaaagatggtattgattttttccttaattgtaaaattctatatttttatcatgtactagtagtatgtgacatttattattaactccgaagcttattttttaatctctattacaagagcaattattttgacttttttcatgattacaatccagacttttgggccgggcgcagttgctgacgcctgtaatcccagcactttgggaggctgaggtgggcagatcatgagctcaggagatcgagaccattctggccaacatggtgaaaccctctctctactaaaatataaaaaattagccgggtgtggtggtgcatgcctgtagtcctagcttctcgggaggctgaggcaaaggaattgcttgaacccgggaggcagaggctgcagtgagccgagatcgcgccactgcactccagcctgacgacagagtgagactctgtctcaaaaaaaaaaaaatccagacttacagaaactttttcctaacctcatctctgctttgtgatcaaaacagtgaaattaaaaaagttttttgagttatagttctctgtgaaaaatttaatgccataatatattttatagtgataaaaatatttcaatattactgtctagtaaatgtgcttttttactaaaatgaaaaataaatttcacaaataataaaatagacattgttgtctacaagtgttgaaaacatcatgctgatatgaattaccccgtactatctgtaggaggattgtatagattgaaatattgtgaatgtgaggctctcaatgtactttgagtatatacaacttcagaattaagataactaactttgcccgtatttcctcttcttaccttttgttaaggactaagataaaaacattttatagacaatattttgattttgaggtttttatttttctatgtgttaacatgaactatttaagtgataatttttattgaataaattgttttcctccccttcttcttgataattagttactctatagcaagaaaggacattaaggaagtagacattctcaatctaccggaatctgagctctccactaaaccaggtaaaataaagatgaattaccctattattttatgttgtggctctatttggaaaatagcaaataaagcaagactgatactctctggtaccaccattttaactgtttagagttgatatccactcttacttgatttttttttaatgtctagatacaatatttgatttgtgattagataagtttaacttttcgtattttaccattgtctcacagtattccgtaaagtaataacaaatgtttatataacattataacttatgaaatatgttaaagcttactgtatcattttataaatgacagccgaatttgaattcagatctttgattctgaatgccatgccttttctattgttctatgctgccaattccatagcaactgctgaagtacattttcactcttagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtggtaggtgtaatttcatgtttgtaacaaaaacatcttaatactctctagtgaaaataataccttcatatatttttccctctgtttagattctctattatttgtttctgtccgtttctagcattgcttaatttgggtgttgaggaagcattttggctcatagcatagtgtgtaaatcagaactaattcttagtaagagattacaagaaaatacttttcaggttagttaatcaacaagtgcaaactggtttttttggggtcttttccaaaacaacccaggagggaaaaaaatgtaatttttaggtattttatatgtgtaactcatttaaactactaccatatgaagtaactgttgttatcctactttaaaggtaaggaaagggagattcagaaaagttaagtaactttcccaagctggcacaactaaaatgggtagaagagggatttgtactcaggtctggcctgtctcaactttaaaacctctttcagacatttcacaatatttcaaggataattaaggttaaaaaaaatcctatccaaaccccaaagaaaatttcatttggcaatttgataaatcatagaaaatatttagattatatgttctaagtgctaatggttttctttataatattgccatgtcatttataatatgcatataattgtaggaaatcatccatggagtacttcatgattgcttatatgaatactgttgtttattctgcagtgttgtatcaaatgggataaactgtctagtacatttttggttgttacggggtaaaagggtttaggggcaagacaaagacaatgaatttactgaaaagggggacctatttgagcatgaaaaatattggcctggaaaaatgtgggattcttgtttctgttttaaatacacaaatatgaatttatgaaatgaaacgagtatagtcatatgtaatgaagggcatacgctatttctttccttttacttcccctgcagtatttggtttttttacactctgaaatcagaatggcggttcatacttacaggctgcctacagagttgccatagtaacgtgctgttggttttaagtgagcatgctcggaaagacaggaaggtttagcagaggcttggcagtttgccaatggaggtttgccagatgctttgaaatgggctgtctttcttttcctttcatgtaatgtctgatttttatgtggaagagaatgtaagtagtgctgtataaccctgcggatgctatgccctaagagggaaagcaaatatttgcaagtcagactgaaaaatgtccagaccctgtactgattaagtagaaggggaatctaaccactttgcatttgaaagaaaatgcagcatataggtaagatttttttgtgtgtttagttaccattttgattgccaaaaacgggattaaataagaattttaggtattgatgatgtagctgatagggaaggactcagaaccaagcgatattctttcttgtaaaaaagacagtaggagtctatttttagaatatcaatggatgaaggctatttttctgaaacaagatagattctgaaatgaaaatgataatgagacagtttggcaaaattcaggatttaaagtcagaatattaaatgtgatttttgtattttatctgtatttatttatagattatatgttttcaggctaattaggccacattttcagggtgtgaactgttgcaaatctgtgatttagcttttgttttttaaattaaccttagttaggatcttatattgtccaatattgaagaaagattagtccctttatttttgctaatacttttaattgctgtccgttccagaatgcattttccctaccccccccccccaaaaaaccctgaaattttaaacaaagagggtaaaaagagctttgtaggaagtggcagagggagattataaaatagtaaattgtaagtagtgctcttattacaatgattaatttcataaatattgtaatgttttattcaagctgtgagtatacgttagtataaaagaatgaagagcagaggcaaagctctgttacctattgtttgcaggtaatagtaaataaatttttaaagataaggaagcttacaaggatagtatcttaaaatgtgtcacctaaattatgagcctgttaaaattaagtgaatcaggatgcttttcatctactggaaaataacagcaaaattacagaatttaggcactgattcatatgattatttatttttcggatggtcagtttcatagcatatgttttattgaattattaaactaattctttttctctggccatacaggaagattttcttgagtgaaattttgttgctttagaaaaaaatcagctgcatttcttgctcttgggtttaagatttagttgctgaatcattgtaacttctcttgaacagttattttttaaaagtgtaatatactgataaactgaaaagcactttatatacaacaaagaggaggggaatgactatggtgtaaaatgaataaaaatctgataagccatggcctacctggcttagtcattatgggcctttatcaccatgtaggtgaggctacgctgttttattacattacagatcagagtcttcccaaaatgtaacgatgctatgcttttcgtgaagattcaatgttgcattacaataatcaaaaagatcttttgtaaggttctctaaaccactataacaatactctagtctgttatttgttgtttttagtatagcaagcaaattttatgcagtagaatcatacaagtgttagatacttctgcagtgttaatgggcagtgaacattgtttttatatttgatgctttgggtatcttaactagccttaataaggagatttgagattctgtgactttacatgaaagagcaccttttccacttaatattaatttgaattcctaagtattggtagttcaggatttgagtacaagatatagatctcatgctgttactgtgtgggaaaagattgaggatctgacagaaagtaggttttatctatattgattactttaaacttgaactcaataattatattgaaaaaatccctgggggatatttttatgggtattacttaaatgtttttgttaagaaaattttgtattagaaaagatattactggatttttcacctttgaaattgatcaaaaagtccatgtaaacataagtaatcatatcaattattcatttattcctgatttatatttactttggataaatataggagagttttctaagggtaaaataaatggatggttgtttagaaaacttgagtattaaggggaatgtgaccagtgttagcttttaaaatcattttggcttataataagtaggcttataggttgggcccttttaaaaatttcctatttagtaatgaaaatttgaattcagtgaatttttaaataactactgccatttctgtaatactgggaattgtttagggaccactgatacattaatgcctaagattatattccagtattgtaaaaaatcataagtacttgagtttgtttactcatggaaacatgaatattatttttgatgtttaaatcatattatttgtgcatatttatgccttgtagattgtaaaggcatttgttggtggtcattcaagattactttaggtataaacttacagtaaatgctggataacttaggaaatccatgctaaattggtggaatttaaagaatattttaaatgtaatgttaatattttaagtatatctaataacttaagttgccaatgaagcatttctaagcagatcctaaaaagccaaccttccatgaataattgggactttagcttgcaatcatatatgacaactgacttgctaaaatcttaaagtttagcccattaagcaaacaaaaatgcccttatgtatttagcagagtctttcttcacagtgttagtgtaagagtctaacccagttagggtcatctaatcagattaatgaggattccacatttgtacacaaaaatatagctacatacagctatatttttatgtattaagaaaacacttttatatcaatgcattttatagttgtggtcatatgatatagttgacttgtactaaaaatcttggatttgatagcatttaaatgacatcttgatgattaaaatgtgtaccttttcaaatggggaaaaattactaggctcagttaactgataaaatacaagaatcatgtaatcatttattttaggcaggctgttgttaaaactgttctctgaaattataagtgccttactatgaatatatcatctcttatgtgagccctgaaattttctgtaggtgtaaaacaggaaagaatagtaccactctaaattttatgattaccaaattccactgggccttcagcactattggtcagttcccaatttctgtaagcaaatcattatttcctccattaaaccaataatcctatacccactccacacaacttcataaagaaattgggagcttcagatgcgagcatgctgtaaacctgtttgcctgctctctttcgctcaaggcacaattgatagtgttttgtcctccctataagatgagtctctcaggttatgctgtggatctcattcccttcctcttttcaggaaaagagagactatcgactctctcttttcttgcatctttaacttactcctttcagttatatccttctcatcagctttttaaaacatgcttacatctctcccagccttctgacaacccctccatatttcctccaccagtcttcagacaacctctgtgctttcctctccatgataactacattccttcttcatcgtcatggccagaatgcttagagttacatacactgttcatgacctcccctttactcttaactcactgtagtgtgtcttgatttcccacaactaaaacaactttactaaggtcaccagtgactccaacaaacttttgtactaaaccaaacacatttttgtcttgatcctatttgactgttgagtagtattcagtacctctgacatacctaacttcttagaatgcttgatatccatgacgacatcacatttttggcctacttcctatctaaaatgatataatgacttgatatctatatgtacatcaaagatgtctcttcttagctcaagacatttatatcaaaccaatgaggattttatctttttttttttttttttaagagacagagttttgctcttgtttgccaggctggagtgcaatggcgtgatctcggctcaccacaacctccgcctcctgggttcaagcaattctcctgcctcagcctcccaagtaactgagattacaggcatgcacctccatgcctggctaattttgtatttttagtagagacggggtttctccatgttggtcaggctggtctcaaactcccaacctcaggtgatccgcgcatctcagcctcccaaagtgctgggattacaggcatgagccaccgcgcccggccaaggatttcatcttaacttgtacgtactcagactcagtatgtgcaagactgcgttcatcttctttttccctaaacctatcctttccctggctgtccttaattcattttgataaaagcaacatccacccagctgtccaagccagatacatagaagtcaccttgattcttcttctcttaaccccctgtccaatcagatacccagtccattctcttctacctgctcgaatagctctcaaatttgcccacttcgtttggtttcttttcttctttctgccaatcttactccaagccactgttctctttacctagcctaatgcaataacaataacaacttaattgttctttcaacatccatgcttgccctcctccaatctgttctctgtactggatctacagtagttgtttgtttttttttttctaactgaaaatatatatgtgattcctttaggaataaaataattttagggaacaaaagaggttgtggtttttattcttttggattaaaatatttctaaagcatatcgcgtaatactacctttttctaaaagcagtataatgtacattatttaatgtaatatttactcaagatttaattattgcattcttataatacacatactgtcttggctcttagtccttacactaaatgacatatgtctgtaaagattgtgaatttttctccaagttttctttcttctaagctatatattgtcaattgtcagtttttacatatgataactttctggacagttcttcagaattccacttgggatggggcttattgataacctatgtagtcattttgacctatggctcacctgagttgccagacttactatttgttttgtttgcttttcactttaagttaaacgtgaagtttaactgaagtttaaaattttaagctttctttttaaatttgtctttatttgctgtttccctaaggtgttgtgacaacaaaatatatctgttgtacgagaacatacatcaagatgtacctttcattataccactattaaaacgtttaccttttgtaggagatacaaacaagtaaagataaccacgccaaataatgttcttagtttattcatggagacttggtggtttttaaagtaagactgtttgtttagtccttacaacagtctatgaaaatatgtatataaataaatatatacatatgaaatcgcctcagagtgcattgcctgagaaaagagagattatgaagggaggttagataccttatcccatagtttctcccaaagtggactttctttttcttttttcttttcttttttttttgtttttgagacagtctcactccgtcactcagactggagtgctgtggcgcgatttccactcactgcaacctccgcctcccgagttcaagtgattttcatgcttcagccttcccagtagctggaattacaggcatgtgccaccatgcccagctaatttttgtgcttttagtagggacgaggtttcaccatgttggccaggctggtctcgaactcctggcctcaagtgatctgcccacctttgcctcccaaagtgctgggattataggcatgagccactgcgcccagccccaaagtgaactttctagaaccttacaacaaatctcctagaaccttctctttatttatatatatatatatatatataattaaaaccgaggtttagagaggtttcagaattttttacaagcttttaagaaaatgttctctcctcctctagactgtaagatctgtgaaagcaggggatctcaggatttttgttttttccttttcctaccagtatatatacctaacagctatcaacacagagcttgcttggctcatattaaaccttcattaaatgaatgaatgtggattatgcaattgttgtagtaaattactctttgaaacaaggtggtgggagatttgttataaggttctagaaagttcaccttggcagggggaactaagggataagatatctaacttccctttataatatctcttttctcaggctgtgtactctgtaggcaatctcaatttcttacataattttgtgagtttataaaataaattattttttgcttaagccatcttgggatagttttctgtcacttgtagtaaaagttattgagtaacaatgctccttgcttgtattttgttccacttactccaggtatcttccttgtggtgttttcccttcgaattcattatccataaacatctttataaaacataggcggttcctgatggtaaccctttattggctttcagcaccttcaggacgaagtctgggttttttatcacaggcctttagaagtctgcctgatcatgatgtgacccatgcccacctctttattctcccttccattattcttccatgatatgggacttcttatagctcccctgctgccacttagatattgttcagaaggtgctgttgagctgtaagatacattacattgaatattgcctttgtgttgcccattccctttgttagtattaaatataataggaaagataaaacgcaagttttaaaaactcagaaaatgagtaaatgataaacaacagctgagattttaaaaattcaacagatgtctgtaggaacaaagagggctctacttgaattaaagtgggtgagtacagcttacaaatgttctatgcatttaccttagttttagtatttcacatttttaaaaaatcacactatttaatatattataaatttaaaattttatacaaaaaatgtaagcagctattggattcgctgcttccttcccgtgagtcctccagtccagacatgtcctcagagctgccacttctgatgtactccttgcagtgcttagctccccacagtggagcttggagggtgctgtcttaacatctctccttccatgatagggatctgcccatttcaggggattcttcctgctgccttcaaactgagcctcatttttggaggtggtagggatgaaggagaggggatggaggggttgtaagagctgaggagtgtgaggacttgtgatggagtttcagagttggggtgagaagggtagcccatgaagagggccagaagagggactatagacagcatcataaagaaatttaaatttctttatatttggtaaaagtatttagtgttataaatcattatgaatgaatgtactaaaagaaagaatataataaaagatcttacttttatttatcatgaaggggaaacaaagttgcttgtgtccaaagtaacattattgcacaaaaaaaagtcctttggtattgaaaaaaatgagtggtatactggagtacaccgccccaccccccacccccaatacacacaaaaggtaggggtgttatataattattaaaactttttttttttttttttttggagacacagtcttactctgcctctcaggctggagtgcagtggtgattatagctcactgcagcctcaactttccaggctcaagccatcctcccaccttagcctcctgagtagctgggactaggattataggcatgcaccaccatgcccggctaatttattattattttttttttatagagacaaagtttcgctatgttgcccagtctggtctaaaacccctgggctcaagtgatcctcctgcctggccctcccaaagtgctaggattacaggcaggagccactgagcctgaccaaaaattttaagggattcccatagaggttcttgaaacctgagaatacccatcaacaatatgttctgttacatacaatacacagtatagggaaaccacaaagatcaagtttagttatacctttcctcactttaaaaatgtcaatttttgtggctccgatatgttatacgctaggaaactatcccaagccaccaattagaactgtgtacaagttacatgggtctgaggagctttgggtaaagttcatcatcttttactgacatattttgacaatttggacactatctgtccaccttcctaatgtgtattggaaactagagttgctagctaagaaagttaatagctcctacaaaaataagatatcttatttttcaaattgtatttgtctctgtattactctgttctcacgttgtcataaagaactttgttagattgggtattttataaagaggtttaattgactcacagttccacaggctgtacaggaggcatggctggggaggcctcaggaaacttataatcaggacaaaaggtgaaggggaagcaagcatatcttcacgtggcaacaggagagagagagagagagagagagagagagcatgagcacgcaaagggggaagtgctatacactttcaagcaaccagatctcatgagacctcactaccatgagaacagcaagggtgaaatctgccccatgatccaatcacctcccaccaggtccctccccgagtattggggattacaattcaacatgagatttggatggggacacagagccaaaccatatcagtttcccatcccactaaaatggtaggaagtctgtttactagaatttttgccatttccaaatgaataatcgttcattttcagatttatatatttggacaagggataaggtgaatgccagcaagtcatgggccataaccacctgtgtctttttttttctacttcttcttcttcttttttgggacagagtctcactcgttttgcccaggctggagtgcagtggcgcagtctcagctgggattacaggtgcacgccagcatgcccagctaattttgtttttggttttttggtttttttgagacagagtcttgctctgttgcccaggctggagtgcagtggcacaatcttggctcactacaacctccgcctcctgggttcaggtgattctcctgtctcagcctcctgagtagctgggattacaggcgcacaacgccacgcccagctaattttttgcattttagtagagatggggttttaccgtgttgcccaggctggtcttgaacttctgagctcaggcaatccgcccatctcggcctcccaaagtgctgggattacaggcatgagccactgtgcccggcctaattttgtatttttagtagagacgggacttcaccatgttggccaggctggtctcgaactcctgacctcaggtaatccacctgtcttggccccccaaagtgctgggattacaggcgtgagccaccgtgcccggccccacctgtgtcttaagaacatcctcaactattcttatttcctctctttctctgactcttgcatttatattatcataaatcttagctctcatactcaatgaatgtgaagcaagaaaactctacacaattcatttgcacagatatcattttcattcacatgagtaatgtctaaactaaatggcagtcattagtcgtaaaattgtgagtaagtcaggcacagtggttctcttttcttccctctccccttctctctccctctccccatccctccatcagtctctctgtctttctctctgtctctctctcttcctcttcctttcatgggaagaggtgatctttccatcccagctggcaggactaattcaggcatgcgttctcttccttgtggactgttataatggcttccttttcccttccaatccatcaaactcattcttggctgagaaattttaaatatacaaatctgatctaattctctttagctgtctcaagcttcacatctagccacagtatcaagttttgtttctttagcatactattacaaagtcctttcctaatcccagcctgcctttgtcagtttcatgcttacgctgtttgcccatttgctgtagctccagggctgtctactatttacattttgaagctgcctaatactaccactgccagttcatctcgaggaaaaccattcattccctcacttgctcctcctgtattctttgatgtattttacaacacttaccacatcgtgttatattggcttcttttacctttctacacctcctgccaaactcagagcagcaaaaatagaaggtaccatgtgttctcattttaatccacagtgcttttgaacaatctctgattcatggtaaccattagtagatgtttgagcttaatctgaagacatgtgcctaaagtcaaaaaattcacaatctagtagtgtagatagatatccaactacttataatactaagcagtatatactaatactaactaaaattggaaatttcttgaaattatcatcatgaatgtgactcttggatctctggcattttactgggtgcatagttattctttacatgtataaatgtaaatgactaaatgaagggaagaagtctcagatggtctagtggacctctacctcccattcttataaccctctcgcactccaaaacccttgaaagatgcaacagtgccaggccttcaccagcagagaaattgctatgaaaatgccatggacagagaaagcaaaccgtgatagcaattaagagccccatacaaaagtcacgaaggcacattcttctaattggaggcgttctctagcatatgcagttttactgcaaggtgactagcagcaaggctagttttcaaaaataattttgaggagtggcttattgtaagagataagcaattttaattttcacagaaacatcagataagtttaaaactttgtttatagcatcatgttttatttatttttggtggaaaagaaatttcccctcaaggcatttgtttgtaagtagaattctttattcatttatatcttgtttaactgtaccaaaactacaattttacagccatagtttctcgtgaaacctaaagcactcttggttacccactaacttttaaaaaaaatacacataaatcaaattttatctataaaaatatattcttaacattaaaaatttatcaaatgttgggtacaacctaatttgcaattgatgagttgattttgtttacttgtattggggagcaactttgattttagtgcctttttaaagaattgcttttacatatattgaatatagaagtgttacctgaattctgtaggatcataaatactggaatgaggcctggtatagtggctcacacctgtaatcccaacactttgggaggccaaggtgggtggatcacctgaggtcaggagttcgagaccagcctagccaatgtggcgaaacccagtctctactaaaaatacaaaaattagccaggtgtggtggtgcatgcctgtaatcccagctactcaggagcctgaggaaggagaatcgcttgaactcgggaggcagagggttgcactgagctgagattgtgccattgcactccatcctgggtgacaggaagactctgtctttaaaaaaaaaaaaatactggaatgaagttttcgtctgaagagagaatattacgattacagggcacaggcaaagcatagagccagtctggcataagtggtttttggttttgattttttttcctcacgctagaagttcttaaaattaatgtgtgaagtggttcttgggctactgaattacctattttcttgagttaactcattggcagttaactttataaaagcaagatttttaaattcacatggggaaaaaactgccatctcttaatctgagcattaagtaatgaccttcactaactactttatagtgattattaactttgtaaattgctgattttggttagaacttatatttaaatttctttatatttggtaaaagtattttagtgttataaatcattatgaatgaatgtactaaaataatgtaataaaagatcttactccctttctcttgattgcctcatggttttttattatatattttgatcaactacatgcttattgatcctggctgtattatcagctattagataacacaattttaaagtgcctgttgccctctggacaccgaagactcaacatttattgcttgagcattgcctttgttttgaatatggctttgtaaagacaaaaatccaggctgggtgctgtggcttatgcctgtaatcccagcactttgggaggctggagtgggcggatcacttgaggtcaggagtttgagactagcctggccaaatggtgagacccccttctctattaaaaatacaaaaaattagccaggtgtagtggcacactcctgtagtcccagctactcaggaggctgagtcagcagaattgcttgaacccaggaggcagaggctgcagtgagccgaggtcgtgccattacactccagcctaggcagcaagagcaaaactccatctcaaaaaaaaaaaagacaaaaatctgagctcttcttttagaacagaggagagtaatactctaagttatgatcatttatatggaggaaacatatcagtgttttgtttttctctagtagtgctaaactttaagaattttaaaagaagctaaatcagtaattatgtatctagtttccttccctaagaattacttctggaattattttgttatcttatttttaggtgttgcaaagtcaagtacaggggccatactagaaaggcaaaagagaaaaccaggttattgtgagatgagggggtgatgaggtctggggtaaaatagaatgtatatgactcacttaaatgtatttaaatatctttaaaacattgtgccatctaaacagaaatcctttgccactgtgactttgcaatccctggtttatattcatctggcaataacaaaaactatgtttatatgaaaattatttttatatataaatatatgatataatgaacatgtgtcattattgtgctcatctgccagtatatttgtgtgggccacatagtatttaaatgggctttaaaaaaaatatatcaggtgaggtgaaaacgtaacactcccattttattcctgaatgttttcctcttggctaatcttagtccttacagtgatactgaaaagtagagttagagtggtaaatggagtgaagggtagacattgtatatcttcataaatatgacttaaaatctgtcattgtaggatattgagaaaattcagatttttcagctttattaaaatttgatgactttacattgggttcacaaaaataaaagaagacatgtatcttttccagttcactgtgccatacatttatatattttatctttacagcctgaggaagaacttgatcctgaagagagggacaacttcctccagcagctttataagtttatggaagacagaggtattttcatgctcattattttaaagtagtcatttctttttcatgtttacattctaggtatatgcattgtttttgttagtattgcagataaacagttttggattttatttatttatttattttgaggcaggttcttgctttgatgcccaggctggagtgcagtgatttgctcctggcttactgcagccttgacctcctgggctcaagtgatcctcctgcctcagcctctcgagtagctgggactacaggcacgtgccaccatacccagctaattttttatttttctattttttgtagagacgggttttgccatattgccgaggctggtctcaaactcctggcctcaagtgatcctcttacctctgcctcccaaagtgctgagattacagctgtgaaccatcatgactgtctagttttggattttaaataaatcctagaatcagttacacctgacagtagtaaaatatttggaattaaactgttcatacctattttacatagaaacaagtgagaaaatattttgatacaatttagttttccctgtcacttacaaagctaaagaatattctgatatttcagaaatagaaagtgaccagttatgttaatctgcatacccactaattactaatgctatatttgtggcaaataaactagataaactagcctgatccttgttctcagcaaattaaacataataggagaccaatcgttatctgaaaaagatgagatttctaatataggtagaataatagaacaattataaaccatcatactccttgccatttgttagtcctagaaaatcttaagataaattggtcctaaacattctgtgtggccttcagaaatcatccttcagattactgctaacagtcttaacatttgtgtcaaagtagtgaaagtggaaccagggtataaatcttatcttttctgttgtgtttgtttatgcctaaactttttttttttttttttttttttttttttgtgacagagtcttactctgtcactcaagctggagtgcggtggcgtgaacatggctccctccagcctccacttcctgggcttaagcagtcctcccacctcaggctcccaagtacctgggaccacaggtgcacaccaccacactcagctaatgttttccttttaatttttgtagagacaggatatcaccatgttgcccaggctggtctcaaactcctgagcccaagtgatcttcctgccttagcctcccaaagtgctggggttacaggtgtgagccactgcacccagccctatgcccaagcgtcttgaaccagcaacattgttggccacaccatgcagtgtttactttagttttactcaattcattggcagttaaagaggtagctttattagtataacacctaaaatctgaagatccccacaaagctatataaataagagagaattattatatatattattatatataaaacatataaaaaagaattattatatataaaacaacacaagagaattatcttgtgttgttttacattgtttaaggctctttaaatatgtgcctctaattaatgaaattggggaaattagaaattgaccgctttgttttcaaattagtatttctcatttgaataaacattttatttctacctacttacattgaaaaggtactccaatcaacaaaccacctgttttgggctataaagatctcaatctcttcaaactcttcagactggtttatcatcagggtggatgtgacaatgtaagtataacattgctttttgaaacatgtattgatgtggtaaaaagttaagttatcttatattgcattattatatgcacattggataataaatacattttcttaatgaacatagaatattaggataaagatcttttcctggccaggcacggtggctcacgcctgtaatcccagcattttgggagattgaggcgggtggattgcttaagctcaggaattcaagactagcctgggcaacatggcgaaaccccatctctacagaaaatacaaaaattagccaggcatggtgtcgcatgcctgtggtcccaactactcgggaagctgaggtgggaggatcacttgagcccaggaggtcgaggctgcagtgagccctgattgcaccactgctctccagcctgggcgacagagtgagaccctgtctcaaaaaaaaaaaaaaaaaaaaaaaaaaaaaaaaaaaaaaagattaattccctttgcaaatgttaacataaaaacttaattttccagattgatagtggtgctgtatggaagcaaatttatatggaccttggcattcctattttgaattcagctgcttcctacaatgtaaaaactgcttatagaaagtaagtagtatagtttattcatcaaagaatatatatttataggaaatattttccatttactttgttaacaagaatacatcaatctagaaacattaaagttagagaaagtatataaaaaggtttaggttgacagatacttgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgagggtgagttcttaatactagttttatctggtttaagtattatttaaaattttttattatagccattttcatatatacacaaaagtactacagtgaacctagtttattttccagtatttaatgctgcttagctagctacttttttcgaaatatattgtatattatttcctctacctgaaaacccttccttctgttttctgtttatattcgattaagtcattcttgtctgggatgaatcccagatattccttttccagtcttctgctaaagtatcacctcattgaaggctgtcttggtcaccttatctgaaattgtaacctgcctcctctctttggaactctcagtccctctgatgttgttctttctgtaatttacttatttattctgtttattgtgattatctattttgccccactctacactagaatcacactccacgaggtcagggattagtgtttatttcgtttattgacagatgccaggcatttagaatagtgcctggcacataataaaggcttattaaatagatgttgaataaatgaatcacctctttatagtgcctgtgccctaaactagatgatatcttgtctttgtaactttatagcacactgtgtagctctagtgatgcgtacatgtatgctggttgtatcttccaactttgctccttctttcctttaatatataaggtctatttaggaattgtcatctagcatttggatcagtgtccagtgatgttacatagtaggatttatcaaattttagaaagagaaaggaatttaccacactatcaaagaagtttaattactatgtcttattttttggtggaatcatatttaatgaaagagaatgtgaaattgctttgtcttatagttcagaaaccagttttcaaaacttccttcatgtagtaaatggaatcttctagtgaatgtcatgaaatttccaaattgtttttttttaattttttttaaaattgtggtaagtacatataacataaaatttgccaccttaactctttttaagtgtacacttcattggcattaagtacattctcaccgttgcataagtgtcaccaccgtccagttccagaatatttttaccttgcaaacctgaaattctgtacccattaaacagtaactcctcattcctccccaacccttagcaatcaaagttttactttctgtacctatgaatttgatattctaggtacttttatataagtgaaatcatacagtgtttgtcctttttcactggcttattcactcaccataatgtctgtaagacattatgttgtagcacatatcagaatttccttcctttttaaaggtgaataatattttattgtatgtattgtggacatactttcttttcattacctaaaaaccttcctcatcctacataaaatatctgcagtgtgctgtctagtatggatgaaccataaatctaccttctccaagattttctcccagttttttactattttaaaaagtgctgccgggcgcggtggctcatgcctgtaatcccagcactttgggaggccaaggcaggtggatctcgagatcaggagatcgagaccagcctcgccaatatggtgaaaccccatctctactaaaaatacaaaaaaaaaaaaaagtgctataatacatttgcttgtaaaaatatcctcatcacttatccacatatataagccaggcttctaaaaatggcatttctcacctgtagtcccagctactcaggacgctgaggcaggagaagtgcttgaacccaggaggcagaggttgcagcaagctgagatcgcaccactgcactctagcctggtcgatagagcgagactccatctcaaaaaaatgaataaataaataaaaacagtatttctgggacaaaggtatacagacccaaattttatagcagttgttttcattcatttacctatagatattttaaaagcacctgctaggccgggcacggtggctcacgcctgtaatctcagcactttggtaggccgaggcgggcggatcacgaggtcaagagatcaagaccatcctggccaacgtggtgaaaccctgtctctactaaaaatacaaaaattagctgggcatggtggtgcgcgcctgtagtcccagctactcaggaggctgagaatcgcttgaacctgggaggtagaggttgcagtgagctgagatcacaccactgctctccagcctggcaacagagcgagactctgtcttaaaaaaaaaaaaaaaaaaaaaaaaagcacctgccacctgctatgtgccagccactgtgtagatctgaggagatggaagtgccatcttggaacttgtgtgttagtgctttaagatagaaagaaattaatttcttctttttctgcctttgaagtgtaaatagcacatagccagcaactagggaaaacatttgtttactgagatattaattgtatcctaatgcttcctaagttgctggctctttatctgctttattccaagaagaggagacttctgccagtgtatagaagttgacttgaaggagaacctaggagatagtgaaattgctcaccagtcatggtcatttcagcattcagtgggctagatagaagctagtggtggtaaaacatattgctgttggcccagcgagctctccagatactcattcaaagaagtctgctcacttttttgccattgatgcaattcagtcctttaaaaatgtaatcatccacaaatacagtgacaatgtaaattttgtcttactaacggtagaattagagaccacagagcctttaaagaagcaaaattcaggggattggttttattattgttacgttttatcattaacattagataatttattttaaatttttattatagtcgagaaataataaaagtgagataaaatgatgtagtaaacaaaggagaaaatttttatttcttttttgttgttgttgtttacttttttcattcaaacagattctgacagatatttcttaggtagtatatagccaaagtagacctggacataattaagtaattctatcagttattcttttactttcaaaaggaagagaaaggtacctttgagttggttttcagggccacgtttcaagccagagacattgctatgaaggttaaaggaaaagatattttttcctgcttttttcccctttatagtgatagctattttaaagcttttatcccctctactagggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagaggtacattatcttatgtttgttctccagaagcacctgtctggggtacaacagcgctttgttcctgcttagagattcaggtttgagggaatgttttcttattgggacttccgttcctcttgtctaatgaaggtgagacacattgtgaagatgatgtgtattgcctttcggaattggagaatatactggtcgcaccattttaatagcacttgtgccctaaacagtggcctcaaagaaggctgcgccacccagtcaaaagaaaggtcctgcagttgacagcagggaagggagctggagaaaaatggaggaagtggacaagaggaaacagcgacagcaaaaattccattttaaaaaaggtacaatgtgggaaagctaacaaacacatgggtgcacagtactagagatgtttctgtgtgttagctttaagacatttttctttttcaagttattgtattagattatgtggcatgcacccctgattctagtttggaaaatacattcttgccccacatcacaccaataaatttcagattttttaatgtccatcctgtttgctgttgagtaaaactgtattttttttctgtgtattagacaagtatggactgaactgacttaaaaatagtcaaatattaggcagtccagcaagatcaaggtagtctctgaccaagttattagctgcttctgtaagtgttgtcaaatggatttactaattttaggacacgactaaaaatgaattttaaatgagcaacaacataacatacttacttgtaataccagctctcttccatagttatttttctattattatgtgatattaaattttctagaaatttgagttgttaagccaaatttgggaaaactgacctgccattgagagaataaatatttggaaaaataggatgattggtgaatgggagaggtaatttgattaaatacaaataggcacaggagctatcacaattacatatgacctaggttagtgagtaaaaaaaagttctgtaatgaaatataattaggattaggaaaagtaggaggaactaattggagttgagtatagtgagtatagaattttaaatatttggacaaaaaatttaagcaaaggtgaaaaacatcaaaatatgtatattgtaatatgtatataaaacatataatacatctatgtaaaatgtgatttaaaaagactgtaactcttttgtaaatggacaaagatttattttagagaaaatttcacagacttgaatgtaagaacaatattatctttaagtagtttttctcatagagttttgaatttaccttatcactctattattggaaggtgccttccaagagaaaacattctcactacaaatgggctgtcaaagcttcatgtcaggacccccagggatcaccaaaataatgccctatatttattacagagcccagtagtacttgttgagcttttaatgcttgtgacactagaatgatctttgatgcagttctcctataagtctttacaggattgatacacaatattttattataaaaatattaaaagtatttttagctctccctgtgttaatcttccttatacctgattatcaatacaaagaaaagccgatggaagatgagtaaacaaatagaattcaacacaaatgtaaagctttgttcttgtggtggtatcctacagtgtcaacaaatgacctaatactcaaatttcttttctttgttagggctgggaaacctttaaaatataaattagtttaaaagacatggttactaaggtagatagcccttgttcattattttgcccaccaaaaaaactagtcttgccaagaactattctaattctggtagtaaagcagatttaagataattcagttacaggaagttacaaaatatccttaaatctttttttacatacaaggtggcacttaaatatgaattctgaagaattttttcagagcatatttttcttattttgttttgtcaaaagtgattgattacagatcatcgttagctggcacttaaatatgaattctaaagaattttttcagagcatatttttcttattttgttttgtcagaagtgacttattttattacagatcatcgttaactgtgacttgattggcttttaaaaagtatggatttactttgggtacagtgcacctttacataataaattccttagtaagtaggccacagaaatcttctccttctcctccttcttctcctcctccactgatatgttattaaggtaatacttaggttgtgaataatctacctgttggattcttttagcatattttattctccattaagttattagtagcattatcagtattataacttactgcagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtaagcaagaaactattttcttactattgaaattttttcgatgattaaatagaacatcaacttaatgttatgaagagtgaaagcaaataatggtacatatttacaaagcacaccttggttctgaattttccaagactttgacattcctgctgttatactagcagtgtcaatgcttctagccagagactaccaggatcacacctgtagttagaacaagttacatttattactcatttatagtgagggagaacacacagcaaggggaaccatagggcatcttagtaatatggtgttaaatgaatcaacagaggctcaaggcaccatctttgggaaaacaataattcataattctgtggagacatattactgactatgagcagggagccaggcctgcaacttccaaccgtgcaagtgtttgtttcattaatcagaaatcaagcctatgtcaagcactgtaataattctaagtcgactaattaataaaaaagaacgttagaacttacatttgatcttccgttagatgattttggggagggtttaagaaaggcagggcatgggggctcttgcatgtaatcccagcactttgggaggtggaggcggaaggactgcttgaggccaggagttcaagaccagacctggcaacatagttagacccccatctctacaaaaaattaaaaattagcctggcatggtggcacgcacctgtagtcccagttacccagaaggctgaggtgggaggatcactggagcccaggagttggaggctgagatgagctatgatcataccactgtactccagcctggatgatagagcgaaaccctgtctcataaataaaaaaaaaaaaaaagaaaaaagagattttgctccatattggatcctgtcaggaagttggggtaattatagttggttttcgtaataaatcttatctagaaggagagacagttagaccaaggtaacattataattggtagagaaacagcaatcacccacattagtcaagaaaaagaagatgtttgtcgtttttgtggattagacaatgttcctgttttttctgtgttcagacacgattaggacatggtcttgtttctgttttgatacatcatggtcacagaatggacttgtctgatgttgatgctctttgaaattgttcatgtttcaacagcaggacagtgtggcctagctatgagtgccagactagctctaagcaacaccaaggcccagctgatagtgccaggcaagttcctaaatgtcaggggctgcctttcttgttctcttttacaaaatctggcatatttaatatctctggttgccctgtatttatttggagccagactgctcctgggtttctctatacactagatgtgtgctctgttataactcaagtccctcatctctacactgggaaaaatacagttcctattttgtagaggtgttgtataatgcagtagttccctctcatctgctggaaatgtgttccaggacccccagtggatgcctgaaacctcacatagtactgaatcttatatatcctatgatttttcctatacatacatacctacaataaagtttaatgtataaattaagcacagtaagagattaacaacaataataaaatagagcaattataactgtattgtaataaaagttatatgaatgtggtctttctctcaaaatatcttaatatttttggaccatgggtaattgaactatgctgtggctaagcagggactactgtagtgataatatttgtattcagatgtaaatgcttagaaccatgcctggcacttagtgctccatgaatgttaactgttttcttttctttacaatgtgttattgaattcaggggaaaaggaatatatcataccaactttcagtcattacatttccagttgcatcacatgatagccttctttcttcctcagattctttagttcacaactatccactcctatttcacatctgtatatgtctgtgttctgctttctagaatttcccctatctttctttctcatttttttaatgttttactttatgactcttctcagcagtcattttattatacgctcaggttttggattagtcatctctctaattaattacctaactagtactctcctggttcatggtttttcgttgttcttctctactcctaaaagctggtataattctggcctgttcagttgagatgaagccaccatggttcctaacgaatttagccagactcctgaaagggagtatctgcaagtgtaagaagtgtgagaagagtcctggtctctcattgagaaatcctgggactatcctttgttagcaatattagtgctagaagtacctacatgatatattgctttgtccagtgtcgccaggaccaagtacactaaaaatcaggcctgtgcttcttggttgtctgatacctcctatggaattggatagagttatccctttgttagccctggatcaggtacatattgcacttaccagactatacttgattttactatatgtctatcttttataacagattatgggttgcatgagagcattggccatgtttattctctacatacttcctgatacagtgcatactagtaggccctcagtaaatgttcaaatgaataaacatttccatataagttaataaagtacagatgtttaaaagcctaatatgatgctcatagccagtctcgttttagaaactagatactgggttaatgagtgagagatagttttcaaatcatagtacaggcagttcctaacttatagtggttcaacttcaattttttttttaaatttaaaatggttcaaaagctatatgcattcagaagccatggaattttgaattttgatttttttttttttttttttttaagacggagtcttgctctgtcgccaggctggagtgcagtggtgcgatctgggctcactgcaacctccgcctcctgggttcaagcgattctcctgcctcagcctcccaagtagctgggactacagacgcacgccaccatgcccagctaatttttgtatttttagtagagacagggtttcaccatgttggccaggatggtctcgatttcttgaccttgtgatcgcccgcctcggcctcccaaagtgttgggattacaggcgtgagccactgcgcccggcctaaatttggattttttttcctggtctagcgatatgcagtatgatactctctcatcagactgtgcagccacaacaaacagctaagaaatcatgagactaatcaaccagtactgtacagtgtattcaataaattacatgagatatttaagactttattatagaatagactttgtgttagttgattttgctcaactctaggctaatatgagtgttctgagcatgtttaaggtaggctaagctaagctgtgatgttcagtaggctagatgtattaaatgcatttttcgacaggatattttcaatttgtgatgagtttatcaggacataatggcatcataagtaaaggagcatctgtataggtagtcatggtaccatgtcaactgaaatacatgcataaaggaaccatgtccttactttgtacatctccatggtaactggcttataaagcaagaatatggtttccagatacatgagtttctattaatacgctacagtctaaaacaagtttgtccaacctgtggcccacaagccatatgcagcccagcatggcctggaatgtggcccaacacaaattcataaactttcttaaaacatgagttttttttatttttttgcatggtttttttttttttttttagctcatcagctatcgttagtgttattttatgtgtggcccaagacaattcttcttccattgtggcccagagaagccaaaagattggacattcctggtctaaagcaaggactgcctgttgtttctttacttaactgtacattttttagattttgacttaattctgtaaatacttgtatatttagataatgtaaaaactgttatttagttctagaaaccttaatttcttatttgcccctgattagtcacttggactatagacaatcaaaagtgatagtaatcatttgagaaggccaggtgcaatggctcatgcctgtaatcctagcactttgggaggctgaggtgggcagatcacttgagctccggaattcaagaccagcctgggcaacatggcaaaacccgtctctataaaaaatacaaaaattagcttggtgcaatggtgtacatccgtggtctcagctactcaggaggctgaggtgggaggatcatctgagcccaggagatcatgcctctgcactccatcctgggcaacagagtgagaccctctctaaaaaaattgccgggtccagtggctcacccctataatcccagcactttgggagactgaggtgagcaggtcacctgaggtcaggagttcgagaccagcatggccaacatggcgaaaccccgtctctacgaaaaataaaaaattagcggggtgtggtggcaggcacctgtaatcccagatattgggaggctgaggcatgagaatcacttgaacccaggaggcagaggttccattgagccgagatggcaccactgcatgtcagcctgggtgacaacattgaaactagccccccaaaaataaaaataaaatttaaaataaattttaaaataaatttttaagtaaatgtttaggggaaatgagttttcaacttaagctaaacagaataaacttagataaagtaggtgaaatacagatatctctaaaaaatttcagaatcctaaaggcaatgtagttcagaagattttattggaaatactagagagagtgttgaggaggaaaaggaagttgaaatggacttgataaaataacttgataaaataacctgaaactgatcaccttgcaaatttgaatttatctgacttagctttctattattcattcaatagcacgaattctattgcagatctgattataagctcaggtctgtaaaagctgtggaaaacaaaacagttcagattgtcttgaatctagagtttgctttccaagactctccctctaaacctgttaactcttaagaaatcctcttgcctttccctagtgagtatacaaaatacctactacagttactggcacatgttaccagcaaaccagcccctgtgcccttcatattcttgccaacactaagaacaaactatttaatctgtctcactgttgttttcgtttggtgaatacatttcaaaaaggttataatgtataaagtttgtacaaactctttttttttttttttttttttaaggtatgatgagtgggtgaaggctgacaggataatctggcctttggacaaaggtggaccaaagaaaaaacagaagaaaaaagctaaagtatgtttgtagatttatgtcctttataatatgtataggaattatccaaattgtattgtgtgttttttaagactttaagaacagttttaggtttataccaagattgagagcaaggtatatagacctcccatatactctctgccccatgcatgcatagccttcccagattgtcaacatcccccaccagagtgggatgtttgttacaactgatgtgcctacattgacacattattgtcactcagagtccatcgtttacattagggttcactgttggtgttgtatattctgtaggttttgacaaatatataatgacatggatccatcactatagtatcatacagagtagctttactgccctaaaaatcctttatgttctgcttattcttacccccaccccagcccctgacaactacagactttttctctctccatagtttttgcctttttgagaatatcatataattggaatcatacaccatatagcctttttagattggcttcttttgcttagtaatatgcatatacgatattgtgtttgtttaataaatcttattgtaataatcatcttggccgggcatggtggctcatgcctgtaatgccagcactttgggaggctgaggcgggcggatcacgaggtcaggagatcaagaccatcctggctaacacggtgaaaccccatctctactaaatatagaaaaaattagccggtcgtggtggccggcgcctgtagtcccagctactcgggaggctgaggcaggagaatggcgtgaacccaggaggcggagcttgcagtgagccaagatcgcgccactgcgctccagcctgggcgacagagcaagactccgtctcaaaaaaaaaaaaaaaaatcttgattcttgacagataattgtgattttctctttataacccaggagcttaaaactaacacattaccacattgtttcagcaaaggtgaaaaccagcaacccctagggcatgactttcaaactcaaattcctgtagaggctttataggagaaggataaagtaggacgaaccgtgacaaacgagaggtcacattcctcatttagacggaatggaactaaccactctgctgtgggaatgcagacccagggttgccagattttaggatttttcaagaccactatctttcttaaaatgtgaaatttgacttttaaatgctagaagccaatactaaaattttaaaacacatatatactggccaattgtaccctcacccacatcctcagttgtcaagctttgctgtagagatttgcccattgttttgtctactggatgatagatatctttcctttctgcaggggatagtagggaacagcggggagtgcggaatagttgtatagtcttctaaagctctaactgaccatcacaatataattgcagtattacaaattgtacaatattgtatttacataaatacaaaatatgttagaaattcagcagtggaggattatataccaatttccgtgacactaatgttaataagttctgataacctctcagaccagccagaaaactcttcttgattcttctgtaagcacagactaggaagtgacatataaaatatcaaaccttttttgagatgtagttttctttggataagtagaatgttcatttttcgtaaagcattggcccttctcatacattttgttgttgttgcccagaataaagaagatagtgaaaaggacgaaaagagagatgaggagaggcagaagtcaaaacggggacgacctcctttaaaatcaaccctctcatcaaacatgccgtatggcttatctaagacagcaaacagtgaaggaaaatcaggtaccagaagtgctcgcagcaatataccagacagctcacctctgtcaaatggaatggaaggtgctcaattttgaggatggctgactttaaaaaaaatcaataacataaataataaaacttccattgtgtgaaatattcacagtacaggttgagtatcccttgcccaaaatgcttgggactagaagtgtttttggtttttgattttttttttttaatattgcatatacataatgagatatcctagggataggacccaagtctaaacatgaaaattagtgtttcttatacacatagcctgaaagtaattttataccatatttttaatagttttgttcatgaaataaagattgtgttatttgaaccatcagaaatcacaggtataattgtctcagccacccatgtgaacagtctgtgattgtttggcatcactgttattcttgactctgaatttatatgccagctactgataagcaattttcttacacttattcacacataattacataacagtaaaacatatgacttacaattaatacagtggaaaaattgtgtggggaaactaagcagcaaggtagcatcactagaatacctgtatcagctgctaaacaacagcaaaaacaaacagcaggctttcagtctccacctacgatgctgtgttttcattaaaaggttacccgtacactagcttggggttgctgaagaaactgttgtgcacctgtgtttggatgcaatgtgtcccatgaggtcaggtctggaattttttacttgtggtgtcatgttggtgcccaaaaagttgtggaatttgcagcattttggatttcaggtttttggactaggggtgttcaacctgtaaatcacctaggattttaatctcatatgatttaaactataaaatttgatttgaagaaaatattttgctgtatcatttttatctaaaatttagtgatgttttcatttaggaatactttttctcataagtatcttgaaaataatatattttaatagaaggtgaattgacaatccatgcatcctaatgtgtgctacactttccctcaaagcctgtaccagtgtatcctataaattcaatgctgttcatctgggatctttcagcaaagctgagaccatgtggttctaagagaacacagactactgtggtgcaggcatgttttataatgagtataggtgaacatattttattctgcttgtactcgtttcccccacttttctacctctgtatacttttaaatgtaattaagaaattttaggctgagtgcagtggttcatgcctgtaatcccagcaccttgggaggctgaggcaaaaggatcacttgagcccaggagttccagaccagccagggcaacatagtgagaccccatctttacaaaaaaatttaaaaattagccaggcatggtggtgtgcacctgtggtcccagctactcaggaggctgaggtgggaggattgcttgagtctgggaggtcaaggctgcagcaagtgtaatcacatcactgcactccagcctgggtagcagagcaagaccccacctcactctgttgcccaggctggagtatagtggcgcaatctcagctccctgcaacctccacctcctgggttcaagcagttttcccacctcagtctcccaagtagctgggaccacaggtgtgcaccaccatacctggctaatttttgtatttttagcagcaatagggttttactatgttagccacgctggtctcgcactcttgacctcaagtgatgtacccgcctcagcgtcctgaagtgctggaattacaggtgtgagccactgtgcccggccaccaaaaaagaaattttaaatggttgtcttatataaaaatttctcttctttcaagaaaaaagctatactgaactacatgtttgctattagtccatatggtgcttgtgtgcaaattataaaaggacatccttcctctttactgccatctgctgacaaatgtttaagatgtccacaaagtgaaaggtaccctcttagaaggcatacctgtgtgcagtgtccagtctatacaactacataccagccttattaaactaccactgaaagggattttttaaaacatgaaaatgaattctacattctgtttatgataaaaccacaaaataaaactgtatacaccttttcactaaaaaattcatgtttgcagttttgaacttcttgaggatttgagcaccatgtggacaatatttttatattttttagatcctatacagtcttagaaccctactttactattttacaagttcccttacagggaacaatttttgtttcctgtactttcttgtctgttaagaatatttaaagttttgaggattccaattgcccattttaaaaacttttcttgctgggcacggtggctcatgcctataatcccagcactttgggaggctgaggtgggcggatcacttgaggtcaggagtttgagaccagcctggccaacatagcaaaaccccatctctactaaaatacaaaaattagccgggcgtggtggcctgcgcctatcccagctcctcaggaggctgaggcaggagaaatgcttgaatccaggaggcggagcttgcagtgagctgagatcacgccactgcactctagcctgggcaaccaagtgagactatgtctcaaaaaaaaaagaaaagaaaagaaaaaaccttttctttccacagttattttaagtagaatgtcatattcctttcttagggtacaaaatgcccatcatctgtccttcctagatactatctcaaaccacttaacaaattaacttcatgtctaggatgtctaggtactaatcctttgatcttttttaaggactattgtacctaaatatgatactggggaatgttgcaaaatagcttttcatatagatttgagttagtaatatgcaacgtaatatatttttgcttggagcttagtttcccctccccctcaaattcttggcacaaatgttatgatttgttttatttcagaaatttctacagggaggtattcagaggtacatgattaaagatttttattgttatttttggtaagatttttattgtaaaattacattggtaatataaaaacctgtataatataataatatttcctcttacagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtaaggactttctagggaaaagtaagtgtttatatgaaaccaaaaatcaaaactgttgagtttcaggtactgttgatctgtaaagtactttctttttcttttctctcttcttttcttattaaaaagaaagaaatgtcagtgtagtctgttgaataatatacttgctcttttttttttttttttttttttcaacattctctctttccccttatttcaggtcagaagaggccaagtgatggaaatagtggattaatggcaaaaaagcaaaagcgtaccccaaagcgaacaagtgctgcagccaaaaatgaaaagaatggaacaggttggtgtctttcaatgctagcttttgtatagtgttagtatttttagcagtttgttggcttgttttaaacataaatggagcaatactatattgttttataactgcattttcatttaacagtattatactagatattttgccatttttattcttaggaactctagctcattctttttaacaactttaggaaagtattcaatagtttatcatttttaaccatttccccgttggtgagcatttaggtttttttgtttttttgttgtttttatattgttataaactttgtgcatttgtgcacttatttctgtaggataccaagaaatgtaattgttaggtctgttgcattttgatatttaagaattttatttataatctgagtcaatcttttttattatttataggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcagtaagaagcttatagaaaacttgatagatgaatactgtaaagtggaatagatcttaaaatatcaacttggattaatgttaataaaataaggaataatgattaactatttagatattccaaatattgccttagcaagaatcaccacatgttgtcttaagtataaatctgtgtcttttcataaaactgacttgataaatattgacttacaggaaggtctccattaagaagccatgtatgatttatataaatcagtgaaattgaagtgccctttgtagcactaacaattagaaatagccagtagttatttctattatgtaactagtagtagtgaagaaaatgtcaatacagggaaactattctgataactataattatagataggtcagggttagtttgtgttgatgttttcttatgtttttctgatcatttaagtaataaatgtttagtatagaaaatttgggatctaaaaataattcttaatcatgaatttaattcacgacttccttgttttcagtcttattcagcttactgtaggagattttaataaactaaagcttttgttgatttatgagttagacgtttgatagaattgtcatcatttttctcacagaattattttaaaatccaaattaacttctttccccccttttagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaaggtaattttattatgatttttctccccttatatttcaaaactatatcctatcattttagaagatttaaatttgatactctttgaatatagtacacattcattaattgctgtttttaaattcctagtgttttctattgttgaaatgagtaggtcagcaactgagttaatcagaatgacacccttaaaagggagtatgaactgttttccaaaatgggtgattgtactaaatgtgatggattctcaggtagagcatagtccttctgaaattcactctttgctcaaacatttattggcatctattaacaggcactgtatttgttatggggttcaccaaaatgaatgagacataaggcttattctcaaggagattatcttgttgggattataaatcatttcctaagcaactaaaatataagatagtgcagctcagcaactttaaagagcacatgccatgtgccaggcactctgccaggtggcggaagtacagaaatgagttagatacagactttcttctcaaagatcttaacatctagtggaacagtgtgtaccctgagaatgatattaacgagtacaagagttagtggaaggagaggttactttggagtagtcagagagagggagtagtgtctgagctagcccttcgggggttgtaggattgacttccagttaaacatgaacatgtccatctacagtccatccctaagccctgctaaaataacagtaaaggaaattaaaagccctaaactcaaaaggacaagagaatgaccacaacagacaagaaatgtcaacagtatatcttttggaagctgcataacagatggactactgtaactgtcccagcagatgagataatgctgaaactaagcttgcttgtccttgtagtgggacaaaacaacaagaagcaagccaattaataccatgtaaccccagaaaagctttcagaagggatatgggacgatgctgaaaaatgggattggttgaaaatggaaagagaaattggatctcttcttcccatctgtgaagcaagtctacctcacccccaactcaagcagaaaatagattaacttaaaagagaatgaggaaatcagtaggcctgtagacttgggggcaccagccacagctgagggtaatgattaagtgctaaaccaaaataatggatggagtgaaagtttgcatactgaatagttagattgctgtccctcttctaactcaaggcctaatcctcttggcttcctgaaagctggcagccaagcttatgcttattcctgggaggagattggaagattcttctaaagaaaatgaccagcccaagaaaaattacctactatttggatgttcctgaaacaaaaatcaagatccttgccaatcactacatgtgcattttctgtatttaaaagccctgatgctcatatacagctttcagtcagctttttaatgttaaatatggaagccacatgaccagacatttgaggaaagcccctacataaaggcagaagccaaagtagaaaaaggagaataaaaaggaactggaagaaaaaaaacagataatgtaccatattaaaaaaaaaataggacaaaactattcttaatagttaatccaagttgagtatcctttatttgaaatgcttgggtctagaagtgtttgggttttttatttttttcagattttggaatatttgtacataatgaaatatcttggtgatgggacccaagtctaaacacaaaattcatttatgtttcatagacactttatacacatagcctgaaggtaattttatataaataattttgtgcatgaaacaaagtttgtggtaagtgcttatgtgtggaattttccacttgtggcaccacgttggtgctcaaaagtttcagattttggatttttggattagggatgttcaatttgtatccagagataaagggaaagagattgccaccttgaaacaaaagcataataactattttaaaaattcagagaacaagaaggatatctttaaaatatgatagcaggaatttaaaaaaaataataaggcagtgaagctgaagaaattccactagagggtcaaaaagacaataggagagaagaaataagagaaatatggaatctggcgaggagatccaacttctgaatcataggatttctagaaggagagttgaataaacaagaggaagttgtcatcaaagatatttttaaaattctagaactgaaggatatgagttagaaaaggactcactgtgccctctataaataatgggggtgaaaatcaccaaagcatatgaaatttcagaatcctgtggataaagagtagattctaggcctggcacagcggctcacgcctgtaatcccagcattttgggaggcagaggcaggcagatcactggaggccaggagtttaagaccaacctggccaacatgacaaaaccctgtctctactaaaactacaaaagtcagctgcgcatggtggcagatgcctgtaatcccagccactcaggaggctgaggcttgaggatcacttgaacccggaagtgagcaccgagatcgcgccagtgcactccagcctgggtgacagagtgagagtctgtctcaaaaaaaaaaaaaaaaaaagtagattctaaaaatttaccatataaagatacatatataaaaagaaatggatctcagaacagcatcaagagtcttacatccgatttctcaatggtagtactagaaactagaagccaagctaagaagacatgggactggcaaacaaggaatcctacataggaaaatagtgaaggaatatctgaaggtgatggtgaatggaagctctaggatgaccactgcatagcagacctagaaagcaactattccaggagtaggatggaacaggaggggaaagctccagaagggatgtctcttaaaaaccaaataaaaggtaaattacctgatagggttgatcatgttgagagaagttttctgcctctagtagagatttagtggatgactttgtggtagagtgacgtgtcatgtgtggccttgaccattgtgctccaagtccagcagtttttaattcctagaaataggaacaggatggagcaaatggaaagagatcagacttctcatgttcatccttttcttttaaaaactgtaaatagcaagaagtctttacagaacttttgaatatcaaaagaagaaaagaacaaattagcaaattaaaatttcttcaaagaacccaccacttgctctggggtcagtttcctaaaggtgacatacatttcagacaattaaaaagattttctttttgttgagacagagtttcactcttgttgcccaggctggagtgcaatggcacagtcttggctcactgcagcctccgcctcccgggttcaagccattttcctgcctcagcctcccgggtagctgggattacaggtgcccgccaccatgcctggctaatttttgtatttttagtagagatagggtttcaccatgttgaccaggctggtctccaactcctgatcccaagtaatctgcccacctcgtcctcccaaagtgctggaattacaggcatgagccacagcgcccagccaaaaagatttttttattaccgtcttttttgttgttggggggtacaggctctggcacccagactggagtgcagtggcatgatcacggcttactgcagcctcagactcttgggctcaagcgactcccacctcagcctcccgagtagctggtaccacagtgcctgccaccacacccagctaatttttttagttttttttgtagaggcatattctcactatgtggctcaggctggtctggaacccctgttctaaagcaatccttttgctttggcctcccaaagtgctgagattataggcatgagccaacatgcccagcttattatagtcttttccccatttttatttgcttatgtttttataatgagttattaaattgagatttgagtgatttgtagcatacatgtaagaatttgttgcctgggcatggggctcacgcttataattccagcactttgggaggctggagcaggaagatcacttgagtccaggtgtttgagaccagcctgggcaacgtagtgaaatcccatctctacaaaaaatttaaaaattagctgggtacagtggcatgtcttagctacttggaaggctgaggcaggagggtcgcttgagccccagaggttgtcatgatacttgaataaacaaaaattaaaattttaaataaaataggaacaatcaggcaaagaaaggcagaagacaagagtattgcaaggaaagagaagataaaagcaaagaacttaaaaagtggcaaaacacctaatgctcagagtaccgatccctaatctgtgttatgtcctcctggagaaaattatgttaaaaccatttgaggactttttgcttatcacacatcattactttgatcctgatctccatgattctgatacctgtcagaggaaatcctctgagttaaattaattctcttacggtcctatgacccatagataaagcagaaattccatatggttccatgtttatctcaggttgaccttgtttctgattgagccaagttccttcatgggatctcccaactagaggtttaagagtttttgtctctttaatctttacattttatgatgtatttttaagtgttgagtagtgcttaactgaccaaagactaactccacttaattgagccaaacaaaatttttgctgacaatttgttactccttcatgtgacatataagaggcctgtgattaaggtgaataatgttaagaattttatttctaatttgctgttagctgggtatctttgtgtaacagtttttggatctaacatagttgttttgattccacagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacataggctttatacttttagttttcatttaagtgattgcttttttcctaagtgcttgtaacttacagttggaaaatcagatttcacaaaaccaagcattttagtatattcagcctttacaataaaatatttctactaattataaaaatgaaaaaaaaagtgtcatttaaatccatttggacctaggaggcaaccttagatttatacattaaatattttaatgatttccttctgtagcaattcaataaatgtgagataaataagttatcagcttgagtactgtcccttctaattgatacaaatttggtcatgaagtattgggatgttgctacaaagagcaaaactgtgtattcattgaatagatacacactgttaaaatcctttcatttggaggctggaaaggattatgaaattaagtgaatattgactaagtatgacatttcaaatattgagcatattttgagtttaggtaaactttgaatagatacctcttaaatgtaactaagaaagtaaaaatataggctgggtgcggtggctcatacctgtaatcccagcatcttgggaggcagaggcaggcggatcacaaggttaagagattgagaccatcctgaccaatatggtgaaaccccatctctgctaaaaatacaaaaattagctgggcgtggtggcacgtgcttatagtcccagctactcaggaggctgaggcaggagaatcacttgaacccgggagacagaggttgcagtgagcccagatcacaccactgcacttcaacctgatgacagagcaagactctgtctaaaaaaaaaaaaaaaaaaaaaaaaagtaaaaatataaagacactctaatataatgcaagttgccatctgtaaaatcaagttatttaaaagattatggtgctttctgttttagtattgcattgtgtgcttttatgtatttcaatttttgaaacagggtcttgctctgtcacctaggctggagtgtagtggtgtgaacacagctcacttcagccttgacctcgtgggctcaagccatcctcccacctcagcctcttgagtagctgggactacaggcatgtgccaccacacctggctaatttttaaattttttgtagagacagggtcttgctgtgttgcccaggctggtcttgaactcctgggctcaagcgatccttctgcctcggcctcccaaagtgcaaggattata

SEQ ID NO: 13221 - DNA, 77586 bp, Human; identical to SEQ ID NO: 13220

SEQ ID NO: 13222 - DNA, 6250 bp, Human
cgcgggtgtcttggaggcacctgccggggccggccggggagcgctccgccctcccagcccctggcgcgcagaggagactaaaacagctaaggagaaagcaaaacaaaaacaatgataaaaacgtttaaaatccaaggacaaaaaccggagtcggtctcaaaatccgcgccgttcagtgctccactcggtagtcgactcggctgcaggccccggcctggccggagcaacgcgggggacacccccgattccgctggggagcgcagcccacagctccccctcgccaggcgcccaaggaccctcaaggcgcggggcccacacttgaagcctgggaacgcgcagacaggaaaccctcttcctcctaagcagtttcttgctcgtcggatgagaggcgcccaattgaagcagaatgatcctcatctactaatatccagcgtggccacaaagcgactggccatttacgccaccactttaaacaaagatatttggttattcccgggaagcaagagcacttttgcatggctgagctgcgggcggaggcgagcctcggcccagcctcccgcccgctgagctgcccgcacctcggcattcgccccctcctggccagcgctccagccgccggggttcaggctcagttccgcccggcaacagacagacgggcactcacgccgctccctgctcgcgcgctccctgaagcatcagaggggaaaacagcgtggctctgggctcgggtgctggggctgtgatgtcctcggaaagtcagctccagccccagatccccgcgtgtctgggagatgggcgagggtcagggacaccaggtttgttcgaggtggggcaacttcagtgacggaccctcccgtgagaccccttcccatcctcccagctctgggggccagtgctgtgtttgctcggccgggggtggggggggggggggaagaccttgggggaggcgtgttagcgggggtggcccactgaaaaacccctgagctgcgggggcgggttgtggctcggggatccgggacagcctccgggaggcagtcgatcccctactcagcgccccctccgcccgctcggattctctccggtagggggaaagggggcggggagcagaggtgtccctctgacggcggcagaagagaggcagacagactgacagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcaggtgaaacccccaccctgtccctcagccccctcctcctaaagacctgtccgtgcccggggaaccccgaccgaattggaaagtggttccactttgtaactccgcaagttggttgcaaagcagcattcaccttccttcctctcaaccatctctcctcctctgttactcccccaccccacctcctgccctccccgctctcggttccctcctccttcccctcccctccacctcctccccgcgctccgctggtaccccacaaaaaatgggggtgggggtgtccaagggaggggggaaatgctttgggtctcgtctctgcctctctctctctctctttgagacctaaaaatcctgacaagtgaaacttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccagtaagtgaggccgccccactgcggggccgcgggctgagctcaggaggtgcggcgagagccgtccagaaggcgcggcgccggcaggctgcgcgctgggcatcagggagggcggcccggcagcggcgccagggacttgggtgcgggagctggggatgcttccccctgctcggctgggggtccaagaacaggcacttggtagcgctggggtcctgcggtcagatgcgggtactcggcgtctcctaggcgcggtggactggcagctctgctcggcgcagaagacctcggggagccaagggaagcgaccccgagctcaaggagcaggggcgagcagagcgcggagaggctagaccgggccaggagggaggctgccctgttgggaggcactcgagcgcccggcccggccctctctccagcggagtctgggcaggtgggaggactcgcagttccagaggggactctaagggtccgagcaggtgccctcactggggcctgacaggagagaagccaagaggcaaagcgtctgggggctccagcttttggaagtcaacaccccctctcctaacctctccaaactggggtctaccgtaggaccccagctcccggcctgagcccagttcgccgcctgtggccagctaatcctaatgctctgacccgggctgggcacgaaaggagcagaagcggcctttcccccactgcgtcttttggttcgaaagagggaactgagactgagggagggcagccagggttggggctgtgagcgctccagtacagccccctcgacggtacggcctggggcaggcgctggcagttccccgcggatgggcctcttgggccccagcgctaggctgcctgggtcaggagggcgccgtcggttggggcgggccgggcgggccaatggcgcggaaaacaggggtggcctggctcggcctggccccggccgacgctgtgcgtttgtcgcttacagtctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggattttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctcctttttgttttgttttgatttggctttaaatggctttgaggggcgggggcttgggaggatcttgtctttggtctgatgagattcaaattgtttgggtttgagctcaaaggattctgaaccggttaaggaggtaaggaggccaggcccagagtccttgccccacaggaagagggagttttgttctgcctcagaaattgtgtggaaacaaatcttgagcagtcctgagactgcagtggaggaccgaaataccaaactacttccaccaagagggagagggagagaggaagagaaagagaccaaataattcattttctgagtcagacttctgttgataggagtctcagaactgtctactgtggtctcacaaagctgagccaaagttttaaaacagtgagagaggacacccattttaaatcagtctgagtgagttatggttttcagtgaatggatcacctctgtagatttgaacatcaaacctttatttctaatcagtggctgagctccttcacagaattcggtgggaggctgttttcgaaagtaaggaagtcattcaggggttttgtttctgtcctaaaacagggacccctctaggggaccagcagcagacgccttcagcccctgctgcttttggctcctttggcctccaacggggtaacactgggtgacaggcctgaggacatcccaggaaggactttgggagctgagatttcactctttgttgtactgggttttatctctgggatcctaaatttttgtagtaatgaatctttctcctgtttacagttcttcacctcccagccactacctcccacgccaagcaaaaaaaataaataaataataaatcatttttgattcctttcttccaacctctaatttcctggtttcctcagcgctcagtgtttgtgttgggagacccattagggatgagagagaggggagaaggaatggttttgaacacagaaaaattgtagtcccctggatgggctgtagccccttccgggtcacccttgccaaatctccggtcgaaaggcagctgagccagctgcgggcagacgcccctcccagcactttcctctaggcctggaagtattggattatgggcaattgattcttatttggcatgtactcacttctcgcccaggttttcaactttctttttcttcctctcttcccctctctcatttcgttattcgtctgcgtctcttcccaatccccctctccagctcccccaccaagagcttgtgaggaaagcagactggccggagtcctc

SEQ ID NO: 13223 - DNA, 19472 bp, Human
atgaggtcttgcctgttcgtatgcgaacatccttgtacccgcctagcagccctgcagactgcaaattttccctgggtgcacggaagtagagcagatttggcgcagaggtcgatactcactgcctgtctgtgaggggggaggaggattccttcctggtcaagttgccgggcatgttcattccctcccgcaagcctaaggcagagtcataagctcccctccgatgcggcaaagtctcaactaatttatctaccagccttaagaaggagctgctgcttctaaaatctttagatttccgaaggctctccttgtgtaaaaatgccaggcggtgccacacgatgtcacccaacaggtattggaggtcagaccaggctgaaattgctatcaagtcaaacttcaagaagattttaaacatttgaaaccaaccaacaaaaagggacaagttcaagtatgtctagttgtgggatttcccccaagattccgattctaaagagtggtgttttagttcatctttacctttcacatcctccattctgttaggtaattttgaatttagagtgcatcctaaccatagaagtgggaatctggagatctgttcctttgcagaagcatggctgatcatagttttttcctgggttcttgcaacttactgacctgagatctgggaccagtcagcttctctgggtgtagaccgcagccacacacatccctggggactgttggggaagcagcctgaatcctgtgtgcacaaggagccttctggattgtcaagtagcagtaacagagttcacgaccccaagcagtacaaactcccaaattcacgaaaatatttctcttcttgtttattattttgattcacattctccacaaccctaactgcaaatattaataactttggctgcaaaaaagcatacggtacactttagattagacttacagtgaataaaagtgaaaattcagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatggactgaagtgaggtagaatcggcaggtgacacagatcctctcctgacagtccccagaggcccgcatgacagattttgctaagacaactccctcacccctgtgcacggtggcgcccgcctcccacctatagccttaacttcaattctgagatgtccatcgttccccggaggaggtctcctcgggccccttctcccttcgagtcattcacattcagaccaaacgctttcatttgtttattcagcattttaccagcctgattttgctgtctttttgtgccgcttctgggaagatgtcaaacacccattttcattgtatttagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatgggtgagtggcggcgggggactctgtcagagccgggaagggagggagggagcgagcgggcaagggagggagggagggagggagcgcgagggcgcgcgccactaggcgctcacattctctattgactttgctcgtgttcctacaagttgtaggaacacgctaagggtcagcggcgcacagcagttcaatgtgaacgctggctactgggtggctgttgatgccattttctgattttaagagaagggagctgtggcatcagcgagcccctcagcccgagtagcaaaccaagttttgtttcacacgcgcgcacacatgcaaacaaaacaggaaaagaaaagaaaagaaaacaaacaacaacaaataaaacaccctctagcttcccctagactttgtttaactggccgggtctccagaaggaacgctggggatgggatgggtggagagagggagcggctcaaggactttagtgaggagcaggcgagaaggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtacgggacgggtgcgttcgcccagtccccggatgcgtagggaggcccagtggcaggcggctgtcccaagcggcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctacccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcacattctctctctctctctttctctctccattcactttctaacttaacagacttcactgtatatatcttaggaagggaagtggcatcagccactgcagtgatggagataaaatgcaggcaattccatgctgtccttttactgttcttttcagttttccctgagcctgccactttcctttggggtccccgggtccccgggtccccgagaatgcaagtggatatctatctagttcctgcatgttttaagcagtgccaccccactgtttctttcctttctcacccctgaccttgcctagtcctaagcgtcctttctgccttgtcagaaggattccccgagccctcctgcccagtccggcttccgcaggagacctgagtttgttttcttttactgagtttttttttttttttttaaggcgttaacttttttcttggtagggagaaaagaaagtctgaatgacctagatgcagaatttaaataatgtgtagatagtccactttcttaatttctcagcctaaagttttaaaagtgtagaggaaaaattaaataggaaagggggaaatagtttctttaattacttcctgcctttcttggttgccaccacattggcacaattatctttttaagtaattaaagcagggctctgatttctcatcttcttgttttctgactgcaagtttacaagagcccagttttgtcttatttggagctacttggagccatagttggagagagtttgcccttgatttataggataaactgacctcactgacatttaaaggaagcccctgttcatgggaaagtgtgagatcagcagaaatgggggctcacagggggatctcaatttcttaagataacttcaagcttgtgcccaccgactgccttttgtctgggaaggcaaagacagacaggcagttctggaccaaaacacagtttcctggtgcaaatgggactcaatctaattcttgggggtggtagaggaggagacatagtgaaaaaaaaaaaaaaaaaaaaggctgacagagtttaaaagaaaacttttcctgcctagggatcctaccatcagagcaaatgtcagttgggaaagtattggagaatggaaaggagcaacttttcctttcagatattattgtgattttggatgccagctttaaacaacccagtttgtgacacatttgtgattataaaaatgatcatttctacaaaaatgctcactcttttaaagcactgtgttagatggaagtgtttaaaatcaagttacaatggctttgccaaaccactcctccacccataggacccaaagacaaacatacattgtttgtagccttcacatatctctttgaaactatacctggtcactgaaaaatgccaataattcaatattctcaaccccaggtattatagtaattactttacaccatacaattttctttgcatctccaccaagaacagaaagaataactgatggcattacaccttaacacttaattttactttcattttcttaacctatttcattttctctttcttgtatatacattttttaaactctttcaggaaaaccctgccactaacacccatggcatgtatagtggtaattgcaagatttatttttaagtcatatgcacatatcacatatgtaatgtgtagaggtagtgtatcaaggggagccctatgcacacacaaagcagaaatctgtgcatgtatattttgcactgtatcgtgggaataatttagttatttgtttgcaaaggacagtgcaggtctttttgttctctattgacataagtaccagatccccacagtgcagtgagcaccagtgcaggcacccttaggtcagacgctcctctctttcttttcagccagccccactgccaaattgttgtcaacccccagtcggccttgggttaagaatgaggaggtggagaacggcacgtgcagccttaagggttccttctccgatttaggtttcttccactcctttgccctgggagagcaaaggggcgaagggaaatcaaaaaccggttgaaaaagaaaaaagtgtcttccctcaggcgtgggtcagagaatttggaaaggcctactctgaggggagtaaaacttcaccaggccctgggctggaagcacaggaggtcgcggctgggcccagcgccctcgggaggccaagggcagggagccgacccaaggtctaagccctccagctctccgtcgcgggtttgggtcccgtctcaagagtggggcgcgcgggctgggcctccggcctgacaccctctcttctctccatcagtgagcgacagctccccctaccacagccccaaggtggaggagtggagcagcctgggccgcaacaacttccccgccgccgccccgcatgcggtgaacgggttggagaagggagccctggagcaggaagccaagtacggtcaggtgaggaggcgagggtcaggccaggtgggccgcgtggcggcggggatttaggcgatggaacactttgtgatgggtccctttctgagcttcccgcgagagaagcccaggctggcgtccctttgctgctacgagccagatccttcgtggactggggcgaagcagaggcctgagccttggaaggcggagctggggcctcgacccccgccaggggccgggagcgctcgtcagggcgctgggggtctggggcggcagctccccggggcgaggctctgggaagcgcctccaggcctgtcggcctccgggagcttggggaggcggctcccgaagccctttcggcggctctcgttgggggtagagttaaccaaagaaggcgcttctgaagggccgggcggagcagccctggggcctcagagccgcgccttcacgcccgcgaaacgcgcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaagagttcaaaactctcaaaaaaccggaccttaaggcaatgtaaggtttccccagcagaccccagtaggtttgcaaatctcttaatcccaaactcaattccaaagcctcaagctattcagttttccttttattattttgaagacttaaaatttttaatgcttttttgtctgtcaaaatcagcttttaaaattaagtggaatttgttcctcttattcacttgaaaaaacatcttagtcattattttctgtaacaaatcccatttccacttcctcttccctctcttattttgttgaaatagaatcagaatacatattagtggctctccaatggcaaataacacagaaaatagcaaggaaagagagcccttttccttagtctgtttctactgtgaagaatgtcaatgagaaatgataaggaagtttgtcattttcttttactaaacgacccacccttaattcgtaatttgcaaagaaaaggcagaatagtacaatggttaggagctccgatctctggctgtacgacttcttaggaaaatatttaatttttagtctctatttcttcatctttaaaacagggaaatgatattcccaacccagagatgttatgagtattcaatgagataatgcaaccatatggcacatagtaagcatttattaagtattgtctgtggttctaagtggcagttaaaaagacacgtgtaaaagtaagtaatatttatcagagtatactttgttctgagagaccatagtcaaaaagcttcaagagattttgttacaaacaatagaaagagtgtatataaagcacctaccatagaagcaagcatttaataggcgctcagtgctttttattaggtcatcattgattggaataacattgtgaagtatagagttgaaaaagtttctaattcccacatgtcattgatgaacccagtttatatatcaagcagtcataatcccaaaaaaaccctttatacttattatttatttatttattttgagacggagtctagctctgtcgccaggttggagtgcagtggcgcgatctctacttattgcagcctctgcctcccgggttcaagcggttctcctgcctcagcctcctgagtagctgggattacaggcacgcgccgccacacccacctaatttttgtgtttttagtagagagagggtttcaccatgttggcctggctggtcttgatctcctgacctcgtgatccacccacctcggcctcccaaagtgctgggattacaggcgtgagccaccgtgccggccagtaatttttattttctcttccttgaattatagatctaacattgaaatttgtttggaaatgcttaatttataatacacttcaaaactaaactgacaaattatttaaaataaaaaatttgaagttttaaataattgatattctgattattaaaaatagattacattttatatactaaattttaaatcactaaattatcacatttataaaagaatataatttaaagaaataagtaaccaaataaatattgctctaaatacttaataagctattttttccagaataaaaatatttatatgaaacttacatttgcgaagttcttaattgcaatatgctaatcttctgcattgcaatgtatttaatagttagataattcaaatgatgtaaaatttcaaaacctgaaaacttcctaagaataatataaattagtggctactctatgataattatcaaaatagtgcttaatgttgaagatgtgccaagttcagccgtgccatttttctgagcagttttgaactttagacattgatttcatgtaaggttaaattgcacattaatacttgtttataaacatacaaaggtaaagtgttgcccatatatgtgcatttctcttaccaatattcaaagggcagatttatttttaaaagttatttttcaaaatggaatcagcatatttcaaccaaaatgtaaactctggtaacacgtatttttccctctgcttatattatggacaataactcgaatgtctttggccaaaaaaaaagctttaaaatttttcccactttcagggcatttgtgattgttattaaatagtgcaaaattatatgatactagtttaattttattatacaaagaaggaaattgagaattcagaatcatagagcttaaagcatatttttcttgaggacatctgtagaattaccaaagggctaaactatgcaactgagtatagatactattgattaccataatctagagtttctattttcagcttaaactgtaaagacagatgtcctgattcctagtaattaaaactgtatgcacatttcagctatgcatatacctatcttttgtctttgaaaattcagtgtagaatattctaacttgtcttacatattaatattacattgtaattaatattttgcagtgccattcagaagtccttattgtctctgaggatagaatatttattttggcttttttatacccacagttaatattggggctagaagtacttaattccatttacttctgaatggcaacaatgttctctgcttcctgatggccggttctcttctgttgaaagcataaaactccaatggaataaaattgagtggccaaaaaaccttatatagagaatcatagggactggaatacatttgcccttttaggaagtatttcatgaattaatgcctcaattttattcaaactatatataaataattgtatagttcttgaaaaattttctacaaatgggcatactgtctcaagaaagatacattgcatatctgatactctaaagtaattggagtgacagatttataagctttgggtatcttcattttggggttgcagatattaatttggcaagtttaatataacactagctacagactgagatgtcagaaatagagaatagtctataaatacttgaactttttaaaagttcagaattaagttgtgaaaatagttgaatttaaagatataatctgaaattcttatgaagcatttacttgcacatgcatttgaagtgaagatagtcttctagaatcctgaatgtgattttctagtgtattattttaaaaactggctgtccttgtggatgtactattctcaggaagatataaatgatattgcactaaatttgtcttcatattaaagttaatttttgtaaataatttatgatttatagacaatgaaatcttaggcaaatgccagcagagtgtctttgaaattcataatgttatctgttatgaaaaacattctttgacctggttacattttaaccagtagtatttcaaaataaaattaatgatcatgtatcagtaaaatgtattgtataaaatagcagggaaaggtaattgcaaatttttcaaggctatgtcaattttaataatattttggaaaattataaaatttagaaaagcttttaaatagcggctttccatttcttagagacatttacatctacaatatgataagtaagcataattaagatcttgttggatgaatgttgaaaccatatttataaccatcatttcattttgtcaggtatgttttactaggtcattgcataatgcattaaaaatggaagaatgacagaaaaatgagttcaccaaaaaagagaaaatcttgtttattttcagatccaaaactttttcttgcttatgatatcgaggttgaaattctaggtgaagcacatctctatttgtggctaaatctactttattataaagccaaggtaaattcattttatcataagaggaccaggttgaactgataagtgaaagcagattgtgggtagaggacctggcactgttatttgcatttatcttcacgataaataatgttgagtagacaattcccagaatttgaataatggtctataacctctaactgccagacatttgccataccagttttatggtggtcacaagtgttttgatactaacgtattttcctttacttggaggagggaggataaatggaataaccataaatcaagtaataaatggctaggttagaacttctgtttacttttttcaacagctttattcattttgcttgcttaaagtgtaatgcttgttttgtgataaacggtgcctacatttttgctttgttttttaagctacagtgtcacatcttttgctttcacaaacctatactaacttaagtatacatatggttgtggaatgcttatgatgtatcctgttttgtggggatacaagatgattaaggcaagtccctgtcctcagacagtttacaatctagccctctgccaatacagttcctcaacatattcaccaaagttacttttaaaaaattggtaaatctgtattttgaacatttggaacaaacgaaattaaaacttgtactttcattcttcttgtgataaccttaactagaagaactacattgcatcttatatatttttttctagactatttccgttaatgtcagtgtgatgaagttggtcttttcctaaaagtattaaaacaaagcagtaacttactttttctagggtatgcaatttagtctattttgctttgtattagtaaatctccttctcaaatttaggtagaagatagtttgctatagagagcacccttgcacagttctttcaggggaaagaattctcatgcctttcatggaagatccacatgagaaaggagttgatggattgaagtcttatttatggaatctttaggtaaagtcattttcaaaaatgagatttccattacatgcccattgctggggtttcatttggaaaatttgtttactcttccctggggattccgtatgttggttgatttataaatcatatttacaatccaattaaatagagtaatttagcatgtttgctcccactatatttatagtgtagatttggtagtctctactcagcctaactagcttttcagattaattacatgcccttcactgaaaacattaaaccgatttgggacgtttaagtcatgtactcttttactggaaagaataaacaaacatcaatgctacctgtagttgttttcctttgcggtggaaaattttactttttcagtgattgcttcataaataacaattacttgacccagtagagatttatatcttttactaatgttatgtgtcaaaattaatagtgagaaaattgatgtgtttattgagtcactaaaatgaataaataatgaaggtggcaggaggcaggtaaattttaaagcacatttacttgctccttttttttctaaatttataaatctgagcttcaaaagtaaaaagtaaaattaagacaaaactctccagacccccaagctagggtcataatttaacctgagagaaaactaagggctatttttatactgtttaagtttaaagatttatgtttgtttttttttttaagcaaacgttttagcctctccttgcctttttcttttttctttctttctttcttccttttttttttttttttttttttttttttttgagatgaagtctcactcttgttgcccaggctggagtgcaatgatgcgatctcggctcactgcaacttccgactcccgggttcaagcaattttcctgcctcagactcccaagtagctgggattacaggcacctgccaccacacccggctaatttttgcgtttttagtagagacggggtttcactatgttggccaggctggtcttgaactcctgacctcaggcaatccgcccgcctcagcctgccaaagtgctgggattacaggcgtgagccaccgtgcccggccgcctttttctatgagatgaaatcaaccatctccgagcttctcttcctaccctgtctttctgcagtacaaagggattgcatcactaaaatgatactaaataaatattgtggatttaagagaactttgaaatatttagtactaagaataatgacataaagcaagtttgtgcattaagtatgagaagttggacaaacatggaaaaatttgctcatttttttacacttgataaatgaatgtaatcatggaataaataaggcactagaagttaatacaggcctaaatccaatgtcctgcctgcccctaaattccaggaacattatctaagataaaagttcaatgcagcatgtctctgagggccatcttccagggggaacatctctgggcaaaaagaagtgggtccatgtaaggggaccatagacattgcaacaaaacaactgaagagtccaagtaaatggggcagatcaatgagcaagagttccaagggcaaaggtgtaagaaaagggaagatgactaagcaaggatttcagagagaactgtaattttgaatgatagataaaatacaaagaaaaaagaatgggtaggaaaaatttagctgtgatgaaaaatagaactcgccaacagttctgttctgctaactagaacattgtttctgccatgtataatattaaattttttaactttatgtccctatatgatgttggccaaagatttttattattttagaagtaattttaatgttagcattcttatttcattattcttagttcacattggcatcagtagtataaaacattagtcaatgctggaaatgaaaatattagttaacaccacatacagatgtgaacacctttccataactgaattggatttatttctttccaaactcatttatcatagattattgggacaattctaaataaaaatgattaaaactataatctctatgcaaaactagattttttcccctgtaatttgatagttctctatcttgatacccatctcctgagagccttaaagtgtgtctcctttgagacataatcagccattctcaaaaagtggaagaaactattctttttttagaagggatctgacaatgagaatcatgttctaggagagaaaagaatttgttaccagatgttatctcaaaagatgcactagttttaaattaaattgcatctatcttttaagtgttcaggaaaaacagtatgatatgctacagaggaccctgcattgggcaggggtgataaatttttttaacacatggccactggcttgccaattggttgagggtacatggctaaacctcttaatctatatccttgtataaaaagaggataagatttcatttgtattcaacagttatgtgcggtagtttcttgatttaaaaaatgcagcagcatcattctctgggacccttaaaatacactttaatttcagttgaacattgtgttgtatttgtgacacactatcttgtaattatgataaactcaatcatttataatgaactatataattcattaatactcattactcagtaaaatatgttggatatttcttggtgcctgggacataggacacacttaagaaactttagcttcctttctctttccctattttcaaagaaccaacattgaaaaacacaacatgaggtgtttgttcttacagagcatagacacaaggctaacccctctaatatttttctttttttgtcagaaatgcatgagtaatgttgtcatacccacgtatgtattctattccatgtacatattcatttactctgcattgagaaaatagtttttgagaccgcaccactgcattctcatagatgtagaagtgaaaacaatagcccaaataaattaaattagaaagtaattcctgtgttgcaattgaacgggaaaaagtacctagctaacatacatctgattaacttaattctaaggattaaatcaattttcctcataaaattctagtatttacatcgtattttcactaggaaatatattgaaatggtagttcattcatgtaactatcaggacacagcatctacactttatttctaaagagtataaaaattgaggggaaaaaattagactacttgaagaaggatgcccagtgttcatgccagaatcaggattaaaaatcagggtgtttttagtgttgttaatagtaacgataccaacaataattcactggatgccaagacagcactggtttctcggcaggctcgcctgccgggactgctgcattgtgtttgcaaacaaagattttaatttctaaattcacttcaagagatttatccacgtggcttttaaaaactcacatcacaggacccaaaaactttgcaagcaaaatttccagtttcaaaaccaggcatatgcagttcttttatatggggaaagacagtttcctttctgataaaacagtcctggaaaaggcacttgcaatattcatttaaaaatccttacaagacaaagtgcctgatttttgtatgtcctttgtccaacgggcattttcaatatgatctcttaaaatatggtctatattttctttaacgaaggtcgtgtttgttgtgcgtttctaacatgacaggctgcagtctgtgcccttctttactgaaaatgaaagttataccaaccaggcctgtcacaagtgcctcaacaaaagagccaaacaaaacccaagtcccaggaaggttgacaaaggcaatgaggacagccgaacagattctaagagtatttaattgccattaattcttttctcaccctgcacctccttcctgtacttccaagtggcacaagcaaatactacgaattttctggttgcagctttctctaaatgtttgtggaaagaataatatcttgtcattatgtttgtttaagtggcaagactgtgaatgtctttagaatataataaagctcaaatttttttaaaaagttggagagtagagtcagagcattgctggcttactcagacttaagttctgcttctttctaagaacgtgtgaaatgttcactcctataatgtgattatttttcacttcttttctactcctctcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttctagaccaatttatttttcactttaatgttaataacagttgtggagtatatgtgtgtgtgagcatgtgagtatgtgttgtattttaaaacaattgattttctggggcaaaattctacagtttttaatcccttctgtttaggaagttcttcctgtttggcaatataggcttaaaaatatgtttttaggacattggtacaattcagctgttggaaaattaatatattgagggttttttggtactaattctgtgcaataactaaaagagcacctcactggatatggatgttgaagatggattccctaggtgattttaatttcttccggtctgtgctgtgcacagtctacatggcaatgcggttccaccacatcggtttcgtggcttcgtttaaaactcagatggctagattagttaggttttcaaatcactaggatgtaaacagtaagcagatttctgacacacaaattatgttagagtgactgcttttttcagacagcagatatcttatagagagctttgaactgcatttatttctaaagcaaccgaaattcagtgctacaaatagaggattataacttcaggagaagaataagcagaaggagcagatgaactctcagggccatagtcttcctttgatcttgtaaaacttccattgacatctggagttcccagtctggtgagaaaatagactataaactgaatggaacaaagatccaatccaatattttggtggagacttctttaaaaccataccatacagggactctcctgtcatctgaaaaactgatgtaaggtacagaactattctttatcaaatgtttttaggtggctgttagggggctttaaaaaatattacttgcttgtgtggaaatgcaaataatgttattttctttatctaaattaagaaatctcttgttattgtgctatttataatttttttctggttcttgtattttaaaaaatctaatattaatggtattgaagtttccttttctccctctaggtcttaacagtgaattcacatggagtaatttttaaaagatatcagatacaatttgctattcaaagaaaattatgatttaaagccactttttaaaatacgagaaggaaaataggatggattaaagggttaacttttaaagattattattggttaatgttgacatatttcctctatctcatagatggtaaaagtgttgcttttaaactggcaaatgcactcttcagaaatccttttctatctgatccacatggagaggttaaaggttcaatttcatgacctctatgcaggcagcgctctcattggatgtaagaatattacctgcaaggatagaatgcagttgtgcaacagagacacattcttatttcttttttttcacaattttgttttgtttttaatgacccttttattgaatattggactgaaatataaattttaaaaaacacgttggaaaggatgtacaacagaaggctatgtatgtatatacagtatgtcaaaagccttttatttttatacttcaaatgctctaaattaataaaaagtaataattaccat

SEQ ID NO: 13224 - DNA, 61042 bp, Human
ggcttgcactattcctacttatcaggatttcctgtttagcacgtatgctgaccaacctttgcttagagtattcataaatttcatagctcactgtccacccattatttgtatgaaatcacaagtagactcgtattcttgaccaatgactgcagtttttagagaacatgtttctttaatttctttttcctcaaaactcatgacttctgtacacaaattgctacctcacacatcagtttagtcaagtgctctagcccagtcccgggagagcaaaaggacccatttattcatttatcagatattatctgagcccctattatctgtccttgcaacagtgcttgacggtggtgttaaaaagctcagtaaattgtcctggaggaactaatttagtttagagttgtgcatatgtaaatctcataatgttcttgtagcaaagactagctagtgcctccaccagtcacgtacagggaaaaaaattctggaaattgtagtgcaaatcaggcacggaccaattatgcttttgaactatacagttttctgtgctgagactgggccaattctgatgaattctgaacaatggtaaaaccgatacctttaaaattcaagaatgttgagttctaatggcagtttgaccattgagatattaatataggaacatcatttagcctcttaagcttgaacatccattaagtgggaaaaatagtgctcatttcctagaggtcttcagattggctaatcaagttttgattttgctggtaagtaatgagcaaattttcttagatgtgatcgcttcattttctcttatattgattggcagcagccaaatgggcattccagtccctaatctcctgcaagagaaacacttctatttcataaatctggtaatttttgagctcttttcccaacagggtgctgcagctcaccaagcggaacccacagcattttctgctaccaggatagcagcttgccagtagcatatactaaattactgggtttcagtatgattttggctggtacagacttcaatcatcgaatcgacatgcgttcagccattctcataatgaatgtttccttctctttcaaacgttgtttccagccccaatctccaaattttttttttttaagaggtgaaacagaaactgtactccttaggaagaaacttttccttctcatccctgttccccataaaggtacctccagataaatctatcaaaagcaggacgcaactcaccaggttttctaaaacgttccccagtctcaccacccttcgtgacacccatgggtttcccaattcttcacctttctcttagacacaggcaagcacattatcactccagaaaagcagtcctggcttagccagttcccttccagaaggaccacgtggtttttggccccatggagccctgcagggtaggggggctcacggtcccgatttgcctcgggactcagggggcttccgagatgcaggatctcccgggctcgaaacgggacatcagtggacaaacgggagcgagggtcgaacgcgcggctccgaggaagaggaacttaaagaacacgggcccagcaggctacaccaggaacgcgcggggctctagggcgcgtccgactcctcccgcccttcgcagaggaggaaactgaggcacggcgactgtctcaacgcagtcccggccctgccccccgcggcctccctcaggcgcgctcccgcgcagccggttcctttgtcccggtcgcacttcctgccccatcctccgcctcctcctagccccgggccgggctgacgcggcgggagaggaatgcgtttccggagggagagggcggcggcggcctcgggagcgggatcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaaggtaggggccggcgggcctcgggtgtgggagcgcgggccgcggcctccggtctcctgtgcgcggcagcacttaaagccgccggccgggccgcgccgggacctttgtgccgggcgtgggggtgggggcgggggcgggggcgggggcggccgccagcggttgggggctggggcaggattccaggctagtccaggaggaagtccgcacgccgccacccgcctcgggtccccggcgctggcagcccccgggcgcagagccagcccagccgcgttccgaacgtgagggtcgccggcctgggcgctgtcacgtcggggctgccggagctgcgggggaccgggcccgaacggcccctgacacctgcggtctcccgccgggctgggcaagcgcaggtgggagccagcgaggccacccggggctcggcgtttgggactcggcgctcccctggacgggtccggtgcctttgtctctcgctccctcgcgagctgctgtccttggagcagcgtcgagccagccgtcggcgcccgcgacggggactggtctcctccggctgccaggaggcggccctggggccagcgccgcgggcgggggcggcgggagccgggtagaagttggcttagtggagccgctggggaccgggggtgcggtggcggcagtgcagtccacttccccgtgtttataaacgtcaagagtcgccggtccctgccgggcaccccgggaccaggacgcatggccatggccagcttgtgctcagacccggtccgcgagcctgagagcccggcctgtgtctagtatcattttaccgcgtgtcatttcttaggcttcataaattggatttatgagactcctactctctaagtaacttttatttaatcaaattcgtgcttttgagtccaaaactttgcactcattggtatgatcattagtaagttgcattctctaagcttccgtttcctcatctgtgaaataggaacagtaatatctacattaataattcatttttataataatgacagtgagggccaagtttagctctaggcattttacatgtattatttaattctggaaccgctctaatgagattggtactgtttcgattcccattttccgagtgaagaaactgaggcacagggagcaaaagtaagttgcctgtggtcatcaggagctcctggagaaggcatggggtctagttccagagtccgcgtttaaaccacaagtaaccttcctaactatagttctgaaaatcaaatgcaaaatgtaaaaaacttagcttgagagtagatgctcaatgagtattgactccttttcagcccttcttttatagtaaaaagatgttaaaaatatctcggaagataattggtaacatcattggtaaggtttctttgggccaacatgccacatggttaacttaggtgggtagaattactaggttatttcgttttgttttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggttttttgttttttttttttttaattgtagttttaatgctacaaaaataacatgctagaggaatttagattagacatctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagatgttattagaatgctagttaaaaggacaaagaatgtggttaatactttaattctgtaaacaggaagcaaatagattgtttaactcgtctgtgttgacttcagacctaaacctacaattttaagtgtttgtgattttcttaatgtaaagttctatattaaagttattttttaataccctcaacattctgcacatgagaagcatggaatcagcaattctgaaagtcactggatttagtaattttaacaattaggcagctttctggtcagtataatttaatttaaatcagccccgaattaccatcacgaatgaaaatgtagctctacattggtgttcttcctaactctgggagtgacactggggacatctggtcatattataataatgaaaagtggtcaaacaacttaacatggtgccagttttcctaagcgtgcttgccactgattgtaatgcttttattgtttggcttcttgataagtaagttatggcttacagcggtgagtagtatagtgttctgtctgaaaacatattcattaatattctgtagctgctctggtttgcccttaactatgctgctagtgtgataagctgaaacatcttgtaactggtaaaagtttcagagaacttaactttctgaatatgtaacaagctgcatgtatctgaaagggttcatttagacttctgttagatattagcagattttctcactctgccagagagttaggatctgttaggttgtgggtggaatcctggagattatgccgggtaaatatgtaagtacctgtattgtattagcagtgtttactctgacttggttttaggttctgagagtttggctggttattttttcagaggtgggaggtatggagtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgccgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaatttaaaattttgattatgattgataatcttactatattgctgtagaagtacatgtatctgaatttataaattgcatttattttgggtacaggtatgcctagaatttttttgctgataaaggtgagtggtcagaaagctttgcagatccctatatggaggatgatttgagtggggttcaagaactactgtatttgggagggagaactgataagacttgataagagaaataaaagaaacccagtgtgacactggtttctggctaggaggtgctgttcactgaggtgagagggtgaccacaagctgggggtgctggttggctggagcagaggggaaatgatgaccttatgaggccaagtttttttttttaaggtgaccatgggacataggtggagatgtctaaattgcagttgaatacacagattgagagcttaaaaaaagaaaaaactctgagagatttcaatttgacaattcttagtctattgctggttgaagctataggctgtgcatgcaaacaccaaaggagggtgtggagtgaaaaacgggctgaaggaggacctgggaacacttttaatagtcaagggggggtggaggaagaggaatctagaaaagcatttaccttccccagtttcttctctgaacttctaattcctttgagtggcatttttgtgagtgacataggtatttctgggtttttccagtgattggcatgtttgagttaaagacagaaagacttcattggtcacatttctttgtggtaatttattttcagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatgtaagtagagtgcagttctctctccatgagcaactttttttttttttgtatcaccagagagtgtaggcactgtgccacttactctgttaaggatacctgccagcgctgaccagcaacatctgtccctgtcagctctgcatcaggatgtagcttggctgtacattacattttattctatcagtacattgagtaccagttacctgaaaaatgctttactcagtggacatgaatcaagaagttggcatgctctttgatgttgagtctgttgtctaattggaacaagttgtgttcagttcaggaaaacataaataccaaagagtgttttatacaatgtactgtaccataaaatactgtaccatgtaatattccctaacaatgttagaaaaatctcagcattggcttgtgtggttttggaacacgttgtgtaggagatgaggcctgagcttggaatggtatgagcgaaggttggatgacagatggttgtcacattcaaggacagcatgggaagaatccaatctaatttcacagatagtacctggccactttgttacctattaggagttatgtataatatcatatatatcagaaggatatgtgaaggctatataaaatgaaggcctgggttcttgccctccaatactagcctgatgagagacacagacatgaatacaattagttacaatagaagtttgaatagaaataacactatattattaagcatcactgaagatttgtcattcactctgctgggcactatcaaagctgttttggaaccacagagaaggagtagttaattaagttgattgtggttggtgaggagatgaagaggcaataaagacagaaaggaagaagaaaaatcagcattctattttgtgtagggagtatagtttcagtggagtgatgaggaaaatatttacatacgaaattaggtatgtaccatttgaagtatggaagtcacatttttctgtataaatgtttattgaatgaatatgtaaataacttaagctttcgtaatctatgaaattagcaatagattattcttctccatgtacaatattttatggtttatgtatgattttcttcatattatgatttcagtgcttcttttaaaggggtggtacagggtcatgtttgattattggaggaggaaattggagtttgaaaaagcacatttggtagtataatgttatgttagaaaaatgttacaaaaaagtacaatagggagtaagatttatgcttattaaagaagcatggattaaaaagattgagaaacatttattaaagagtcactgaggttcttgttttagaaggccatgattaatgagttggagaacaagaagcaaatttggtaatcatgtaaattatgagctgctgaccacctagaaagatatttgctgataagagctttcatataatgatcatattttatctttccaacaattagatactgtttacagcttactgatgtgtaaaatgagaaactttttttcctatgtttatcatggttttaaaacatttatcatgtatttaaaatactgtatgcactccaccacagacaggatggagaggaagatgtgacaaaagatgtggtcaaaattagttttaatcaaggaagcattttggaatgatctgcttaaaaagtggatataattacgcagtttgagaagataattctccttaattgaaattacggggaataagtcttgctctcaggtgcttattgataccgttgatcatgctggttcttttgctggctccactcacaattatctttgacaacttgccccaaagtaaactttctcaaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttatagtgtatttttctgcttttacgttcatcctctgaagtcttgagttaattttgtgcccctttacccccatttgaattaaatgcttcatttttttcccgtttctcacataaagctatttttttttcaggacagggaggggctggtggtggtggtggtgctgtaccagttgtctgtttatgagatcaccattagacaacgtttctcattggcttgaattatttgaattttgtgtgattttcctgttatgttgattctgttcttggtgtctatgagttctgtagaggattccagcctaaattttcttccttagttctgtttacttttcctcgacttttgtggttttgctctttgatcactgtcaagatctatttgagattttctgactttcttgaagagcagaatgagatctagattttctcttatttttaaagaagattcttcactgacttcctttcactttttgttctgtggaagtctttcctaggtgttaagtttccaggctttacctccccctacccccaacgtattatctttaggcattttgtttgccaatgcgtactatatccattatttatctttcccttgcacttgtagattgggtggtgataaaaatcttccatatttcattttcctggagaaggcgggtagagtcactagtgatgaattttatcttcaatctgttgtataattttcttaaagtatctcgccgtgttgtgagctgttctcagatttcaaattgttttgtgaacctatagctttggagcagccaaacctttgttgttagagcttcttagcccaggctatcattatcattgtgtgagaaggggttagtgctctttaaaaagccatttttcttctgggtgggagtggtgaattttagatggttttctaattcagactacttttctgtttgtcaaggagaggagaagaggacttcaaatgtggtgttacatctttgggatcccttagcctcttctctttcatgtctccttttttttcttctctattctttctgcgaagttttgttaatcattaatgctagcttattaatatttgggccataaacacctctgtagtgaccaacacacctcttcctgccagatggaaggaaaaaaagtgttgagttttaattgttcttcctgtaaggggaaaggttccctttccatgggaggaactcatctccacatgtcaccctctcagatggtacagaattcagaaagatttctcagtttcttccattcatgtttttctcgtttttattactctctatgtgggataagtgggaggaacctcatgtctttcaatttggctctgtgttcttcttctggaatatattgatttttaaatactaaaatctgttattggcctatttcttccccttttaaaagcagatacagaaaataatgatggtagaacagacttgggatgaatccaagtttattataatttttaggagacatttatgatatacctctataggtatcagaatcttttctactattaaggtgaaaagatttgagattttgtgaaatcttttgtgtattctttttatttgagttggcttttaggtggcttatttttcaactctgaaatgaacataacatgttacatatgttacatatgttacaatttttttctaaagtgtagttgtttaatttctacaaagatagtccatataaagtttctaaagattgtaaatttaaaaggaaatgccaaatgaattatttgtaaaattgtttaaaaaaattaataaataatgagtgtgtatttaaaagtttgaacatgatataaaaccatacttttatggataaagattagtttacagtgaagattaaaacaattatgcactatttttgacagtggaaacaattgcacatatttgggttaaccactaaaatgagattatttgtgggtggtgtttaagattgtttattgttcagggaatgaattatgaccccttagataaaatttcatatggtaaaaaatgaccttaaggtgaaatgcttttataggaacaagacacaaaacctttgtctgtacttatgaaatatggcaattaaaataacttttcttggcctctattaagttcaaatgcccaagaaataaactcatagaacattataagccctttccatttctgtgccctgagtcagttctaacactagaaggatgttctttgttttaaaatagtgattaagtaggctttgaaaaaattacagtttaatgaagtcaggtcatagcttctggatacagatggtcaggtttcaattccacctgtgcaacttttgattccaccattgcaagttgtttagtctctctggttttgtttcctcatctgtaaaacaaagacactattattcttcacctcattgagttacctggaggagatagatgctattattttatcattattattatcatatccatttgaaggtgctgaaataaaattctaattttttaaagttctaaatgaaataactttttgttacaaattactttaaatcatcaaaacttagtgtattatactcttcttcttgcctgtgcctagtctggccctctcaattgagaagtcagtctttttttttttttcagtaatccacagtgagcagcagtccctgaacgaaatcatattgctagttgggtttgattaataaaacacagaattggtattctagtcctttcaggggggtttgcttccttgtgatgtaagaaccttgtcttagtctttgtgctgctataacagaatgccacagactgggtaatttatgtcagggttctgggggctgggaagtccattatcaaggggttggcatctaatgtctttctgttgcatcatcccatggtagaaggtggaagggcaagagagtgagagaagagaaggaggccaaactccgtcttttatctggaacccattctccactcctgtggtaatagcattaatccattcatgtgggcagagccctcatgaccttatcacctcttaaaagtcccacctctcatcactgttgctttggggattaagtttccaacacgtgaaccttggggacacgttcaaagcatagcaaacctcaaagcttcctccttatttctgtttgtattaggtatgttattccctcccctcaatctttttttaagggtttctgtgatatcagtgttcagagcatttgtattttgtctactatgtttttatgatattagtgttcagagcatttgtattttgtctaacatttactaccttaaatattttgtcagtataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttattttttgatacctcagagtatctccagttgtttttatcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatgattcgagggcttcaagagttcatgcagatgatacttctcacaccttggtctggcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctctactaaaatacaaaaattagccagccgtggtggcacatgcctgtaatcccagctactcagaggctgaggcaggagaattgcttgaacccaggaggcggaggttgcagtgagccaagatcatgccactgcactccagcctgggtgatcaagtgaaactgtctaaaaaaaaaaaaagaagtctttactataattcttttaaaaaaccttggttcatcttgaaagactgatgaatttttgaaatacctgcagaaaaggaaaataatcccccccccccccccagaaatacatacaaaccacttattggcacttgtgttttaagtacctggagaaaaacaggacagatttttaaaggcaattaataacagcttatacaaggccttgtttcatttgctttagcaccaagtaaagtaagagtaaatatgctgtggaagatggtcaggtttttcctccttctctcatatgccccacttctcctaccaggtcacagtacatcagcagccatccttgttgccccactgaggaatcactttagattccagtatttaaatggctgctcagatgaaaccagtagaattctttccccttaagataaggtggcagtgaatgctagcaggtatcaatttctttgatcaggaacaaagaactccttcagaaaactcacttttttggtctttgttaacctatcctgtgaattctttttattggcacaccttgtttacgaatcatgattgattgctatttatgccaagggaacattccgcaggcatgcctgatctatttactaatgacaaagtatgcttactttacataattccataggttttctcttttatttttgggaggaggggtataataacttgttatttatcagggcagatcatatatttggatcaaaaagagaaactggcaagtagatcctaaaacacatttcttaacccgagtaacatctgaaaacatagatttcaattatattttgttgaaaattcattcaactttggtgcttatccaagaacttataatgtcaatttctgacaaaaattataaccctcaatacatatgtattttcaaaagaagagtcatcttaaagtaatatttttctgtatgttaattgatacatttttatagcaaattgaaaattctgagtaaattgaaagtatgtttaacaacaaaataaatacagcatatatggttagcttatatatttattagtgtaaaggcagcagtgaatttgtatcttacaacaaatctgtgaatccagttgcttttttttctggaattttatgtagtatcaccatgctccacaatgctagaaatgtggcattaatctgcaaaaatttctgatgagatactttccccaaatgacatgtaactttttaaaacttttccaaaaaatatggacattttatcaatcacttaatcttttttttttgagacagagtctcggtctgtcgcccaggctggagtgcagtggcgtgatctcagctcactgcaagctccacctcccaggttcacgccattctcctgcctcagcctcccgagtagctgggactacaggcgcctgccaccacgcccggctaatttttttgtgtttttagtagagacggggtttcaccatgttagccaggatggtctcgatctcctgacctcgtgatgcaccatctcggcctcccaaagtgctgggattacaggcatgagccactgcacccagcctatcaaccacttaatgaacaaaaagttagattactaccaattgttcatttaattttgctctaacgtgttttaaaagttaagacatctctgatggttttgcaggtgactggataaaacacactagatgatttcaaaagattaatcttagtatctgactcgtttggcacatcctcagtatccagaataaaatcagtagaaataaaagtaatataactttcaaagaattcatacatgctggaggtcttaggaaaagcagtttttaaattcaaggaataggaggtttgctcatcttactagttacacacatttctcctcatggagtaatggcagctttctggcttctttgtggaactttagtttgtagaaaagcttggtaatattccaggactggctttgtttgggcttcataagcctttagtcttttgataaccgtctctggtttatcatcctcatgctgaatgagaggatccccagtcagatcatcagtgcccacagttttgggagggttgaattcaatgttgtagactcagccactggcaggatgaatctagcgagcagtaaggcattgtttaatgacctcaaagggcacattcgggctaatcactttgtctgtctaagaagcttagtctagggcttctgcctgtggaagtgtccatggaaaaccacccaacagctagctatactaagtgagatttttcagctcatatagggccagctgagtcatgacatcatctcggatgagtttcctttggtcaatgaaagcgttagctaacacattaatttctgtgccccacagcatgttgatcctggagcaggtctccgctagagaggtgcttcacagtgtttggtgacgcgcgacaactagtgctgttgcctagcccagggcccccatgatcacggctgctgccgcgtagacgcccctttacagaccaaggcccacgccgcacccgaacaagggctttggcccagcctgtgaacttaccttctctgccgcccaggcccagccagctggcagcgctgctagtgggcggggactgtggctcccaggccttccctgaactctggtctagcagttttcttgtctctcaactttagtggccattggtcactgtactggaaacctcgtgtgtctttctcacatcctcttggcctctgattccagctggtgctgctgggaacagtcggtggctcactcctggctgactgcatgctgcctcaggtgcctctcttttgctttttcccctgcggctcctctaaccaactttcttgtctgttccctcttgtctgtcgctgggcacgtgcactgtagttcttagaagtgttagtggagttaatgccctttgaggcgactttttacctatgcaactggagttgatccatttccccgttgactttcactggacagactttctacgtacttctcaaaagttttccacaagatcaagcccccaggtactcagtatggtaaagatagtatctttgtattggctttttctctttttcttggttcactgtcttcaaagtgtctctctcttttcctggggtcaccttccaataaactgcctgcacaccagttctgttcccaggctctgctttggacagaaccctagctaaaacaatgacctggtactgtatttttaatacaggccttttcccccaagactgcctgtctctgaaattgtaaattcttaactgtcgtaggttccagctcttttcacttccttgtttccgtggtcccctctcctctcacctccctgttgtgatgtctggtcttttgactttttcctcttgttaactttttggtagcactgcaccttctttgccccccacccccacctttcctcttgcacctgccctgcacaccagggaatagatttagtgattccaaattggagtctgagggaccatgggaggtattctcagagatttgggcatttctacaaaatttaaaaaaaaatcatgctttcatgttaataataaacatttagtttatctggttgaccatcttataacccagtaatataacttcagaatctatgtttgtacttggaagttaattttggtttcataatgtttaagagctatgagcatgagacattttatatctatctataagttggcttatatacttaaagtaattgaaaatttaagttgtcacttggatgtctatagtaacacttttctgtttagagaagttctgcacattaagtaattctgagacattcttctgagtaatgtcagagaaaaatgtcatacaattcaatatggttcagtgaaaatatttttaattttttaactttttgaggcagggtctcactccattgcccagcctggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccaaaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagtattcttttcatcccaatcacatccattttcataagttcggttagcacctagattatgacaactctcatgtctgtgtctctaactcttgacttatctcctgagatccatactcatgtcctagcttcccaataggcatcttccctagattttgcaataaaacaaacctcattttttcccctaaccccattctccctcgtacatcttctttattttaaagtgatgattattctaaattcctttctttctcccatccttccttctccaagtaagcagcagatccctcatagctaccttctaatcattgtttgttcgtcttcttgtttgttgctgttatctgaatttagacatttgtcacctctcacttgaacctttgcagtaaattctgtatttgtcttccagctcctgtcttgccccctgtccttttctccactgagtttctgccatgtatatgtagaggtattactagcctgcccaaattttttcagttcccttcctatttatagaatggaatccaaactcttttagcatggatggtatttggctctctgtaacgtagctcttcctgcttgcttggtcttcgttcctgttatttccaactcataatttaagtctcagaaatacttcaagattccttttggcctttctgatattttaagattttaagataatataacttatacttacaatagaaaattataaggataaaataatcactcattccaccaacaagatatagttacaaaaacatacatttttctagtctttttttctataaagagagaaaaagtgagacagttccaattttgggttgcagggagctgcccaaatgcatatgcttagaaataagattaggaaggagttattataattcgcctcgggacttcatggctttgtatatgcaggccttttgcttggaatatcttctctccacttttctccacacccatctcctatgtgccttcaggtctaactgaaacactgccatgtgcctgatgcctctgaacttgtccaggcagatttcagtgtcctcagtgcactgtgtccttgtttattactgaaaccatcatatcataataatttgtatttttgtccttgaactgaaagttccctgaagcagtgacccttgtatttcctgatatggctcaaaacctgacagagttgtctgaagaggaacctccagaaaggcagggggaaaccagtagagttcaagggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataacggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagtgattctcctgcctcagcctccagagtagctgggactacagatgcgcaccaccacgccaagctaatttttgtatttttttgtagagacggggtttcaccatgttggccaggatggtctccattacttgaccttgtgatctgcccatcttggcctcccaaagcgctgggattacaggcgtgagccaccgcccccagcctgttgttatttgagagagtatctctccttacagaaaaagtaaaacagcctcaggcaggtccaggtccttcaggaagtggtcccgaagaaggagatcttttaggagatgacagctccatgtgtcattggagacaggatatgcaggcgcaagacagtgacattgatgatcctgacccagggcagctgtgcaggctttaggctaatgtagtgtgtatttgtgtccacagtactgtgtatagtaatgtcagtaatgtcctgttcagtgtgtgttctgtgcagtgtactcacttgcccctctcactcactcactcactcactcactcactcactcactcacttacccacccagccatccagagcagcttccagtcctgcaagctatattcatggtaatagaggtgcatcaattttaaaatcttttgtaccatacttttactgtgtagtttttctgtgtctaactgtgcgtagatacacacatgcttactgcagcattccagttgcctgcagtattcaggacagtcttgtgctggacaggtgtgtagcctaggggcaataggctgtaccgtagagcctggatgtgtaggaggccacaccatctcggtttgtgtaagtgcactgtgatggttgcacaaagatgagattgccttcgcatttctcagagctctttctttgttaaatgacacatgaaggtactgggttgaggagagggaaggtaggtaggaaatggagaccagtgtagacaactgtttctaggtctttgaccgtgaagaggagacaagcgttagaattaggacagcaactgaaaggcatctttccctgttatcccctcatactctgttttatatggaatgccattgggaggaaaccccttcaggtccttttctcagcataagaatcacctggagtccaggccccatgctcagggattgtggattttaagcctagggcatccaggtaaacccaatgcagttgttctctaggcccacttagagaagtgctgtcctgggagctttgtggcgtaggacttgggcacctgttccttccccttccatgcgcatgtgcagggggcacccagtaccggtagaagggaaggccagcagcattgaaagcgaggctccctggccctctgcctctcctttcctgtccgggtctctgtggcttgcttccctcaggccacttctaactgtggtctcctctccgccccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttgtcaaggtttatagaaggaaaggacagtgacatttaaagtagtgtggctccgaatgttaggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatagtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaaaaaacaaatggccctcattgtctttatattgtgcatataactctttgttatcttcagattatatgaaactattagtattatttttatattcttctcatctttttttcttttgccttgagaaagtcacgttcttctcattgtgtactttacatccaaaattattttgtaactctttttttttttttttttgagacggagtctcgctctttcgccaggctagagtacagtggcgcgatcttggctcactgcaacctccgcctcccgggttcaagcgattctcctgcctcagcctcctgagaagctgggattacaggagtatgccaccacacccagctaatttttgcatttttagtagagacggggtttcactatgttgtccaggatggtctcgatctcctgacctcgtgatccacccgccttggtctcccaaagtgctggattacaggcgtgagccactgcacttggccctctataactctaaatgttgctgcattttattattgcaatgactaataagtccctaaacttgatgcagttagatttccctgttattggatataggatatttacatttttgctcttgtgaatatactagagtactatactgaatgtgtgtgtatatgtgtgtcaccttttatatatttaagtatttccttagggtaaattcccagtagctggattattagagggtagaaatttttttatggtttttgatataaattgtcaaattatttcccaaaaagttgtatcagttcacagagctaccagttggtttctcgcagccatctgctatagttttgttgggttaaaaaactttctatttttgctagttcatcttatgttgctttaatttacattttccaataacgattaaacctaaactttttttgtataaatttgcttttttgagtatttcttcttgtggagggacagatacttatatataattattagattggctgctagtccaagagcagtaagtagttaagggatcaagtcagcaaccagtggccgtagccatctttgaccaatcaaagatatagattcatatcatcgtgaaagctttgattcagagaaaatagttatatatgtacctaatggtaggaaattggggtagttgtatttagtatatagaatattacctaattttttggttagaggttctagaagacaagactttttcagtttgtcttatgccctctttttttttgttgggggagaggtggggggtctggacactctaggaaattaaaactgagtattttacttattgcatgcatagaagttgattttcttttcttttctttctttttttttgagatggagtcctgctctgttgcccaggctggagtgcagtggcataatcttggctcagtgaaacctttgcctcccaggttcaagcagttctcctgcctcagcctccggagtagctgggactacaggcacccacgacgatgcctggctaatttttagtagagctggggtttctccatgttggctgggttggtctcaaactcctgacctcaggtgatctgcctgcctcagcctcccaaagtgctgagattccaggcgtgagccagcgctcctggcagaagttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgccggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagctagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaagcaagtatatttagaagcaaatgaaataaatgtgtagaatggaggattatgaactgtccattattatctgcaaagactttctagaagacattctcactctttgataaaaaagtctcacaaaatgttggcatcatctaggaaagcagtgaaaataaagctgaaaatgtatttaacccttctataaagatgtggctccacatctggaataatggatacgcagttctgtcctctgaatcttgaaaaactacactgcatagagcagttcgatatcaggattggaaggacttactacaagtagtaaaaatgaagcaggagaccgtaaaagaaagtattgataagttagttacataaaatcaataataacaaaaacattctgtgtcagaacaccgtaaacaagatgagaaactaaacaaaggttccacttcattaatgtgtatagaaatccaataaaaactgaggaacataacaaaaaaatttgcaaaagacataacaaaattataaaagaaatggttagtaaaaatatgaaacaatgtaaaacctgaaattgataggcttcaccaatgaattgatattctaatttacacttatgaaatgagcaacagttttttaacattaaagcacttcggttggaaatgtggtaaaatggtatttgtacactgccgttttgtgggagcttatattagtagtgttgccctatggtatccatggggaattggttccaggacctccttcagataccaaaatccacaaatactcaagtccctgatataaaatggcatgatatttgcatataacctacacatatcctcctgtatactttaaatcttctctagattacctgtaatacttaatacaatgtaaatgctaggtaaatagcttttacactgtattgtttagggaataatgacaggaagaaaagtatgtacatgttcagtacagacacttttttcccccatttttgatccgtggttgcttgaatccactgatttggaaaccacagacacagagggtcaactgtatattacttttggatagaaattagtgtgtatagagaattttagaaatgttaatatgctcttcaacttagtagttaattattcttttgggttttattataaggaaataatcagatgtgtactaaggtttatatataagatcatcagcatgtgtatgtgcatgtagtacagtatgtgtatatgtgtacttggggtgtttatatgtgcatgtgagcaagcatgtgtgaactgtgcacacatacatttggaaacaatctaaatttgtccagcattaaatagagtacacttatattgaaatacataatcattaaaagctttttaattctttttaaaaagaatttgtgatgataagaataaaacacttaggataaggtataaaaaacagtatacaaaactgtacaactgtatatataaagtgcatcctcagtttcatgtaaataatacatgtattaatatatatatgcttgcttccccttgctatttatctgcataggaaaaagactggaaagaaataggcaaaaatgttagcaacagtcctctctcagttaacagattcagtgagttggttctttatgctcttgtgtgttttccagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttgtgagtatggtaggagttaaatgacaagaaataatactttgcccagttttaagagaactcatgacatttatgacagtcaagaatgataaattctgaattatgtcttgtctttgatacagaagacaaggaagataacttatgtctctctgtggctttcagtgtcaaggtgatccaaaatcacaggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtcctttccatttgttctctggtcatttagtgtggctcagtgctgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctttttctttttttagtgtggctactaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatatcaaaagagaaggtaaggagaagtcattttgaggttgtatagtttattcacagaatgaataactaatatcagaagatcaaggggttactgattttgttttcatgcaggcatttgggcccaagtttcaagtgcctatttttgtatgcctaagtggtcaagtgtcagatatgtcgtatggtttgaccacatgaaagaaaaaatgagaggttttgttgtttttcaaaaattttctaatggtgttttctaaaagtggtgtgttgggattacattggcaacagtggaggaaatatggagtgttgtgagtttgtctcaggcaaggcttatgtaactgaagctcttggttttcatatctgaaaatgaggatgataatatccgctttatctattgttacaataattagaattgatgaacttaaagcagtttcacttaaaaacttctaaataagtggtagctgctattattgttaacatatccattttatggggactacagtttatctgtagttaaggattatcttagcctttgagctttggagcataatccttaaaattttaaaggctttctgaatatattcagtgaaattgtatttgggtgtcatgattgtaaatttcgtggattgattagtatttagaaatgtgtaattcactaggatcttgtgctttggtaggtagtagtttaggtttaataaatagtgcagctttgaattatctgattcttggtattcccttccagttgttgattacataaatactctcattagtatgatgtttctcttaaaaaatcttatgtaaaaactattgtgtattctttaaatttaaatatcttcacttactgttactttatacagcaccgttaaattgatatttgataaataaataccatatataatgtcactgtttcccccacattttcacatttcttgaaacacctttattcacagtctttatatagatctttaacagcagtgtttttgaattcactaaggcacttttcagttatatgattaaatttttatttctaagttgtttgatgtataccacatttaaaatctctgtcattactagaaattttactactgcaaatatccattcacctgccattaggaactttttttccttttttgaaatttacctgccattaggaccttttacccttgtcatatacttactccttttacccttgtcatatacttactattttgctttttaaaagttttttaaaaacttatttacaataatagctaatacttaaagttttttcaaacctgtgggaatacttatttaatcggtgctaaatttcgtgttgtccttttaaaaaatgcaataattaattgagatgtttttaagctcgtctgttttccctaaacatcgggttgttcagcatattgcgatggggagagtgccacataatatgagacgctttgtaaggacttttcaaagggaaattttggagaaatgatctgatatttgggtgtatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatattgtttaaaagccagaattggggtacattagatgtgatttgatgttttgcaatttaattgcttatttgcaattattatgtaaaaaggtttgaccattacaattttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggtatggaagcccaactctgtgaatacctgcgtgtttacttgaggcattcgacaccagctttatgcaaactctgaccagtttctgttgaaggctcgtttttacatgtggactggcactcaaaaatgtggaattgtttaaattttagaaaatttttgcagatataacaattgtaagacatatttacttggaataatattaaatgttgcctaatattcaaagtaaattttgttaaagattcagaaagtattaattagctttagtgagttttaaaaatgaaagtgttcatcctctggtctaattacataatatattataaaagcaacattttaacctgttcttttcctttgtatttgtttagtattattaaactgttaaggtttttgtaattatgtctgttagtcccacatctaaacatgaaggaaaaaacaagccctcatcctcgcttttctggtttccgacctttcttgtcaggagaatggtagagtggccctgtcccctgacttccctcccggcccctcctcaaccaggtcagccctctcctcctcatcctgctctagcaaagctccaccatcgccttcagcccgcagacccaggggacccttgtcaggattttttttttttaactcttctgtaccaagtaacactttgtactttttgaaatgctctgtccttgatcaatgataccactcctcggtttttctttgtgtctcttaccattgccttccaggcctctttttgtgtcttttttcttcctccctttttgcagtccacctaaatgtcagttttcctctcgtggctttaaaacccaattgtatgctgcagcaacacagacttttcttgagctccaaacccatttctccaattgcctattagaaatctatatagagaaaactacaagttaaaattttaattacattttcatccaaacctctctcctgtatttcctaagtaaattacattaacgtctcttgtatctctctcttctcctccttcatcatctctctctgggtttcttttgtagattagctagtctctttgcctcataatgataataaaaataaaataataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgttttaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaactaattttttgtatttttagtagagatgggggtttcaccatgttggccaggctggtctcgaactcctgacctcaggtaatccagctgccttggcctcccagagtattgggactacaggcgtgagccaccatgcctggcccttatgacttattttataaacatgtgttgaatacccagattttatctaattgctaattagtatgtctgcacctgcccgtacagcctgatctcatcttagacctggatttttcatatgatgatgatctgctttccaaaccttatttttcccatttcatgcatccccagcttaacctcttttttgcctgcttctctccactcctgttgctctagaggtttagcaacagaatattagaaagatttgacagttatgaggcctaagagctgcctttcaaaaattagccctattttagtggaaacatttaaaaatagcacttgcttaaaatgttcttttattctgtaagcataattcaaggaccatggcattagggagctcctatcaaattagtgttttttaaaatggccagaattctagaatatttgtttattcatttgttcagcatgtcattattgagagctggtgtgccaagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggagacagcagctctctggggcttctttgatgaggtcactgtaggagtctattcttacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactcactcactgtggtcagaatagcaccaagccatgagggattgatctgcccccatgatcgaaataccttccaccaggccgtaccttcaacattggggatcacattttaacatgagacttgggcggggacagatacccaaactgtatcagttactaatcccattcatgagggctctgccctcatgatctaatcaccttccaaaggaaccacttcctaataccatcatgttgggaattaggttttcaatgtaggaattttggggtaacacagacattcagtccatagtaacctacatttggtaacatagatgaattttttaaacaatgcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctggattttagaaaagcccatgtgtcctaactttctggctttgtactagagatagaattgatgttattatctgaggcatcaccaggaaccttgaaattgctcaaagggagagtgtcttgtatcattttcctttggtcagttttcttctcactgtctttgaaagacacatctttctcctgtgtcttagtaattcaaaaagagagaactttttaagctctagtttttaacctatatgaatagatgtattttgagaagtgatacaatatttgtaattttaattgtaagattttcagtagcaagcccatccctattggttcaataatttgtattttatgatccatgtagcagctatgtattttgagatgacactttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatgatagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgcaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaagaataaagtaaatgagtgcataaacagtactgattgaggagttagaatgggtgaaattatccttaaacaagatacttatttctgttataaaaaaaggaagcctcatatggtgggctgataaagaaggtgcatggcatagaacatagagcagagatgggtggatggggacaagacagcagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacagaattaggttaaaaatacaatggtggcctatatgaaaattaaaggatttttgttgaattactgtgaatagtgttttaaaattgaaatccttttcttttcaagtcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtgggtgactggcttggggtttctcagggtttgaggttttgctgttttggtaagtaggggtcctgattgaaagtgcaggaaagctagtgttgctgtttgtgaagatgcagctttgtatttgcttccttctgctcagacaagggcctcactggggtgggaaagggatgcccagatgccactttcactctttgcctcaactccccgcccacagcatttggtagcacagtcagtactctttctaaataaataatttatctagtctcatactctttgttttatacgatttttaaaagcagtcactctgcctttattgaaaataaatattggcaaagcattcaagttctagaagaaatccaaatggtaaatcttggtctttttcttaagttgtagataatagaatatttaattactgactattctttaatttcattgtccttatatttaatatacatagataaacttactatttaaaaccttttgaatatggaattttttattcatacatgaaagtaaagagaagaggattagcaattcatgtatacacacgactcacttcagcagtttatatttgatactgttatttgaaagcagtcttgtaatctagttatatgtatgcaactagatgtaatctagctatatatggattatatatgtaatctagttatctaaagcagtcttgtaatcgagttatgtgtaatcttgcatgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatattaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactcatatatacgtataccataaaatatataaaaatgtaaatatacatgtgatttgcctatttcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttagacatttttacttcatgtcatgggggtaccataacgctttggaaaggccagcctaccatatgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatggttccttaagcaaatttgttcctagactgcatagttgattgtttaccctagtccatagttagctggagaggtaggactacagaaatgccattttgccgatggggaagacagcatttatttcgtttttttttggggggtttttgtttttgtttttgtttttgttttttagatggagtcgcactctgttgctcaggctggagtgcagtggtgtgatcttggctcactgcaacccctgcctcccgggttcaggcgattcttctgtctcagcctcccgagtagctgggattacaggtgcacactgccatgcttggataaattttttttttttttttgtattttagcggagatggggtttcactgtgttggccaggctggtctccaactcctgagctcaggcagtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggagtaacaataagttacaaatcttactgcaagaacggggtgaatggaacaggggaaaatggaagaaaatgttccaatatttccattggagatgaggtatgttgtataaagcattttctgtagaaaacattggttatttataagcaaatttagtttatagtttgagaaacattaaaataagtgagcaactttttgaaatattttttagtagatttaaattgtttagttggttgttaatcttttttttcccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctatttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatgtgtgttgtaaaatacaaaagagaaaatggtattttcagtatgtagaatctagtactaagaaaactaacaaaattacttcagattttattttcacactgtggttactttttgtaattgaaaatgaaaaactgagtatacattgaataccgctttctctgtaaaagaataggaagagggaagagtgtttaatccagtgtcagccccaaaagactaggcttagaaggctattgactatgaaagaaatatatggctttagctcactatcaatttttaattgtctgtgctaagtaacaatttaaatgttagagtttctttatcttccatgttgtacatatcctgttttaatcatgcaggtccatttttagtaaaatgtcatttaaccaaaaagattatcttgaaaatactttgcctttctttcctttatatttttaccagatacagaatcagtgcagtcagtgtccatgagcattatgtgttctaaaaatacacagggaacctgaaaagtctgcacatgtaggatatatttatttttaaatagtatactagttatattttaagtggtatacacagtatgttttttttcaacttccatacacttttttgcatgtgtttattgtatttttttaggttaacagaccattgctttaaatttagacagttcacctggaatagtaaatgtaatagcataccatttgaaaatgtaactaacgtgctctttaaaattaagtttattctgcctttccacatgtgtcattcactattcattgctagattacatttttgtcttgaccaaaatggttactttcctgaagaaatttttttcctagactcttgcatatattccgtatgaacttgagtggctggaatgtacatgtgcgcctgtgtatgtttgtccctgcttgcacatgtgtgtacactttactacacgactgtgacttgtggcatggacactcccacctaacagattaggagcttgaagagattttttatagttttattttctttcccagtttttcccttttaaattattattattattattccctccaagatgattcttcttcttttttattatactttaatttctagggtacatgtgcaaaacgtgcaggtttgttccatatgtatacatgtgacatgttggtgtgctgcacccattaactcgtcatttacattaggtatatctcctaatgctatccctgccccctacccccaccttatgacaggccccagtgtgtgatgttccccaccctgtgtccaagtgttctcattgttcagttcccacctatgagtgagaaggtgcagtgtttggttttctgtccttgcgatagttttctcagaatgatggtttccagcttcatccatgtccctacaaaggacgtgaactcatcattttttatggctgcatagtattccatgttgtatatgtgccacattttcttaatccagtctatcattgatggacatttgggttggttccaagtctttgctattgtgaatagtgccgcagtaaacatacgtgtgcacgtgtctttatagcagcatgatttataattctttgggtatatacccagtaatgggatggctgggtcaaatggtatttctagtcctagatccttgaggaatcgctacactgtcttccacaatggttgaactagtttacagtcccaccagcagtgtaaaagtgtacctatttctccacatcctctccagcacctgttgttttcctgactttttaatgatcgccattctaactggtgtgagatggtatctcattgtggttttgatttgcatttctctgatggccagtgatgatgagcattttttcatgtgtctgttggctgcataaatgtctccttttgagaagtgtctgttcatatccttctcccactttttggtggggttgtttgattttttcttgtaaatttgttggagttctttgtagattctggatattagccctttgtcagatgggtagattgtaaaaattgtgtcccattctgtaggttgcctgttcactctgatggcagtttcttttgctgtgcagaagctctttagtttaattagatcccatttgtcaattttggcttttgttgccattgcttttggtgttttagtcatgaagtccttgcctatgcctatgtcctgaatggtattgcctagattttcttctgaggtttttatggttttaggtctgacatctaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcagatggttgtagatgtgtggtattatttctgagggctctgttctgttccataggtctatatctctgttttggtaccagtaccatgctgttttggttactgtagccttgtagtatagtttgaagtcaggtagcgtgatgcctccagctttgttcttttggcttaggattgtcttggcaatgcaggctcttttttggttccatatgaactttaaagtagttttttccaattctatgaagaaagtcattggtagcttgatggggatggcattgaatctctaaattaccttgggcagtatggccattttcacgatattgattcttcctatccatgagcatggaatgttcttccatttgtttgagtcctcttttatttcgttgagcagtggtttgtagttcttcttgaagaggtccttcacatcccttgtaggttgtattcctaggtattttattctctttgaagcagttatgaatgggagttcacccataatttggctctctgtttgtctgttattggtgtacaggaatgcctgtgatttttgcacattgatttttgtatcctgagactttgctgaagttgcttatcagcttaaggagattttgggctgagacgatggggttttctaaatatacaatcatgtcatctgcaaacagggacaatttgatttcctcttttcctaattaactgatgggcttccctttgtgggaatattgttatgtgttatttctttctcctgcctgattgccctggccagaacttccaacactgtgttgaataggagtggtgagagagggcatccctgtcttgtgccagttttcaaagggaatgcttccagtttttgcccattcagtatgatattggctgtgggttgatcataaatagctcttattattttgagacacatcccatcaatacctagtttattgagagtttttagcatgaagggctgttgaattttgtcgaacaccttttctgcatttattgagataatcatgtgttttttgtcttaggttctgtttatatgatggattacgtttattgattgcctgtgttgaaccagtcttgcccagggatgaagccaacttgattgtggtggataagctttttgatgtgctgctggatttggtttgccagtattttactgaggatttttgcatcgatgttcatcagggatattggtctaaaattctctttctttgttgtgtctctgccaggctttggtatcaggatgatgctggcctcataacgtgagttagggaggattccctctttttctattgattggaatagtttcagaaggaatggtaccagcttctgtttgtacctctggtagaattcggctgtgaatccgtctggtcttggactttttttggttggtaggctattaattattgcctccatttgagagcctgttattggtctattcagtgattcaacttcttcctggtttagtcttgggagggtgtatttgtccaggaatttatccatttcttctagattttccagttaatttgcatagtggtgtttatagtattctctgatggtagtttgtatttctgttggatcggtggtgatatcccctttatcattttttattgcatctatttgattcttctcttttcttctttattagtcttgctagcggtctgtcaattttgttgatcatttcaaaaaaccagctcctggattcattgattttttgaagggctttttatgtctctatctccttcagttctgctctgatcttagttatttcttgccttctgctagcttttgaatgtgtttgctcttgcttctctagttcttttaattgtgatgttagggtgtccattttagatctttcctgctttctcttgtgggcatttagtgctataaatttccctctacacactgctttaaatgtgtcccagagattctggtatgttgtgtctttgttctcactggtttcaaagaacatctttatttctgccttcattttgttatgtatccagtagtcattcaggagcaggtcatttagtttccatgcagttgagcagttttgagtgagtttcttaatcttgagttctagcttgattgcactgtggtctgagagacagtttgttataatttctgttattttacatttgctgaggagtgctttgcttccaattatgtagtcagttttgcaataagtgcggtgtggggctgagaagaatgtatattctgttgttttgggatggagagttctgtagatgtctattaggtccacttggtgcagagctgagttcagttcctggatatccttgttaactttctgtctcgttggtctgtctaatgttgacaatgtggtgttaaagtctcccattattattgtgtgggagtctaagtctctttctaggtctctcaggacctgctttatgaatctgggtgctcctgcattgggtgcatatatatttaggatagtcagctcttcctgttgaattgatccctttaccattatgtaatggcgttctttgtcccttttgatctttgttggtttaaagtctgttttttcagagactaggtttgcaaccactgcctttttttgttttccatttgcttggtagatcttccttcatccctttattttgagcctgtgtttgtctctgcacgtgagatgggtctcctgaatacagcacactgatgggtcttgactctttatccaatttgccagtctgtgtcttttaattggagcattttgcccatttacatttaaggttaatattgttatgtgtgaatttgatcctgtcattatgatgttagctggttattttgctcattagctgatgcagtttcttcctagcatcgatggtctttacaatttggcatgtttttgcagtggctggtaccagttgttcctttccatgtttagtgcttccttcaggagctcttgtaaggcaggcctggtggtgacacaatctctcagcatttgcttgtctgtaaaggattttatttctctttcacttaaagcttagtttggcttaatatgaaattctgggttgaaaattcttttctttaagaatgttaaatattggcccccactctcttctggcttgtagagtttctgccgagagatctgctgctagtctgatgggcttccctttgtgggtaacccaacctttctctctggctgcccttaacattttttccttcatttcaactttggtgaatctgacaatcatgtgtcttggagttgctcttctcaaggagtatctttgtggctttctctgtatttcctgaatttgaatgttggcctgccttgctaggttggggaagttctcctggataatatcctgaaaaatgttttccaacttggttccattctccctgtcactttctggtacaccaatcagacatcgatttggtcttttcacatagtcccatatttcttggaggctttgttcgtttctttttactcttttttttctctaaacttctcacttcatttcattcatttgatcttcaatcactgatatcctttcttccactggatcgaatcggctactgaagcttgtgcatgcatcacatggttctcatgccatggttttccgctccatcaggtcatttaaggtcttctctacgctctttattctaattagccattcgtctagtcttttttcaaggtttttagcttctttgcgatgggtttgaatatcctcctttagctcggacaagtttgttattaccgattatctgaagccttcttctctcaacttgtcaaagtcattctccgtccagctttgttccgttgctggtgaggaggtgcatttctttggaggagaagaggtgctcaaattttagaattttcagcttttctgctctggtttctccccatctttgtggttttatctacctttggtcttcgatgatggtgatgtacagatggggttttggtgtggatgtcctttctgtttgttagttttccttctaacagtcaggaccctcagctgcaggtctgttgggagtttgctggaggtccactccagaccctgtttgcctgagtatcaccagcggaggctgcagaacagcaaatattgcagaatggcaaatgttgctgcctgatccttcctctggaagcttcgtctcagaggggcaccgggctgtatgaggtgtcagtcagcccctactaggaggtgtctcccagttaggctactcgggctcagggacccacttgaggaggcagtctgtccattctcagatgtcaaactccgtgctgggagaaccactactctcttcaaagctgtcagacacggatgtttaagtctgcagaagtttctgctggattttgttcagctatgccctgcccccagaggtgttgtctacagaggcaggcaggcctccttgagctgcgatgggcttcacccagttttagcttttttttgctttgtttacctactcaagcctcagcaatgggggatgcccctccctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtttctagaaccagaacagtgccaatattaaaatatactgtaaataaaatgcctgccatgtggaagcctactctttaattcttaaaagttctttctcaacagctagtatatattacatggtatgaagtgtgtcatgtgagagttgtactattattttgatctgaatgtgctagataattgaatttacatggtaacctttattttggcaattaagatttaatttaatttaatttgtcattaccaatttcttaattactgtcttttgacaaaactaagccaaattaaagatttttcctcttgaaggattattatactagtaacatattatttaaattattatgattttggccgagcacagtggctcacacctgtaatcccagcactttggaaggccgagacaggtggatcacttaaggtcaggagtttgagaccagtctggccaatgtggtgaaaccccatctctactaaaaatacaaaaattagccagatatggtggtgtgtgcctgtaatctcaactacttgggaggttgaggcttgcttgaacccgagaggcagaggttacagtgagccaaggtcacaccactgcactgcctggatgacagaacaagactccatcgcaaaaaaaaaattattatgattttatgttacatatttaatatgtgatagggctaatttattttactatcttttatttcttaatagggttttaatttgaactgtaataaatctttaattttattatggaaattagcatctttttacataatttttctatccacaaatgtaatgttcctcttcatttattgaaatcttccttcatagctgtttgttcaatttggtcacaagagtttagcatgggaaatatgtttaagcaaatatttactgaaataataaaatgtaaatatcataatttgtgttttttgtaacagagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccaggtagaaatgcgatgattgcagacattcttttcatatcttgtatgtcttgtttctgcttatttaggcctaacatccagaaacagcctccagctggaatattttaggtcaagttgggaaatttttcatctctcaaagcttaaaatattatctaattaactgtataagaaataaggaaaagagagttccacttttaagttttctgagtggagagtttgaagattaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttgttcaacttctccggaggtgaaactttttttttttaatcttagttttcctagtagcctttttgtagattctttggaattttctaccatagtgtacatgtttttgtgtgaacataagccttcatttctcttgggtaaatactaaaaatggcattttggagcatatggtaagcatatgtttaactttgttaagaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttttctcctctgttttttggtagaagttttatagtttctggggtttcacatttagatctgtaactcattttgagttagtgtgtgacaaaaggctcagtttttttcatgtcagtgtccacttgttctaggggcatttgttgaaaaaagactgtcttttctccacctttgttgaacatcaggtgaccttacatgtgtaggcctgtttctgactctgtattctgttccatgtatctgagtgttagctataccacatggtcttgtagctttctttatagctaggcctgaaagcagggtcttccaactttattcttttacaaaagtgtttttgagacacttccttagttccctgccttccatgtaaattttagaagtggcttactgattgctacagaagttctgccaggagtttgagtgggataccattgagtttatagatcaaattgggaagaattgacgtcttaacggtattaggttttgtaactcctgcacatggaatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagccatgttgtagtgaaaagagaatgtgctttgcaatcagttagacctcaggtcaaatcccacctcttccacttagtaagtagaacagcattgagtcacttcacttctctcaactgtcacagggagtcagtactctgttttgtatggggtggttgtatttggcaaatgcactccagtatatgaaatcagcctgtcagctctaatcctcataacagtcctgtgcctagaatgatattatcctattatcttttgttctttttctgtttatttatttatttattttgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacgaatttgttatgagtaaattttagggttggatagtgaaaattgatcatgaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatgattctgaccacttaatctgtgtttaatcttcatagtgaaagttgtaggaatgttttacatatgagaaaactgagacacataagggttatgtaacttgaccgagttcccacggctggttagtcagagagctgagatttgaacccaggcagttgggctccagagtccatgttcttgtctatgacattgtacttggtagcagttatgtatcttcagaagtcccgttacctggttaggaagaggtagatcactctttatagagatttacagcccttttacaatttgttgttactctgtcagagttaacactgctgctgttggcaaacatcatgttagggaaatcactttaatacatggaacccagtgctgttgttgtgttttttgactattgagagtgtgcttacaaactgatcatgaataagagcctacagtacaggaatgtttaatagttacaagtgatataggaagtgctgataacattagaaatcattaacttgtcagatttttatttctaagtagaccgtaagatttttaaagttaaatttgatggcagaaaattatattcaaattcacatatgggcaggttggtacatatttgtattagtctgagacaatatatttttctcgttctcacttagtactttacagaaagtcatttttagaggaaaactgattagccaatgacattgccaggctttttttttttttaatacatatttttttctttagttgtaggtcaaaaatagtcaaatgttgacaatttcatgtggttatttctcacaagagaaaaaatttctgtcctactgaggtgaaattttcacccttgctgtacctttcattgtattttgaaggaaattatcagtaaatgttatttaaacttaatgtttataatgtatatatggctaaaatgttgctaaaataagcattttatgtaattcaggaagcagaagtttggtaaaaatttctctatgcattattgaagtccaggcaatttgatggctacagattattttaagagatgtttttctcaagaaaaagtagaaattaacaattgaaataaatgaatgagcatcaagaaattacatcatggattgtaagaaacttttctgatatggaccaaggtttgccagtcaattatgtcattgaaatttttgaaataatgggcaggcgctaattactttggcagaagactaccatgtaggaacattaagaagaacatgtcacattatcagcttctaactgttggagtgggttaaaaaaatggtctgtcctcatctgctgctatgcgggtttaaatgtggctcccaaatctcccacacttctgcattatgtatttaatacattgtagagatggttctgcagctaccactgtcagccattccagagtgagcacaaagatgacattttactgagcttgagggcttcctttcataatataaccctgttctcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgagagtttgatgtacacagttttgtcatccacattatatgctgtttgtctctgagggatcctgagtttgtccatgtttctgaaacaaccagtcaaggtgtattttgaggagaggggagtgagggctgaggtatgttgtctggttctgattggtatcacatgagctgctgagctgaaatcacagtggtttatttggtgtcttgcaggacccagcctttatatgttaatgtttttccctcattggtatgggatacctacaggatgaagttcagacttcatagcaaggcctctaggactgttcttcctttgtctcctcacctccaatcatatgcccccttaattcttttttttcctcttttttttttttttttttttttgagatggagtcttgctctttcgcccagtctggagtgcagtggtgcgatctcagctcactacaatctccgcttcccgggttcaagtgattcccctatcccagcttcatgagtagctgggattacaggcacccgccaccacacccagctaatttttgtatttttagtagagacggggttttaccgtgttggccaggctgatctcaaactcctaaccaaaagtgatccacccacctcggcctctcaaagttctgggattacaggcatgagccaccgcgcctgccctcccctaactctagaaacttctgaactgtatgtatttctacttaaatgtcccattcttttccctacaccttgactttgcatagattgctatttaccaaccaataatttttctagtcaatttcacaatgaaaatctccttaatcttcttaaagttaataacttttttcttatactattcccagattatgttcataactctattgtaaacttcatcagagtgccttattttcatgtctctcacccaccaaactataccttccttgagggcagaaattgtgccaccaaaaggcagatccaaatacagtctgcaatgaagtgtgaataaaatttaaaaacaaaaattacttttagatcaaaaaatgttttagatgctttctataaatatttttttaaaaatcacctgcagttggttctatagtgagatataaaactgaacaacattccaaaatcttaattttttcttaaaaaaaatttccctggtagttaacaagtattttttatttgtactcactgtaattttctctgattaagtgttatttggtcacacttctcacttggctttcaagcctgctttcaatttataagaacaggagaaaaaagaatgctatagcaagtatttaaatgtagcagttatagtataagagaatttttaaggaaaagggtgatacagtgatatgtttttttctgcttaaaacatcactgtcagtatatttttggatcttgaaagatctcttgtgtttatggcttggggcctgcttgctaggcttgacttcagtactgtttactaaattatagcactgcaataagacatttcaccaatatgatattgaagcataacaagttatttcataaggaatggtaattatctaacattctaagcaaatttggcagtgtgacttggtggggcgcagtgctgtccctgacacaatgacagccttactctctaaattagtaacttccgtaggagaccccagaagcacacctccctcccagcagtgaaagccgaggattcccgttttgattagcaggcgccttctgttcacgataaagggataagaatcaggcagtgatggcagcggagttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttttagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcatttctggttggtgggtagttcacttatgaagctaaaacataattctttaaaaaaatgtactagggacataaggagagtggtatggtgaaatacagacttgaagactgtccttgggctctctgaatcatggtggatagatccttacttatcctgctatgctgggagagaggtttcatcccaatattaagcagaattaactttatgaacatcttagagccattagtaggtgctggaaattgtatcattttatttaagatatagataggggattgttaacttttctgataagaaaaattaggaaaaattttacttttatttggctttggtttctgtttgaaaggatatatccataagaactacttgtgtaaagcttattagaagaaatatatgctgctttcttaagcatacaacaaatgtcagaaatatttggaggagaaaaagtttcagccttactagcctttcacatttatacaatcccttcacatcctgttaatcttcttttacttactccatttaaatgtgtttcatagcttagactaaagcatatttgaggtgagaattacacatttttagtagtttgtaagatccatgaaaaaaattatctgtatttattactctctgtcaccctgtttcatcttgttttccaccatccataattccacttagcttaattcatttccctgtgccttaggcataatcaatagttgaattgcatatttctgctccagaactctgctcttataatgatattttaaaaatatattagaacaaagtaacaaagtctatcttctatatgtacataatttttttttccaaacacgtgtttgaggctggaatgtggtgaatttttagattttatattacaatttatagcagacaaaaagattttctataggaatccctttgttggaagttggaggaattgtatacaagtttatttctcatgctgattataagagcctaaaatacttaaatcggaagactcaatttgacatttgagtaattctaggcttgaaactggcaatttcaaaatatagtctgagaaattgataatagtatatctatctctatgtagatacacacaccacacattgagatgctttgactgaagccacatagaacttggtcactaaaatacttattttcccagcagca

SEQ ID NO: 13225 - DNA, 40168 bp, Human
  misc_feature (1)...(40168): n = A,T,C or G
caatcttggctcactgcagcctccacctggcaggttcaagcgagtctcctgcctcagtctccctagtagctgggattacaggcgcatgccatggcgcccggctaatttttggattttttgtagagacggggtttcaccatgttggccagactggtcttaaactcctgacctaaagtgattcacccgcctaggcctcccaaagtgctgggattacaggcatgagccacggagcctgaccacatcaatacttcttagtatgtactctctatcattgtcccccgaaaatgtgctgggttttggttttttaaaacagttccaagccttttcatttaacaaacagcatggtgcttcctctaagacactttacaaatattagctcatttagtcttccgaacaccctcctgagatttgtagatgaggaaaatgaggcacaattaagtgacttgcccaggtggcagagccaggattcaatgtgggttggtctggatccaaggtcaacatgtttaacaatgaaaaatgttatctttggtccgaaagtattcaccatctgaaatatcaatccttttcctccactgtttgaattttactactcatccttcaagacacaactcaaataacttcttacacgaagttctaccatagtgattccatcccatagtcttctctcttgctctgtccggcactacgccagatattatttcaatgaccggtatatgtcatctccccaactagacagtggccacttcctatatagatgctatgtccaaataaacccattgtaaactgaaaatatcgttaagtcgaaactgcatttaataccctgataaacccatcataaagtcaaaaaaccgtaagttgaaccatgcttaagtccagatgctcctcgactgacatggggttaggtctcattaaacccatcataaagtcgaaaaattgtaagtcgaaccattgtgaggggtaagtcggggaccatccgtacttttcatacccaacagagccccttttatagtacaatccaagaggtaagtgctcaataaatacttgttaaatgaatatgtaagctgaatctttgaaacaggcacattgtatgttctgcatgcagccaaaacattatttccaatttagcttatatctggcagagtcaaaacacttatttacactcagcccctcaccctactcccataactgaaagttctgcttagcagacttctcttcccagaaagtccgagaagcacgaacgctttttgctaacatcctgctcccaagcacagaaaccacagcaggagactgtgtgtatctgtagcacctggtatacagcatctaggacacacaactgaactaataaataaaggtgacaggcgggaagaagagcgcagaattacttgtccaggaaacgggttgggtgggaaagagccggcaactggtaaaagatggaagtacacgccggatctgggaagccaggttccgcgcctcggactcatggaaaaactggatctggatcactgcaaaagaatcaggaaggcttcggtatcaagtaactggtgtcctaaaaccaaaaaacaaagtgcgatgccggggctacgctgttgtgagatgctgttatcagttctcgtcaccaacacagcggcagcaccaggcacaaccgccaatcaaagcggccccacgagtccctccttgaacaggttccttaactcgttcagtccaacactgtgccacaaactcgcgaaaaccggctacctagagccagcgtctttgcgagcttgcggccagctagtgcatgcgcaaatcctctcgccgtgcggaccaatcgcaatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggtgactgacccattccaggcaacctccaagtccgagggcctggcgccttaggctccctgtgccttgcagccctctacccccgcgtccccgcgagaaacttaacacatagtcacgtgaattccaaattggcagactccgaaccctgagtcttgcaagcggaggaattggctcagccatgccgacctgaccttcaagagatttgaacccagtagtcggcttgaggccttttcccgggagcgtttgctgttcagggatcccagaacaactggctgtcggcgcctccccggcatccccaccccccacccccctttttagagcaatgaggtcaagtagactttgtcatttaccgattgagactttaaacaggacgtttaagccctacgcctaagtttcttgtgtaaatgagggtgttatctgctcagccttccaaaccacagatgagatccatggatttgaatgcccagtgaaacagaaacggtgcagggcaagtaaggagtcggttggttgtgtaccagacacccagagaattggcccagacttaattggagatgcctgagccgtgtacttcttggtggtctttaaggcttcaaagaaacagtttgcagaacgcattgtattttgttctccattaagttgtttcatcaaattttagagctggaagggattttgtggtaaaggtcaacccactcattttatagataataaactgaggcacagagaggtgaaattacttgccaaaggtcacatagttaattaataggtagagctaaggatagtttgctagcctccaggtccttaatcccttcgctgcaactccatactgcttcctaaagttgacctcaaaaagttaagaatgaattcgggtctcttcccagtaattagcccattgtacatcagatatccgtgaatttatctgagcatggcttgagcctgcttcttttcgtactgcgttacttcatgggggcaatgaatgatccacctgtaggagttgctttgaaaaaaaaatcagtaatccttcaatgtccacccctagggcatttgcaatgtcagaagttatccttgaggcttttacaatacagaaacacctgggtgctttaaaaataaaaagtggaaaatattttccttgggttgttagggtctttgcaaatgtgcatttgaacagtttttccagttgctatgcacaatgaaaatgtttcctgataggtgtatttgagttatgtcctgggacatactgctcttggaacttaaaacctctgcttagcttttaaactaatgccttatcaatggatgtcatctttgagggttttgtgtattgaaatgatggtgctctgtgcttgttgcacagaaattgagataacctgaattttttttttttttttttttgagacggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaattttttttttttttttttgtatttttagtagagacaaggtttcaccatgttaaccaggatggtctcgatctcctgacctcgtgatccgcccacctcggcctcccaaagcgctgggattacaggcgtgagccaccgcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcatacacttgttctttgtcctttggccgtgcaccaaagtatgacatcatctgcctttaaaaatgggtgagggtagtgttaaattttcaaaaagaagttctgatactctcattttaggaattaactctgttttgtggcttgattcctaactgcttttaatctgatttctttttcatgtagtagcatctaccgtgtgtttttgcacaggtgggaaagagcaaggttcgtttatacaccatttctccctccaccttacctttaaacttttttttttttttttttttgaggcggagtctcgctcagtttcccagagtgcagtggcacgatcttggctcactgcaacctctgcctgctgggttcaagcaattctcctgcgtcagcctcccaagtagctgggactacaggcatgcaccaccacgccgggctaattttttgtatttttagtagagacggggtttcaccatgctggccaggctggtctcaaactcctgaccttgtgatccacctgcttcagcctcccaaacctttaaactttaaacctgccttgcaactatctcgttgacatctgtcaccattgtcaggttcatttccattatatgttgcattctgccttaaaaccatgatagctactatttgtttatttactttatttatttggatgctctgcctccttccagagatgattgaaggtaactcatagtcatcactctatgtctgcattcagacacagaggagcagataggttagataatagacattttctgttctataatattttgtttggtcaccaaacagtgctgcccatgttatcaaactgatcaccgactccctgactttaggttcaaatgtttgaacatttttctctatttggaatccttctcacctctttaaaaaggaaactgagctccttgtgggcaaggatcctggcttcctggacactgccaaatgtgacttcgttttgaagcctaaaagatgagtcttcccccgttgtttctgctgagacaaggctttgcagaagaaattctttggcagctcagccctttctgtaaccagttaataagttacattttctagaaatgttctaactttttgagggagttactgcatgtcttagctttcttctagatcatgtttccaaaagttgcctgctcatgtgaatcgagtagagaaccagttcctaaccttctccaggagataattctgggaatctgtattttaacaagccccttgacattcatatgatcagacaagtttggtatatactgttttggatgagtagtgactcttccccttctgttttgctgacgtaaggattaaaaaaccaaactgagcaatctggagtctcttgtgatttgtatcaagctcattttctcatattcagaatagtagcagccattctcctaaattaaacactacctgaggacatggattatgtcctatttatttttgtgtccttagcatcttgtaccatctctggcacatggtaaattctcgtgactgaaccctagtacagcattgtgaaggacttaactttgcagaagagagattttattttgttatctaaataatttttccttgtgtgtctttcatcagaatggttcacgctgtactatagttattactactctgtttcttctaaaattccagcaagggttgatattaaaaaattaaaaaaggctgatagctaggcgtggtggctcacgcctgtaatcccagcactttggtatgccaaggtgggcagatcacttgaggttggaagttcaagaccagcctgaccaacatggagaaaccccgtctctactaaaaatcaaaaattagccaagcgtggtggcacatgcctgtaatccctgctactcgggaggctgaggcaggagaattgcttgaacccgggaagtggaggttgcggtgaaccgagatcacaccactgcactccagcctggacgacagagcgagaatctgtctcaaaaaaaaaaaaaaaaggctgataaatagttgttggatcccttgtaaagaatcatttatctacaatggacagactatctaggcttgtcctgtgtttttttttttttttttttcttcaaacagagtcttgctctgttgcccaggctggagtgcagtgacacaatctcagctcactgcaacctctgtctcctgggttcaagtgattctcctgcctcagcctcccgagtagctgggattacaggcacctgccaccacgcccagctaatttttgtatttttagtggagacggggtttcactgtattggccaggctggtctcgaactcctgacctcgtgatccgcccacctcggcctcccaaagtgctgggattacaagtgtgagccaccgcacctggctgtcctgtgttttctccatgctggaaaaatcagtttgaccctcaggaaacaagtctcaagaacgtatagatctcttaaccatttaggatccctgggtgcctcaattgtgaagttgtgtttttggaaaacgccttttgggagtatggaaaaacaggaaatcacaaaacctacagaaatgaacttgctagtttagctactattctaatgctggtctatggtgtttgaggttactcatttatgattaagcaacctaaaataaatggaatctggctaaagctttttttaaaaaaaactcttaagtttattttttcattttatttatttatttatttatttatttatttatttttaagtagagacggggtttcaccatgttggccaggctggtctcaaactcgtggtctcaagtgatccaccaacctcggcctcccaaggtgctgggattacagatgtgagccaccgcgcctgccctggctaaaatttctttgcaaagaattatttaaaatgttcagttatccgggcacgatggtgcatgcctgtagtcccagctattctggaggctaaggtggaaggatcacttgagcccaggagtttgagtctagtctgggcaacatactgataccttttcatttaaaaaaaattttaatagtaataagaatgttcagtcaatatcaatagaattaggaagaatttctatttccttccttcattaattcaacaaatatttattgagcaaacatctgtgtgtcgtctggcgctgttgcacaggtcaaactggcttcttaagaatgaaatcctaagtgtgaggaagaaattgcattgtatgtgtggtctgactgcagaaaacctaaaataagtaaactgctgccatgatgaaaagtcaaggagtaagttggcttttccatgttagtaagacaagtgaaaaggcatgtttcagtcacgatgtaatatttcctaaaattttgaagctatggggagaaaggtttgggaggaatttcatagggaaaagaaaatgtggggagggggaatgtaagcaaacaatacttagtacattttacaaaattaaagtcactttgtaggtatataaaaagttttaaaagttggtttattaatgagagtagtgtattacatttcttttcaagcagtagtttaaatattaaccagtttacttttttttaaagtcaatttacttttccagcctggacaacatggtgaaacctcgtatctacaaaaaatagaaaaattagctgggcgttggtggctcacgcctgtagtcccagctacacaggaggctgaggctggtgaatcgcttgagcccaggaagcataggttgcagtgagccgagattgtgccactgcactccagcttggggacagagtgagaccctgtctcaaaaaaaaaaagtccatttacttttaaatgcttttttcttttttttttggcagattgagacaaaagctgctgaactttcctaaatctacactgttagtattatcagtttgtgaaaagcaagcagaaggagaataaacatgagtatgatattaaaacaaatttgttataatgtctgtatttagggtcttctggaggaataaacagaattaaaaaaaagaaaaacaaaaacaaaaaaaatttatttttagtaaatgaaccaggggtagaggtggaggacaaactaaattcattgaactaaatcacatggaacttttcctaaccagtttcattttctaagctctgagagttaccactttctacttctgatggttcattatttttgtaagcttctgaaaatcaaaagcttgcccagattgagataagtttctgccccgctcacgtttttattttcatgatttgtcattatttccaaatctcaaccattttatttcatgtggtgatgaagagttctaaaagcaggtaagaagaacagtaaagaaaaatacatttccttttctaagagtgtagatctaaagtctcttatctgtaattcagaaattgaaattgtagaatgaccaaaatttaagactatcaagttttcataactcatttgccagtaaaacctgacctgaactggagagaggctactttataatctttttaaaatatcacttagcgtgattggtcatattaatatgtttaactatgaattgctgccctttaccttgctaggtgtcactatgtggtatatgccccatatacttaagaccagataattcaaagttccaaattatacatggtccccaggatttcagatgagagaccacagatccacattgggcttgtttttacccgtctgtggcctaacgttatgaaagcaagggggaaattccttctctaatctctgcaagtatacatgggatgctactaccagtgtccattctgtttgtcttttaaagcctagacaggacagggacataagtatcagcctctagactaagcttgtccaacctgcagcccaacacaaatttgtaaactttcttaaaacattatgagatttttttgcgattttttttttttttttttttttttttttagctcatcagctatggttagtgttagtgtattttatatgtggcccaggacaattcttcttcttcccatgtggctcggggaagccaaaagataggatatacctgctctagacagatggttctcaatgtgtggtccccaccctaacagcagcagcagcaacagcagcatcccctgggaacttgttagaaatgcacattcttgagccccatcccagatctattgaatcagaacctctgggcctggggcctggccagctttgttttataaaaccttcagggcattgggatacactctcaagtttgaaaaccactgctctagatcggggtctgccaactacagccacaggccaaagccagtcagtcacctgcttttgtatgccccaggagccatgagtgggttttgcattttttttcttttttctttttctctttttttttctttgaaatggagtttcgctctcgttgcccagtctggagtgcgatggcacaatctcggctcactgcaacctccgcctcctgggttcaagctattctcctgcctcagcctcccgagtagctgggattataggcataagccaccacgcccggctaattttttgtatttttagtagaaacagggtttctccatgttggtcaggctggtctctaactcccaacctcaggtgattcaccctcctcggccttccaaagtgctgggattacaggcgtgagccactgcacctggtcttttttcttttctttttttttttttttgagacggagtctcactctgttgccaggctggagtgcagtggtgcgatctcggctcactgcaacctccgcctcccgggttcaagcgattctcctgcctcagcctcccgagtagctgggactacaagcatgccccaccacacctgcccagctaatttttaacggggtttcaccatgttggccaggatggtctcgatctcttgacctcgtgatctgcccgcctaggcctcccaaagtgctgggattacaggcgtgagccaccacgcctgacctacattttttaaacggctgaaaaaaaaaagaatttcgtgacacatgaaaattatataaaatttaaacttcagtgtccataaagttttattggaacatggccacatccattcatttatgtattgtctttggctgcttttatgcagcatcagtggaattgagtagttgcagcagacaccaaatggcccagaaagctgaaaatatttaccatctggttctttgcagaaaaaatttgctgctctaggttgatagtcaacaaacacgaggagtaatcacagaataatcagagactgagaccttcctttatctgaaaatgtcagcgtctccctagaaaaagaaatctacagaactcttatatttctatgtacaggtgctgttatgatcatcacatcattacatagctctgcatagttttacgtcaaaataacctttgtattattttggaggagtaagagtcaaggagttgctggacacttcacattttgtcattataaaaaatatttcatagtccaaaattttttagttctttgggggagagaaactcattaaaatttttttttctgattttcttctgagctttaacatttctgtattccaggacacattacctttcatgcaagattgaactgtgtcctggttagagtgttgcgttttattttgtgcaagattggaaccatctagattactccttaaatggttgttataatgtcccaggtagcccatggttaactttgtatatctacctattcagtcatctctctgtgtttacttaatttatgggaaagacatgaaggaagaggtatttgatgaactgttcgtgtttttcatgatcttttctggaagctgaaaattttctcactggacagcattaaattttactcttaaaaacttcagcaacttaagagcgttcattcagctgtctgtagtatttatatatgcagttttgatgatatttttcttgatcatttaacggtgaatatctgtgggcaataagtcttgtacagtgcattgacatttaatcataaatatgtattaactattttatttttgtatgtgtgtgtcttaataaattatgtttcttaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgtaagtagaaaagcagcgtgtataaagaagctgccaaacagctcccattaatagactcgatagtattctgctttaaaacttttgcaactaattcccctttctccttttggaaaaattttcaaaaagccttctcttaagtgcctgctgcctaatatcttatgggagccaattctggaatgactgaaatttaatctcatgttgattgatttctgctcttttcacttgtctttttcttctttacttgaaagccactatgttttcctagattcgagtaacccacaaaattgtacctgttttcttggatgtcacacactaacctgtgaataaagtcaaaatccattgcagctccttagcacaatatttgattttgacctatttgtcagacattttatttcctcagcttgaggttcacattaaaaaaacaacagccttcaatcaaaaatattaagtgttcctaaaaggaaagctatccctgaatcttacccaaagactaaattacagaaacagggctagtatcactgattttagaatggagtttgtttgaggtgagaaatatggtgtttaattgctatgtagtattagcaccattatatctccttaaatgaactccgatcagcttagcaggtcacagaggaattattttgtgggtgtttttttcctaacttggcagggtttactgtgactaagccgatcagtctaaagttggatcctgtaaggttgagtgaaccaacttagataacacctagtaacacccttgattgaaggaagctgtttgttttacttaagccattacaagtttaggggtttttttctacattggtaagacaatgaatttatctttgttccttggttgctagcttaaagaaagggacatgaaaattatttgaagctacctatatcctcatcccctgatgtgactcccaaacggacaagaaaagtagatagttcttgcctattgtgagtcaaatcagagtaagaaataggcgagagctgtctgataatgtggtttgatgaaatacacattctgcaatcctggagcagcatttttttctttttccttttttagcacagggtaaccaaaactgcttctctgcctttgtattgaatgtttcttcattaatacttagtactctgtttccttttgtttctctcttggccttatctttacctacagttgtgcagtctcatcacctaggatccccttctagatcactagcatctacaggtgcttctgggaaagatggcagcaacctagtgtacttcttaattgtaggagcaacagtcactggggcaggagtttattatgtaagatgcttacactaaaacatattttggggtagggtgggtgagcccatggcactaatgaaaacttgatacattagaatatagtaaaatattcacagcatgtgctttctctaggtgtttattaaagggacattgtcagtcactagagagtcctcaaatctcattcttcaaactgttgaagtcctaccagatatagctaaagccacaagtctaatgatgatcacaaatcctcatcattaactctttctttgaaacttttgccaattttataatgattttgtatgataccaaattatattgtgctttagtgctgcatatctaacaagacagtctcagagtaaatgttaaataagcaaataaaggtaatgtgaacatcatccatttttgaatcattttaggtaaaatgtaatgtttgtgttttgtgggaaacgatcaaccagactttgactatgaaaaggcattttattgaatgcttctgaggagatccaaaaagccatagaaactgcaatattctccccatccacctttccacccacagcctctatttcaaagtaaattcatttggcagtgtccctttgtaatctctaatttggtcaaactagtggctgaagcggtacaagctaacacattcatgtagattgctttctgtaatgcctctcattcgtaattcagatactaccctctgagccttactttttgcatttcatatctctcaacttttcccatcagttccaccccattcattcaaaaatagatttaaagcctttgtgttcagtatgttggtaacaatttaaacctgataaattcctggtccgtgttgctgtaccagagttggatggcctccacagagttgaccatgcaaattttcttgatgccaagctacaagacagggctggtcactgttcctttctcctgccttagaaatatctaagaagcacaagttcctctcaagtcattcatttaaatgcctcattgtactctgtgtttatccaacactggtaataataaagctaccgtattataaagtggttccaggttaaatgataagcttttgtctacctacaactgttattgaactgttatgtacagttttgttttaggttctaaattattgaaaacttgatctgaggtggcttagtttttttgtccgaaattggtattagtctcaagagaactatgaacttaaaatcagtgttcagatttgatgagatatagctgtaagttgttgaacgtttgtattagtttcttgggctgccataacaaaacaccacggactgagtggcttaaacaacagaggtttattttctcatagttctgaaggctggaaaggccaagatcaaggtcacacagggttcagtttctggtgagggctctcttcttagctttcagacagcctaccctcttgctgtgtcctcacatggttttgcggggtgggggacggagagggagaaagagtgagcaagggaactccggtgtcttccccttcctgtatgagctccagctctatctgattagggccccacccttaagacttcattcaatcattatcacctccccaatgccccattgccaaataccatcacatagtgggttaaggcttcaatataggaataggaaacattcagtccataacagtgaatagcgtttcttcgtaacttttttctgtcatttgaagaaatgttcctaacttaagtataactattactttggcaattcctgtattgggagctctttacctccctcccactttaccctccaaaaaaagggagtaaactgccgacttttttttttttttttttttttgaaacggagtctctctgtgtcgcccaggctggagtgcagtggcgcgatctcggctaactgatacgtccgcctcccgggttcatgccattttcctgcctcagcctcccgaggagtagctgggactacaggcgcctgccaccatgcccggctaattttttttttttttttttttttgtatttttagtagagacggggtttcaccgtgttagccagaatggtctccatctcctgacctcgggtgatccacccgcctcggcctcccaaagtgctgggattacaggcgtgagccaccgtgcccagcctaaactgtcgacttttaaaaatttttaccatgatctgcagtgagaaatacatttcttttacaacccattttatgactacaaatacataaaaagaaacaaagcttcaaaaactactcttactaggtatcatacacttactctagcttctgttctcttctatttgtgtttgcgtctaatgctggttgcagcctactaaattgacttcacagcccactaatggcatgcaaccacagtttgaaaaacactgatttcaacagtgcttctgctgctcggattgtaaatatgaacttctgattcgcattgatgtgagagtttttcctctttttgctggtaactttccctaggacctgaggcagattcccaaatctcagtcctctattttttgttggtgggcagagccaaagtggcctttagaatagttaatgagatttagtatttgggccctttgctattgttaagctataggattgcattgcctcactcagaaaatgacctgtttcctttcaaatcccattaagttgaataaatgccaccatattcatctgtttagaaaagttgtcttcactaatatttttcataaatttgtagtctttcttaacctgacatgtattcatgtcattaattggaaatctgtgcaaactaggagtacagaaacccttgggggaaaggtaaagaaataaatacatttatatatatatatcagacagatcgacctcattcttgccctttccccactaaacctctagatatttcttggtctgctcttcccttcatgtgtgagccattagcaagtgtgagctgggcttaggctattttgggatattcctctcaatgaacatggcccctgtttatttctcttttcattcatgttgaccagagtaagccatctttttaggtaaaacttttcttttttttcttttcttttttcttttcttttctcttctcttctcttctcttcccttttttggaaaagctttcccctctaggttttttttgttgtgtttttgtttttgagacagagtctcgctctgtcgcccaggctggagtgcagtggtgcaatctcggctcactgcagccgccacctcaggggttcaggtggttctcgtgtctcagcctccctagtagctgggattacaggcgtgccccaccacacccaggtactttttgtatttttaatagagacgggtttgctcttttggccaggctagtctcgaactcctggcctcaagtgatctccacaacttggcctcccaaagtgctggaattataggcatcagccactgcgcctggctaaagtccctttcttaaaagaaatgtttttaagatatgagtaaatactggacttgtgtatagtatctgataccaagataaaaactcttcctgaaattaatgttaattgaattcatttattcgatacatttagtagtaaattcaaggagtaactattgtcttttcccatacagtacttaactttctacttcatttgtcacaacgttaaatgcttccaggttgaacccagctctcagggttcaggttcctcaattgcagcacattgcctgatgggctgttctggaaggaagtcatagaagtattcttagaatatgttttatggggccgggtgtggtggctcacgcatgtaatcccagcactttgggaggccaaggtgggtggatcacaaggtcaggagttcaagaccagcctggccaacatagtgaaaccccacctctactaaaaatacaaaaattagctgggcatggtggcgtgtgcctgtagtcccagctactcaggaggctgaggcagcagaatcgcttgaacccaggaggcagaggttgtagtaagccgagatcacgccactgcactccagcctgggcaacagagtgagactacatctcaaaaaaaaaaagaaaagaatatgttttatgatagttcctctgattgtctttactttctcctacaattaatctgagatttcatttgacatatgttcacctaaattcctgttttgttgaccctgtggggtacaaaagagcaaaagcattgtaggtttttcttttcttttttttttttttttttaagacaaattctcactctatcgcccaggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccggccaaaagcattgtaatgttaagtcattcttgcctaccttttctttaaaaagtctccaataggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcagagcttgcagtgagccgagatcccgccactgcactccagcctgggcaacagagcgagactccgtctcaaaaaaaaaaaaaaaaaaaaaaaaaaagtctccaataaactctggtactgtatgttaaaaaagaacaacacacaactggtcataatggtaaaattacccttttccaatttgaaaggatagagaagatagaatatttgaaatgtaacaggtgtgtttaagcaaggtgtttgaccccctagtaaatatctgtgtgtagtttttctgaatgagattccttctacctcgtgagtttaagaaaaggatagaccattgagggaatgatgggtaactctctaaaaatagaatacaggcagccatgtttctgaccactgtgtgagtacttagcaaaagccggaatgttgaccaggaaaacttatgtcccagcttcctacccgggaccctatagattgatttcacagctagtgtccagcgtagtccaaaccccgtttctgtgcttcatatatagattagccctttctagcactttattcttctagtataaaatgattttttcttttttcttaaactgtaccttcagaataaaatatggggagaattctttatagagagcctaaaaatctgaaactggaatattttcatctgcttacacatattttttccataccaagcatgtgcacacccagtattttttatttcttaagaaaacaactttgtcttagtggttttgacatagaggaactaacatcagatagacaaaagcttctcatttaattgaaagataatattacttacagtatgagctagctgtatggtgaaataaactttctccatgtttggatccgcaggcctacaagactatgaaagaggatgaaaaaagatacaatgaaagaatttcagggttagggctgacaccagaacagaaacagaaaaaggccgcgttatctggtgagtattcccttaagtcttgctatgatttgagactcacaaagggaaagttataaacagtttgggtgctgtgatttatggatgtcttgtagaagcaatggtggtatgagattgcaagcatctagaaagtatggtattaccctagaactgggagtgatttaaagcatttggctgaaatttgggtttgagaataaagctagtgataattatgattggttgtttatctgtatattaatattagtctcttggctgggcacggtggctcacgcctgtcatcccagcactttgtgaggccgagatgtgcgggtcagctgaggtcaggagctcaagaccagcctggccaacatggtaaaaccccatctatactaaaaatacaaaaattagccaggcgtggtggtgcacgcctgtaatccctggtgctcgggaggctgaggcatgagaatctcttgaactgaagtggcggaggttgcagtgagccaagatcacgctgctgcactccagcttgggtgacagagcaagactctgtctaaaaaaaaaaaaaaaaaagtctcttaaaaggcaagcttagcaaggaaaactattggaaaagatggaaaagagatgaaaaccttttttttttttttttttttttttttgagatggagtttcactctttttgcccaggctggagtgcagtggcccgatctcatctcactgcaacctccgcctcctgggttcaagcaattctcccgcctcagcctctggagtagctaggattacaggtgtgtgccaccatgcctggctaattttgtatgtttagtagagacagggtttcaccatgttggccaggctggtctcaaacccctgacctcaggtgatccgcctgcttcggcctcccaaagtgctgggattacaggtgggagccaccacgcccagccgaaagctgttttttaaatgaggaaattcttctagtctgttttgttccccttttgagtctttgcagtttcgagttgctaaaggtatatttgctttcctaaagcacataccctagccatcacttccatttcacatgattcacttcaattttcagagaggactgttttaatcctttaataagccccacaactctgggtgggcaatttgttctgcttttttcaaaagcacccccttattcttgaacattgtatgataatccccaattgacctcctggattttctccctttgttgctaacggaaggtgaaactgagcctgatattttcctggtgatcactaggaaattgatgggaagggcaaaagcctactgatgtatactttctaaatgttttagaagtaactaaatatttaagctatgtcctagtaccagttcagacctgatgaatgaatgacattggtgaaatcattctcctatttttcacttatgaaatgaaagggatacttgcttttcctctcccatcaggatgctgtgaagattgttaagattagcgtaggtcatatgttttgctagctttatgtggaggattgagacaagtgcaaggtgatttttttttaacagtggcaaagaatcatctgagacttcaagaagattcatccagtctgttctgttgctttcagcttcagaaggagaggaagttcctcaagacaaggcgccaagtcatgttcctttcctgctaattggtggaggcacagctgcttttgctgcagccagatccatccgggctcgggatcctggggccagggtaaggtgcatgtttttttgcttggcacagagggtacagtctgcaagcatttagctaatgtgaatgctttgacatttgccccttaaatgacttggctctgataagcgtcatgatttttatgtctgaaggtactgattgtatctgaagatcctgagctgccgtacatgcgacctcctctttcaaaagaactgtggttttcagatgacccaaatgtcacaaagacactgcgattcaaacagtggaatggaaaagagagaaggtgtgtttgcttatgtaaaatgagcctatcaacttcagctaagcacagagaataggttaggattttgccactgactgtgtacagtaataggagggatggcttggctgtccactagagtctactgtggtccacacttggtacagcttagagataacagtctacaaagggcaagagtcctggattctgttaccagatctaccaacagttgatggtgtaatgttggcctctgaaatactaatgctcctatttctggaacctttatgttaagcttctttaggtgaagatcaacttggcctgtattgtcacttctttttttatttttattttttgagatggagtcttgctgctctgtcaccaggctggagtgcagtggcgcaatctcagctcactgcaacctccacctcccgggttcaagcaattcccctgcctcagcttctcaagtagctgggattacaagcacgtaccaccacacccggctaattttttgtattttatagtagagatggggttttatcacattggccaagatggtctcgatctcctgacctcatgatccgccttcctcggcctcccaaattgctgggattacaggcgtgagccactgcccccagccatcacttctttatacttgcctagacatgtcctacaagagcagaagaaaagaaactttttaacggcactctctttgacagcctagcaagcatttagaatttcaggagtagagtaggaaggctgtaaggaagagcccgtgttagaatttttgcacgacagacttggagatacaggtccagaagctttttccttttgatggacaacttagatctcaattctagtaccatgttctttgggttccaattttttttctcattagtgacccctttgatacctgaccaaattttacaaacttacccttttccctcacccccactagttccattttcaaacaggatgtatactttcaattaagttagtggctaactttatatgtatacatatgcatacacacacacacacacacacacacacacacacacacacacatattttgagagacagggtctggctctgtcacccatgctggagtgcagtggccgaatcatagctcactgcagcctcaaactcctgggctcaagtgatcctcccacctcagcctcccgagtagctaggactacaggtgcgtaccaccatgtgccttttattaattaaaaaaatttttttctagagacgagatgttgctatgttgcccaatctggtctcaaactcctggcctcaagtgatcctcccaacttgggctcccaaagcactggggttatagacctgagccactgcactcagccaatattaatatattaactaattaatattaatatatcatagttgataactgcttgaggcagagtcttctcaggagctataattagttgttccattgaagagcaccattctggacaacccatttgggtggatatgtgaataccagctctttgggtgctccacttgttcttactttgaaatgaacctaaatctagagcaggatcctcagcctcagcactattgacatttggagcaggataacgctttgctgggggtggggagctgtccagtgcatcataggatgtttagcagcatccctggccattacccactggatatgagtagcatccctacccaagttattacaacccagattgtctctggacactggcaaacatcccctgggagcaaaattgccccaagttgagaaccactgatctggatacctgtatgtaagcaagtcatgaccatgatttaatagacttggagacttactttggaaaacgtcccttaaagtttctgataatggaaacagttttattaaagctacgggggaagctgataacagttccacatgcttataatattctccctctcttctccatacagcatatatttccagccaccttctttctatgtctctgctcaggacctgcctcatattgagaatggtggtgtggctgtcctcactgggaagaaggtgagctagtagaccgcttcttttgtcaggctctacgtacttgcccaccagccagtatggtgatgtgtgtttccattaccatttatgtctgtcctgccattgtagttcatcaaagaaggatcgagctgctttaggtttaataatgctgagtgtgtctttctggggaaagcactagtatcaaagcctaggttagcatgctgactcaacttgaccctaaaagctgttatctctcctatttgctcttctgcccttcctcatccttcctgttttcccacactaacttctctctgggattatcgatgagaaaagattgacaaatatgtattactcatagtaaaataatttgggcataactcagcacggaatatattgttagactttaaaaggtgagtgtctgagtaataaggtcagttattagcaggtatttgtggagtcccaggatggttttgttatattttattgttgttaatggcaggtactagagtgtgtgtgtaaactaatggcagtgttccaatagggacgcattctctgaaggagcaaagcccagagtagatgagatacacagcataagtggaaggattgtccttcgttaggaacatactcacttctcctgtaaggggacattagacagagaagatggatataggtttgttgataagccggtaatgagacatttagtgtcccctatgtgtaaacaacattcaggccctgccctctaggggctaactgtattaggcagaaacataaatacataatcataacacataggtgtgtagtaagagagatctgcgcagtatgttgtgggaaatactgggaagggtgcccagtagagtgatgacatcaggaaaggctttctggaggagaaggtcttacagaatgggcaatcttatggaatgaagaggcattcaccagactagagaagactgaagagcatccaagtaaaaaagaacagcataagcaaaagcacaagggcacaaaaaagcatgtttggtgccaggaaatagaagcagctcgatactgatagagcagttaggtacaagttaggaagtggcaagagatgaacctgagaagttatgcaaggggcctgattgtggagggctttgcgtgaaagagctttttctgcactggggagctgttgcattttaggcaattgaattttaaataatcaccattggccgtgaggaggatggatttcagtgagacaagactagagagagaccatttcagagattattgcaataatctaggcaagagatgatgagagcccaaattagaatagtagtggtatgatgatgatgaagaagaagaagaaagtaagaggtaaaatttgtatagtacctattctaatcttgtaagcacagttcttaaatgctttatgtgcaccatctcattttatcctcccaataatcttatgaggtaggtattatttccctcttacagagaaataagttgaaatttttaaaaataaataaattttaaataatttgcctaaactcacatagctagtaagtggtagagagagaatttgagcccgggtctgtctgagccacagaattggaacccagatattctgattccagagcctaagctattaataacatcagtgtacagtgtacagtactttttttttttgagacagattctcactctgtcgcccaggctggagtacggtggcatgatctcagctcgctgcaacctctgcctcccaggttcaagcgattctcctgcctcagcctcccaagtagctgcatgcgccaccatgcctggctatttttttttttttgtctttttagtagagatggggttttaccatgtaggccaggttggtctcgaactcctgacctcaggtgatccacccacctcggcttcccaaagtgctgagattacaggcatgagccatcgtgtccagccagtattacttcttgatagaaaggtgatgagaagtagggaacacacttgaggcatgcttaggagtcatgcttgatgaggcttggtggttggttaaaggtagaagatgaaggagatggaggaggcaaagatgattttctaatttctagcctgcatgtctgagtggatggcagtgtacccacagctgagaaagacattacaagaggaagagctagtttaagggggaagataaaattcagttttggaccattaagtatgaagtggaatatctgcgtgaaggtgtcttctgggcagttggacatatgactgccacgcccaggggacttgggctcagatagagagctgagaatcatctgcatatgtgtagaagttgaaaccatgagagtaggtgaagcctcccagggagaactgatctggtgagaagaggaggaaggcaaggatagagccctggggcaccccaatttttaggaagcaggcttaagaagaacccacaaaggagactaggaaagaacttaaagagcagtatgaggaaacctgaggacaggagccaaggttgtagggagtttcaagaaaaagaatgtgatccacagtgttaccgtggcagaggaatctgggaagaaaagaaccgtaaaatgcactgtgagatttggcggttcagatacctttgggaggctgaggcaggtggatcacttgaggtctggagttagagaccagcctggccaacatggtgaaaacacatctctactaaaaatacaaaaattagccaggtgtggtggcgcacacctgtaatcccagctactcaggaggctgaagcacgagaatcgcttgaacccaggaggcggaggttgcagtgagccaagattgcatcagtgcactccagcctgggtgacagaacaagactccatttcaaaaaattaataaaataaaacagataccattgggaagttagaaaagagggtaaagcactctttcaaaagatttaaatgagaaaagagagatggcaatcggataaaagcgtgaagaggacatagaatcaaaggtgggacctattggatgggacaagcatgttaataggctggacgggggtggtggggagccctcatgcctcatgggaagctatggaagatcacatctaatggcttcatttgtttttgcaatacaatagaacataagatggttatctgagagcgaacaccgtgagggttgagtagcgggattggattgaagagggagcttaccaaggacaaatcaaaggaggctaaagaagctgcttatccatcagatctcagttcatgtcattgcctctagaaagctttacccaacccaacctgactagattgcacatgtcatatgttcccagcgctacctgcactgttcttaccacttacatcacatttgtcactcttgattattgttagtgcttgttaaattgtcttggccactaaactctgaaagcagcaaggatcactgtctcaacttgatacatagtaggtgcttaattgaatggtctcagctagtaaagagtggtgcaaagactggggccctattctctctgactccaaagctcaagctcttaaccataagaaggagtagggtgcaagggaattaaaggtactggcaaaagaacagtttgggtgttctaccattggcccaaattagttagaatggagcagctagtcaaataaacagagaaaattgaaagcaagcataggagacagactgagcgaaagctgaagggatggaaaattgtgaccaacaagtagaataattgaggtaggaggagaggtttaggagataacaagatgaggaaaagtatgagccaggttccaaggtcttcagtgaatcaggaggagtagccaggaggtggctcaaaacagtgattcgtaggaatataggactcctctgatgtccctcagaagagaatgaaagtacaagaatctggaagcagcagaccagtaacctcaagaagcttgcagaatgccaacacctcctcctggccttgtgatgtggagtgtgggggaacgaacagcctctatgtgtaagctctccttaagagagagccaagtttccgtgaaggctacaagttggagaaagcattctgtaaaaatgttgtagatgtaggagacttattaataaagtaataataagtaattccaaacagccatataagaaaggctgttccgattctccttttccacacatgggtcagggctttgggactgtcatgacttgctctaatgttgcctgccttctcattgccaatttccaacatatgactgcctaaaaaaactgggtaccagaaactgtggttcccatgattacttggatatggtttcttaaggatcgctttaggtcaagaactcattcttcttattgggctgacaactttttttgtttttgtttttgtttgtttttgttgttgtggttttggggtttttttgttttgttttgtttttgagacagaatcttgctctgttgcccaggctggagtgcagtggcatgatctcggctcactgcaacctctgcctcccaggttcaagcgattctcctgcctcagcctccccagtagctgggaccacaggcatatgccgccacacctggccaatttttgtatttttagtagagacggggtttcgccatgttggccaggctggtctcaaactcgtggcctcagtgatctgcctgcctcagcctcccaaagtgttgggattacaggcatgagtcactgtgcctgtcctgggctgacaacttcttattgacctggagttttggggtggtgatggaaatgttctgaaatcagatagtggtgatggtggcacaaccttgtgaatatactgaaatccacagaattccacactttaaaatggtgaatttgatgtgaattatatctcaataaaactttttcaatgctaattcatctctacctcttttgtgtatgtgtgtgactgtaccaggtagtacagctggatgtgagagacaacatggtgaaacttaatgatggctctcaaataacctatgaaaagtgcttgattgcaacaggtgagcatttctggagatggctttcttccctgatacagctcattcaagttttagagtccagccttctctatggaaggcattactacttaagaaaatggaaacccagactctctgaagtgagtgtcttctcttggtacaaaagctggctgtgtcaaagcatcctggatcaccagcccttctggatgatccttgctgttctcccggtagaggcatgaagaagttgcccttttttctctccctgcttaaccctcaccctgtgccctgtgccttgaaagtgatgtcgtttgtggcttcattgccagttgcaatcagaaaccaagagaggagacagaagcaatttatcaaacccatgtagctatgctagctggcaaatcctcatgagaaactagaagagaacatggaagccaaaagtaaggccttttggccacctaggggcagggtgtaccccttgaagacagactctcaaatctgcttctcaaaggaaactgacagaaagcctgctgtgaggcaagctgaaggcaaacaaagccttggtatcctatcctgttgttgccgccatggtgctaagtgaagagggctccacctttgtgtggtggagggagtattgtttgggctggctcctgcttgttgggctaaagggttttccttctcttatttccaggaggtactccaagaagtctgtctgccattgatagggctggagcagaggtgaagagtagaacaacgcttttcagaaaggtaattgtctgctttagtgttttccttgtgttgtttttgaagaagtagtataatcttgcagtccccaagtgcccacccgggacttgggagatccaagttctatttatggctcttctccagacttgttatctggccttgaacaagtcacttcctctctctgcacctcagatacctcactcaagggttttaagctcctagggaaaaaatggagtgtttgtattgcttgcaatagatccttctgattgctcttccatagttgttttttcctgatgtgtttgattcattggaaccccttacagcctcttggcatttttcattgcaagtgctgtgtagagacttctgagaaaaaagttaagagtacctaaataaaaagcaaggaggtgttctgcttcttaacactgtgcttataaaaactgctgtcatttttcagggataagatttgtcctgtctttttttttttttcgagactgaatctcgctctatcacccaggctggagtgcggtggtgcgatcttggctcaccgcaacctccgcctcccgggttcaagcgattcttgtgcctcagccttccaagtagctagaattacaggcatgtgccaccacgaccggctaattttttttttttttgtatttttagtagggacgttttaccctgttggccaggctgtgtactgtcttttaagttcttcctagaacaaggcttgtcagcctctgcagtattggcattttgagctggataattgtagtgggggctgtcttatgccattgtagtatgttagcagcatcctggcctctgcacactaaatgctgggagcacctacttgccctgacaaccaaaaatgtcttcagatattgccagatgtcctcctggggaagatagggacaaaactgccaccaattgagaaccactgtttatagaaggaattttaccatgaagaaataaatttgcattaataacatagaagttataattgagtcactttatacaaggagaaaatttacttttgccaaagatttagaagaaactactttctagtattattatcctatgccccttttggaaattaatggactaaactgatgtgatcctgcagattggagactttagaagcttggagaagatttcacgggaagtcaaatcaattacgattatcggtgggggcttccttggtagcgaactggcctgtgctcttggcagaaagggtgagtattgaggagtgaccttgattttctttctctagtcttatatagcttttctgtgaatcccagagatgtgtttggcaggatcagtaggaagagtttaattaaggtttatttatttatttttttttgagatggagtctcgctctgtcacccaggctggagtgcagtggcgcgatctcggctcactgcaagctccgcttcccgggttcaggccattctcctgcctcagcctcccgagtagctgggactacaggcgcctgtaaccacgcctggctaattttttgtatttttagtagagatggggtttcaccgtgttagccaggactgtctcgatctcctgacctggtgatccgcccaccttggcctcccaaagtgctgggattacaggcgtgagccaccacacccagcctaattaaggtttatatagtgaaaagctaaacactgagattagttctggtgagggatcccttggtgaccaaaaagctgtcacctgagcaacttaacagcgatgcttttttttttttttttttgagatggagtttcactcttgttgcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgaggtagagagactgtttctatatgctgccactctatttcctttgagtgtgacctaaggcaaacttcgcttctataggaacccccttgacataagccctatcacctggcctgtaaaatgtttccaccattctccagtcagctaagttcatctaggtgttctgaatcagatgccccaaattcctggaagtgctgaaaatgaaccatgggtgtaggttcttgcagctctccaaaactgcctgtgtactgataattggttttaccgtggaggagaccgctggtcagctttcctacttcccatgaaagtgatagccttgtaggctcactctcaggtcttgtttgcctttacagagggggttaaggtgatgcccaatgctattgtgcaatccgttggagtcagcagtggcaagttacttatcaagctgaaagacggcaggaaggtaaggaaggaaaagatagtctgccaagaggccttccagttctccactccccttgcctcatttttactccttcatttgacaccagtagattagttttcctggcagttgccattaacctgatataattttccgaattaaccatccctccattaaaacagaatgatgagagccagagtaggctcctgtgaaccactttcccttagccccattctatctgtctcacagagttttgagtcctggctagggtggcagatttctgttcgaatgacatgggggatgtgcatgggatggggtggtggaggcttatgaaatagaacttaaaatccatttatcagaggtaagttaacccatgattttttaaagtcccaattcttaatggcatgaagggccattgttacgcctgtaggcataaatggaaactgtggtaattgactgaattatttcttttttgcctcaggtagaaactgaccacatagtggcagctgtgggcctggagcccaatgttgagttggccaagactggtggcctggaaatagactcagattttggtggcttccgggtaaatgcagagctacaagcacgctctaacatctgggtggtaagtgtgctacagcatgaccaggcataattcattctctctagcctgtgaacaagtctgcccggtggtgtgctaaagctcatcaacagcctaaccaaatagggtcagagtgtttggaggctgagggtacagaatagaaatgtgtgaactgcttgattcagaagaccaggtatggcctcatctgcaagctagtggcagatgaaatgaacagtgtgcatgcctgcaggggtagagctcttgcggttctacttattggcagcagctactggcataacccctggtgggcatgcacataagccttcagatggatctgctgttccctttgctcaaacttgaatccggaggatggaggatgaagcaatgttataacctgttccctagaaaggaaaattactctgttttcattttccttgagtactatttttagctgttttttacaatctattatgacataaacaagactatagtatgtaggaaccatgaggtaatttccccattgctagttacaagtgtattgtgtttgtttatggactctgcaactaaggacgtaggtaccttggaggaatttttttccccctccaaaccttgtttttttttttttttttaaaaaaaaaaagatgtactggatctttttaacctgttataaaagtaatacgtgggccaggagaagtggcttacacctgtaatcccagcactttgggaggctgaggcaggtggatcacttgagatcaggagtttgagaccagcctggctaacatggtgaaaccctgtctctcctaaaaatacaaaaattagccgggtgtggtggcacaggcctgtaatcccagctacttgggaggctgagtgaggcaggagaatcacttgaactaaggaggcagaggctgcagtgagtggagatcatgccactgccctccagcctgggcaacaacagagcaagactcagtctcaaaaaaaaaaaaaaagtaatatgtggtcaatgtagaagacagacaagaaggagagaggagaggaaagtcacctgcagcaaccattaatattttggtgtatttccttccctgtgtttccttgcatgtaggttttattgttggtttgttttattcgtggcaagcatactatatataatattctgctcttttccacttaacaccataaatgtaagcattttctatgttgcttcagactttgtaaacagtttaatgactatatattccattaagcgaatttcacagtttacggttgctcactcgttggatttttaggttgctttgggggagtctaaatagccacaaagatgaacaaagggttagagagctcaaatgccacatccttcatgaagctggtccagttcacccccggctggaggttctcgccctctgcttgaaatacttgactcctttaatctgtacctctcatatggcacactactgtttacattgctctgtagttgtgagcaaggctgtatctttctgtactaggttgtatgctcctcatagtcaaggtccatgtcagttttgtctcagcaacccggacaacataatacttttgtatataataagtactccataaatatttgtcgaatgaatgaatactgagtgacaaaaagaaatctaagaaaacatttctaggtgagtggcagtcacatccaaaaactggtttctacatatagaaaagaatattctgcaaatcatggttattaaatatcctgtctgttaaggaaagaacaggaagtagacataagtaaacaaaactatagaagatttaggttagctttatggaagcagaatagatttttttttctttttttttttgaggcggtgtctcgctctgtttcccagtctggagttcagtggcacgatctcagctcactgcaacctccgcctcctgggttcaagccattctcctgtctcagcctcccaagtagctgggattacaggcgcttgccaccacacacgcctaattttttgtatttttagtagagatggggtttcaccatattggccaggcttgtctcgaactccttgtgatccacccaccttggtctcccaaagtgctgggattacgggcatttgccactgcacctggcctggaatagatgttttaaaatgagatctcaggccaggcgtggtgactcatgcctgtaatcccagcactttggaaggctgaggcaggcacattgcttgagcccaggagttcaaaaccagcctgcgcaacatggcaacaccccatctctaccaaaaaaaaaaaaaaaatttagccaggcatggtggtgcattcctgtagtcccagctacttgggaggctgaggcgggaggatcatctgagcctggaggtccaggctgtggtgagccatgatcgcaccactgcactccagcccaggcaatagagtgagaccctgtctaaaagaaaaaaaaaaaatttaaatgggttatcagctgtttttgttagtttaagtacaactctggcctgtagatggaaaacatgaattagttaccattacaagtgttctttgagcccccaaagtttatattttgtctttaacttgctttttttttttttatcatgtgttcatgttatgtatttgtttccacaggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggtaatagtggtgtgccttggagacccaactgattacaactcagtatctctaggaccataacacagagttatggtttggttttattatgagccagttagcttcatacagaagggaaaaaagtccatcttatgtccacacattctaccctcaggtagccatctggcagaagtgtcctgtttagtttttcaccaaactgatccttttgtaaaacattaaaagagaaaaaaattattttaagtgttctgtctggcgtatgttagactaggtgaatgaatggagatggcaccagcacttccggcaaaataggtcagaggccgaggtgggcggatcacgaggccaggagtttgagaccagcctgaccaacatggtgaaaccccgtctctactaaaaatacaaaaattagctggacgtggtggtgcatgcctgtaatcccagctactcggtaggctgaggcaggagaattgcttggacccaggaggtggaggttgcagtgagccgagatcacaccactgcactccggcctgggtgacagagcgagactccgtctcaaaaaaaaaaaaaaaaaaaaaaggagtgtcagaaagcattccagtcctaaaagatgaaggctggtctggtatggttgctcatgcctctaatcccagcactttgggaggccaaggccgggggattgcttgagcccagaagttcgagaccaacctggacaacatagcaagagctcgtctgaattttttaaataaaaagtttttaaaagttaaaaaaaagaaaagtggaggctaaggggaaatactgtaggttaatgaagccataaaacatctcaaattctgaattccataaatgtggaacactctttaaagcttcaaaaagggaatttcaagacaaaagtagtgaatagcaaaagtgggaacctcatcactttccaaatgtggcatgggataaaagcacgaataaattcaagaacgtttcaatcaccgcatggatatgtggtcgtgtataatggctttttaaggaaaagtcaaagctattagggttaatcttactttctcatggtcatccctagatgctctagcaacagcagatcagttggcatctctcgtgatctgcatactaagttctttggttggcataagagtgcggtgttggtcgggtgcggtggctcacatctgtaatccctgcactttgggaggccaaggcgggcagattacttgaggtcaggagttcaagaccagcctggccaacatggtaaaaccccgtctctactaaaaatacaaaaattagccagggtggtagtgggtgcctgtaatcccagctactcaggaggctgaggctggagaatcacttgaacccaggagggagaggttgcaatgaactgagttcgcacccattgcactccagcctgggcaacgagtgaaactccgtctcaaaaaaaaaaaaatgcagtgtcatggagaatatgtgctaccgtgtcattccttacagtcccttgacagaacaccctcttctctcttcttaggagtgatttgggccccgatgttggctatgaagctattggtcttgtggacagtagtttgcccacagttggtgtttttgcaaaagcaactgcacaagacaaccccaaatctgccacagagcagtcaggtaagaaagtcctagcactcctcttggagagtgttgagaagcagtggtccagattctcctgaacaaggggtttctgtattggccagaggggcttgtcagtgaaagcctctcttcatgttgtgctttaaaagaaaccaaaccccaagtcctcactctttagtggtctgagatttggcaaaatcaggtatcctggtcaaagcatagattcaaatattgtgggtatctgtcctagacagtggacagtggctagctcaacgacactgctgttttgtgtgtctctgggaagacctttctaaggaagaaaacaagaaaacctgaactttttagattgcgtttttatttttctttctttcagttgtcatttttattattttgcttcaggcgaatctcaagaacacggcctgataggcttagcttaagactggctatcctccatgggtcctgcgcagggaggaactgggctgagtagttatttagctgcctcccattccatttggcagatcttagtgccaggttttctttagatgggaggcacctctcttggaatggacttctctcccacacatgtctctttcattaactccgagaccttattccttgaccttagctcaagttatttaacttctgcatccttttgccagaggtgtctcaagggcaaggtgctgtttaagaaggagaaagcaagacattatatggatatgtaggtccttttcctgtgtaattctaatgtattccatattccttaattctgatctctcctagtaacctagtaagtggattcatgtcactgctttgtcgactggacagtattatttggaggctggtggttctcagcaaggtgcccccttcctatgccacccttcccttcccctctttctctaggaagaaatgcctccactatggtttttccaaatggaagtgccttctgctttgtctaaagtacctgtctaatagcactgtccaatagaactttctgctgcgatggaaatgttccatctctgctctgtccagtacgttagccaccagccacatgtggcttttgagctcatgaaacatggtgagtacagataaggaactgaattttacatcttactcagtttgaaatgatgttcatttacatggctgtggctagtggctactgtatttggaccatgcagctctagaattatttcttagaggacaagaaccagccttctgcagtttgaagaaatccagataccaggaaatattcatagcatgaatttaaaatgagataataagggagggaagtttagggtcagactgaccctgtgcccaggagctggcaaggaagacctttccttggctttgtcactggagaggggctggtgaaggccagggtttactgagggggcatagagaaataaatcctctagaagtagcttgaagcaggcctcgaaagactgttggcttctagaatttcccaagctcataataactgaagttttgattttgcttccatgtttatttgttttgggggctggccacaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaaggtaggtgcctgtcataactcttagaggaagatgggaagtacggcttagaaacattcctgtaacttcatcgggtgccctgagatgcattgtcccccggccaggtcaaattgtgcctgagcagaacaaaggtatagccttggctcaggaacattctttttcacttgggacttggctgggtgacctgggagttggcaggctgcttgtttggggttagtagagaactgttcccacaactccctcccagtgtgatatggggactgccccaggtagccccattgtgtgggcatggcctgaacgcaatggagtaagttagggacctattgttactctctctccctcagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaattctgttctcttgtcaagggggcaggtgggtgaaggtggaaagccacgcatattagaaagcaagcaaattgcagcaccgaccaagcacaggatttttctcagccatgtattcatgccctactccagacgcaaaactcctttcatttccgaacttccctcacccctccagacctctttgcacacacctgctgtggcctcggcccacaacacttgactcccctcctctcctctcaggaagttcactatctctgaagactttcccagccttccaagcctcatccttgtgtatgtgtctccctgctagcccatgacttcctggaagcagaagccctgatgttaaggccttgctcatggttttatctccagagcttagcacagggtctgcttcatagtaagtgcttcatagatcattgtcgaatgagtgaacaaataaatgtatggaatagactttgtttacctggaacaactcctgtcccagaactggattgggtcctgcaggggacagaaagggcacttactacaaatctgagttcagagacctggtgcttcacagttaaacctggagacggactcatggaaggaccatcatctcttgactcttctgcctgctgtcctcatgccagacatctgtcctctcttaagctccttttctctgaaatacgcttatgggcatacctcactttacagattatttcctgggaatacgattcaaagtttcacaagtcaactcattgtttggcattttagattgcttaacttttaaaaatcaaatcttattattattattttgagatggagttttgctcttgttgcccaggctggagtgcaatggtgcgacctaggctcatcacaacctctacctcccggattcaagtgattctgctgcctcagcctcccaaatagctgggattacaggcatgcgccaccacgcctggctaattttgtatttttagtagagatggggtttctccatgatggtcaggctggtctcaaactccctatctcaggttatctgcccgcctcggcctcccaaagtgctggggttacaggtgtgagtcaccgcgcccggcctaaaaacatcaaatcttatttaagaggaatttgttactactttcaagagtcctgttgttaaactccatgtatataaagagaaaattattaccagtctggattttttttaaatattgggtttgattaagggcagtttcagcttcaaccaaatcccttctgaacactgggagaacaggccaaatctccaccgtaagaatttgcagtacaggtataccgaacaatactatatagatacaggtttactcaaatgtgatcatatccaaatgatatatccaaatctatatgtagaaaactcatctagggttgcgcacagtggctcacgcctgtaatcccagcacttggggaggccaaggcaggtagatcacctgaggtcaggagttcgagaccatcctggccaacatggtaaaaccccatctctactaaaaatacaaaaattcgccaggcatggtggcatgcacctgtagtcccagctactcaggaggctgagacaggagaattgcttgaacctgggaggcggaggttacagtgagccaagatcacaccactgcactccagcctgggcaacacagcaatattccatctcaaaaaaaaaaaaaaaaggaaaactcatctagtatcctgtgacatcgaaattattatacagcagtaattgctgcttacagagatgggggtaagactaagatcctagtgttccacaaatcattaagaaaagatcaaattgtgatttgtcttgctttagtgttgtatacagttttg

SEQ ID NO: 13226 - DNA, 16407 bp, Human
ttgagatatcatattttcagaaatcaaagtttcttccttacaaaagtagactcagtgacaagtttttgctagaagcttacattgaaataatcttattatgtacatatgtttttttaatatctctcaggaagttagcattaattctagctgtgaattggcaaagggcaaagcccctttctactttgtgtacaggatgtacctaattaatagttacccctctccaccttaaagctattctgtagataaagatcatcaggggcattaacttccaatacagaggggaacgatccagcaaactaggcatcagactaatcaaaaccaaaaatactgtacaatgatgattgatacataatacaatgaaaattggtattcataaggatgattttggattagccaactaagaggaaatccttatctgggtagttttaatgctgagtagtataatgtagggttttagaaatgggcgacccacatatatgataaaagggttagctgtaaatatatctgctagctcagctaataaacttattaactggaagatgccattctgagtaacttggacgtccttgagtagtcacattccaatttgctttcaggtatatcactgatgcactgaattgtttttctctcagcagaaatggatttggtcatgtttgtctcttcctgcagctcaacctcccaaataagatggcagctcaactgtgctgtttgaatccctgaccttgatggcattagcaataactcacgagtcagtgctagtgacatgtgtcagtgttaccttagcttatgaaatatgtagggggagaggtaaagtcttaaaagaaacaaatgggtgcactttatcgtatgtaaattgtacccccagtaaagtcgatttcaaacaaattctgaacccgcgaatgactttagggagaaggaatactggtcttgaccaagatgtgtgtgatgattagtaagctttgggcagcagccccctaatactgtaaggaggttgtgttcatttatcatcttccaagcataatctaggcttctggcaaattagacccaaccactttgttctacattcagctgcagggggaggtgaaccctcctagggattcccaactccctctgaaactccagcgttctggagggacttatggttatatggagggcttgggaatggaaggcactgtggagcttatgccattgtcccaagatcctccacctgggccagtaatggctagccccgtaaacaaagtccccttttgctggaactgccaccactagcttcccccccttctcctagcctctgtgtggccctctcccgcggcgggccttccccattggccagccaaacacaaccgactgcggcagccaataggagccgctctcctgaacattcagaggatgggtgcgcgtggtgtgataaggggatgttggcgcctggtacgcgcccccctacatctggcaagtctgtaacagaaacagttacaccccctacacacgcacacgcgtgcccgctggctccctcctctcagctgtacaggccccggacaacccactgcgtgtcttggcagcggcctcccaggctgcctggggcccgcgagtgcacctgctcactcattaagacagagcatccctttatcccaaggcgcgggtcgggtagagggtgggggtagaggggacggggtagcggggaccgggaaggcgcggctcagctgcccgctgctcccgaggtgaaagaggtgcctccgcccccaccccatccccgcagagttgcgttgctccagggaggccgaagtgatccagtgatgtcttaaggtgcagctctttgtcctccccagctgtgctccctgcccgctgaccccgtgcgctcgagccagtgggggtggggagcccgaaacctataacataaacgggggcaaggagaaagaagtctatcccggggtggcgtgtgccgctgtccccaccccgtctctttcctcctgaggcttcttccctcgggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggtgatccagggggtcaggtccaggaagggtgggacccgggaggggacctcgcccgaggcatagctctagcggttgtcgtcgtccagcgtccagcgcgtggcggtttcgcctcttgctgagccgaggaccctcggctcctcctcaccccttttcacctctctcagcggggccccgtccccacttcactcagttttttagggcggttgagaatggggttgcattcttacccttagcccctgcctgacaggtcctgccaggaaaagcatgttggattcccatccatgacccctaccccgagcagcggcacctgtgggcagagggaggcaggaggcatctgtgggtcctagtctctgggatggatcccaaagcactttacacatcctgatgtctcttctaccgcttgggtgccgataggctgcaaaaccccactttggctaagcctcaaggcgttagagggaaggaaatgatggaaatccatggagaatgaaaaagctgctttattttaaattgcagtttatagttaaaaaattagggctgagttgagatggcggtggagtggggtggttctggcagaaagccatgagcccttttaaagaaattgaggcagggtccagcccttcgtaatagacaaaacttgtttttttgtaacagcccccctggaatgatatcttctttacttgtctggggcatctaatacatgaactgctccttattcattctgttggtattgtcttcaggtctttgtaaaaatgcagtgacttaaccgagggccaggggaatgttcaatcctccccctccatgagtttatgtaataggctaagtgcaaatattcttgtctgaccatttgtgctcacctttaattcagaaaaggtagaaacctgatatgacaggaatatgtcaatgtgcaggggatggcgggagggaggacataacaagggcaacttcttgtgtcatggggagcagaggggggcctctataaaggcactgggatcactgaagacaactcctctaggctcacagctggcctttccttgagcgtatggttggaccttagacagagtcaggggtgacagtaagcctccttcttgctggtcaaactgccaaagtgaccacaaggcccctcctctgagtgacgtggagagaagggctgagtaactgatgaaactgatgaaacacttgaaactgtgcgagactcctgactccttgattattaaaatgaacgtgttctaaaaatggcttcagaaactaggccaactcactagatgtcaggaagatggacagctcagtactgataagggagagccccagggtaggaagatagaacattattttgaaatcgtgatcttttttgccccttgcattttggaagggaagtgctacatttccttttaaagtcaaaggcggtatctgtctctgtcctttcctggggctgttgacatttgcttggttaagacttcctctagtgtgtctagcttctttaatgtaaggctataagattctagaatttctaaaacatgactttgtaatccaaagtagaaatatctttacagatgggctcttaaacctcaaaaacctaatgctcccatttgcttaaaatcaagtgctacagtgagccaaagagttccctggatttaaaaggtgggaaataagtccatctgaaatttagatggaaaaaatgaagtgtttgggaatctaaagaaggagggaggaagaagctagaaagtgagggatgacagatgaacacgagtggaagagtcaccacccagtggccttgaaggaatttttaaactattccttctcttctaacaccccagtacttagccaaactggactttacagtctctggcaaagattccagactttttcccagagggcagagcctgtgacagtgtgactcactagaaacagagctcagcacaacaccacgtgcagataagtgcttaatacaggcttttttggggaagatgatattttcaaggggacaaagccttgtgacactgctcatggaggagtcctctgagggcagattccaaaggagctcagagtggcgtgtgggagtggggagatggtgaccctgcttcttgtaaagctgctgcaatctcaggaccatgctggcaggcgagagaccagcatgtctgtgggaagatggcagagcctggcggctagcacgtgatctagataagagaagatttggcctcgcactctggctagcctgaagttgttcaaggaatacatgccaaagccatgcttggagatgactgccaagggcttcgtcctttgcgagagagagaaaagtccagtgtgacagtccgaggtctggcctagaccatggccagcaatagaaggcttttgggctgtaacataccagcccttggaggagagtggtagagaggtctcagccagctcttctcagtctaagagcaagggtgtggcctcttctgggctgcctgcctgtgtcccggggtagcacatacatgaacccctgctagggacaactgatttggtgtagttagagccacactgtaattaattatcaaggccatccctagggtattgaagccccatttgctgtctccaatcattatgttccccaccctcaccccatcaaagcatttacaattgagtcctgatgaactcaattgtatgaacatcaagaaaagcctccaatgagtaggcaataataataataataataacaactatgtattgaataagcaaagagcccaggctaggcactttacatgcattatcttatttactcctcacagcagctttatgaaatcagcagtattgttatcattcccattttatagataaggagactgaggctaagagagatgaaataacccagtggcacatggatctgagcttcagcctttgactcttgagcccaagcacttcgccacctcactatcctacctttcctgttacagggccacgatttcaacccagattcagagaccatgccctttaccactgcatttcactctacaggacaatattcagtcccctagattgggggagtttgacagggggagatagaatgccaggcagccagtcttgctctttcttctaggccagggacttagggttatagcccaaggcccccaggagcctttcagatgtctccttcaatttgtatccaggacacacagaactcaactgggtttacttttttttttttttttttttttgagagggagtttcactcttgttgcccaagctggagtgcaatggcacgatctcagctcactgcaacctcggcctcctgggttcaagcagttctcctgcctcagcctcctgagtagctgggattataggcacctgccatgatgcccagctaatttttatatttttagtagagatggggtttcaccatgttagccaggctggtctcgaactcctgacctcaggtgatccacctgcctcgacctcccaaagtgctgggattacaggcgggagccctgggtttactttttgcaccttgattatctcaactcaggtgtgagatgcagaaaatgttcagagataaaagagatgttacagattctgtgatccagtgtcctcctcttgcagataggaaactgagactcagagagggaaagtgacttgcccaagatcacacagggccaggcctagaactcatgtctcctaattccctttctggtgctctttccacacatcatgctgcctggcacaaaatcctctctccagcctagctccatggtccatccaacccacaaggccacctatgacaagaatccagagggacatcataagagatagctgacagtctttcctgacatcagcctaggaagggtggaggcatcccccagcccccaaaggaagagtggagcttcccttaatgactatgatgtgtctgtcacctacagatgtagctaaatttattgagtctgtctcctaaatgcattggaaaatgccgaataggggtgtgtgtgtgtgtgtagagagggagggtatgtagtagaggggaggctaagaaactaatttttgaatcattctttgtatatttgcatggaagcttcacttctgtctataatagtttggttcctcccacaggctgggcactccctgtgccccagccctggggacaagacaaactgcaggtcagctgtggctatgggcaggtacagctcaggactgtgagtttctgttcctctactgatcactgggggaaaaaaaataccttcctgtgttacattatcaagtggatggaggctgagctaagtgttccttggaagctgcctgcagtcagaatgacatcatttcttccttagggcttctgagcttctatcttctgccagttaacttaatggttaattatccatcagtgtaagtttctctgtctcccttgctgcttctttctgtgtgtgagtttctctttgtctctgtcctcctttgccattctctgtgtcagctttgtgtgtggatcttagatgcagatgggacagtccagctagttgaaaacaggtttcttttaaacttttcccatcatccactggggcatgctccagaggttacagatgtatttgtctcctttttttgcacttctaccctcccccatcggcctccaacaaaagcacattcatgcctcatctatagaaagatgccagttaatgtttcctagggaaaagaaatccccctgtcagctaagagcacatgcagggggttgggggcttgctgaagctcgcccagaaaatagttcaaaaggttagatatctctttggcagttccccatgctgtgcccctccatcctcctccagcaccccatcagttcgggcctgcccccggccacccatggcatgttgccagtattcctctctccaccccctccccactggatggcctttagctctgtctcaccttcgagaagccaagctttctgtgatttccaggatgagagaccaatggacccaaggaaccataccaacaggagagggcttgatggcctttctgagaccagagcaacaactaatatttgcagagtgcttgacattttccaaaagtcctttctcatgtgttatttcactggatcatcccagcaaccataggaggatcaaggtcccattgcagagatgagaaaaacaaggctcagttcagggaggttaaaagacttgtctggcatttactcagcttctgagcagaagagctgggatgcttgctgcctttccaacagtgcttgctcaagttgttgcccatctagacttaatggtggaggtttcaggccatgaaagaagggagagtgtatattaggcactgggtcacatacttacaaggactactaatcctcatagcatccctacctgattactattgttatcatcactttccagatgaggacactgaagtcagagaaagtaacttacctaaggacacctaacttatctaaggacacctaacaagtcatgtactaacatgacttgggccgagatctgcacccaagttgatttgactccactataccccattggccatctgacagaaacaaggatctggggtacatgtatgtggctgtggctaagaggcagtcttcacccccatccactgtatggatatggtgcccacaggaaaggaggaaagggtgagaggagaggcagctgcgaaagaggaaggagatgctttcactgcttggcaggggccaggggtttatgaagatgctgagaaaggaacacctaactctcaaacaaaatgagatcactgctaggtaaggtggcttgccagcactttgggaggccgaggcaggatgattgcttgagcccaggagatccagaccagcctgggcaacataaggaggaccccatctctatgaaataaaaaaaatatgaaaattagttgggtgtgctggtgcgtgcctgtagtcccagttactccgaaggctgaagagggaggattgcttgcgcctaggaggttgaggctgcagtgagccatgattgcactgctgcactccagcctgggtgacacaatgagatcttgtctggaaaagagagagagagagagagagaaagagaccaggcgtggtggctcacacctagagtcccagcactttgggaggcccaggtgggcagatcacttgagcctaggaatttgagaccagcctgggcaacatggggaaaccccatctctacaaaaaatacaaaaattagccgggtgtggtggtgcatgcctgtagtcccagctactcgggaggccaaggtgggaggatcacctgagccctggggaagttgaggctgcaatgagccgagatcatgccactgcactccaacctgggtgactgagtcgagaccatgtctgattttttaaaattaattaattaatttatttatttatttttgagacagagtcttgctctgtcgcccaggctggagtgcagtggcgccatctcgactcactgcaagctccgcctcccaggttcacgccattctcctgtctcagcctcccgagtagctgggactacaggcgtccaccaccacgcccagctaattttttgtattttttagtagagacagggtttcaccgcgttagccaggatggtctcgatctcctgaccttgtgatccacctgcctcggcctcccaaagtgctgggattacaggcgtgagccaccgcgcccggcgattttttttttttttttaatgagatcatttcatgtgtttagggagcctgcctgctgtgatcttcctttctgatggttctgaggccacaccactggttcttctattttctgctgcgagcagcctgcttcctggctcccctctcacgacagacacgtctgcaaagaactcagggtggggtttacaaagagctggaagggagcagtgcctgcagtttaaattcggagcctccaaataaaagcttcaaggctcccaatagtgttggaaagacagaggaggtctccagcagagagggccctcctggcagttccggcaatttgggcggcatacgcaattatgaagccaaagaaaagccaaatggccaacctcactcagcctcaaacacctcacacactcccacccgtgttcctgctagtggcaggtatttttagagtcctgagctcatggtgttaaagcatctgccacatgcctgagggctggtagggattcagacttcttcagaggcaaaaggcaagagtgaagactcctggggggtggggggagtggggatcaggagccaagtggtaatgatattcctgggctatgcctgctgtcttcctactgacctccattcctcctgtggtctgctctccctttcttcctgttcggaacaccacggagaggtggaagaaatgaaaatattttctgtctcttgcttgcagaagcaaatcagtctttgaggacttatgttttttctgtgtgatcacagtcagacgttctctctgaaatccccttggcacatatctaggatgccagactgcttgtagttttagtggttcaggccatcactgccttttgataatgtgtctgctgctgataatgatgatgatgacaacctcagtgacgagtgtggtctgatgcagaaaaagactgcttacagtcttgctggagagatgccaagagcactgacgagacaattagaaaacataaatctattcaaaatggtatgatgcagactcaaagtgcaacagagattcctaagaaaagagaattgaagggaagttggcgaaggtttgaggaagaagcctgaggcgtgagcttaaccttgaagaatgggtgagatttggatagggcaatgagggggcagctgattctataggggaggagtggactagcatgacccaaagtacagaggagggaatcaaccaggtgtagctgagtagtttgaaaccaggttgggaagggtcaaattatggcagacagaattccacatgtggaatccatgtgatgccacatacagtagagggctgcagtcgtttcctgaagaggtgaatggcatgctgatacaagcagggattgactaaagctagtcagaaagccagtattcagagatcgggcactggggctcacgcctgtaatcccagcactttcaggggctgaggcaggtggatcggcagtgattgggcctcccaacatgctgggattacaggagtgagccactatactcagactccaatttatttttatttatttattttttattttgagatggagtttagctctgttgcccaggctggagtgctgtggcaccatctcggctcactgcaagctccgtcttccgggctcatgccattctctggcctcagcctcccgagtagctgggactacaggcacctgccaccacacccagctaatttttttatattttttggtagagacggggtttaactgtgttagccagtatggtctcgatctcctgatctcgtgatccgcccgcctcagcctcccaaaatgctgggattacaggcgtgcgactgcgcctggcctccaatttatttttaagttcacttttttgttacctaaggtcaggagtttgagaccagcctggccaacacggcaaaaccccatctctactaaaaatacaaaaattagccaggcgcagtggcacacgcctgttatcccagctacttgggaggctgaggcaggagaatcgcttgaacctgggaggtggaggttgcagtgagctgagattgcaccactgcactccagcctgggcaacagagcaacagtccatctcaaaaaaaaaaaaaaaaaaaaaaaaaaagcaagcaagcgagcagtgttcaggagaccctgcaatggaaacatccacaatccaaaatactttgctctagtccaggagtgaggagaggagaggctggccgagggccgagggacacagaaatcagaatagaagaagggttcaatctgaaggtcttgccagaggaacttggaagctgtgtcaatagagggagatgacggggagcctggacaatgaaaactgatattcggaatgatgactctagggccctgtaaaatcttcactcagccgacagattcaattatatttactagattatacttactgactgctaactccaaataaaggctatacttcgttttaagagccatagcagtcaattagtggccataatcaaattttctttgataactgagaattgtatagggccttgggaccatcattctgagcatgaatctcccttgtccaagacgttggatatataaagggaaatagattgggctgaatgtatatctcctgggagttatgtctttgcatatgttacagatagcagctttttcttcataatttggcctttatcccaaaagctgagatacagaagaaaaatccagtgaattaagttccttttacataaccaaaaagtgaacttaaaaataaattggaggctgggcatggtggctcacgcctgtaatcccagcactttgggaggctcgatcatttgaggtcaggaattcaagactagcctggccaacatggtgaaaccccatctctactaaaaatacaaaaattagctgggcatggtggcgcacgactgtaatcccagctcctcagaaggctgaagtggtagaatctcttgaacccaggatgtggaggttgcagtgagctgagatcacaccactgcactccagcctgggcgacagaacaagactctcatctcaaaataataaataaataaataaatagggcttgaaggtgagattttaatactaactttgttttctttaaaaagttattcaggctagtggctcatgcctgtaatcccagcacattttgaggccgaggcaggaggattgcttgaggccaagagttcgagactagcctaggcaacataacaagattctgtctctacaaaaaaaaaaaaaaaaaaatatatatatatatatatatatatacacatatatataacatatatacacacaatatatataacatatatatgtaatatatataacatatacactatatataacatatatgtaatatatataacatatatatgcatacttgtagaagaaaatatggaaaaatatttaaaaagaagaaaataaatatcactatagtctcattgctgataaataaccattaatgttctgatgtgtacacttccagtctgtgctttgcatatgtttatgtttaacgtttcttaaaaaaaactgggaccatagcatatgaaaacttttgaggctgggcgtggtggctcatgcctgtaatcccagctctttgggaagccgaggcaggcggatcacctgagatcgggagttcaagaccagcctgaccaacatggagaaactccgtctctactaaaaatataaaattagccgggcgtggtggcacatgcctgtaatgccagctactcaggagtctgaggtgggagaattgcttgaacccaggtggcagaggttgcagtgagccgagatggcgccactgcaccccagcctgggtgacagagcgagacacggtctcaaaaaaaaaaattctaaataacactgtaagatattagtacagaattttgaccacatccctatttcttttgtatagatttctggaagtgagatttcaggtcctaagagttatgaacatttttgaggttcttgataatattgccaaattgctctccagaaaagttgaccaatttacatccagtttttcaactaaaaatcttaagatttttttcaactcaagattttcagttaacaatcttaagaaaaacttgacaaatcctgaaacttctctttatgctttgataagtccattctgctcatctgtcaaagaaccacttcctgtgtcacggcttgtcactttttttattttttttgaaatggagttttgctctttttgcccaggctggagtgcaatggcgtgatctcggctcactgcaacctccgactccctggttcaagcaattctcttgcctcagcctcccccgtagctgggattacaggcatgcaccaccatgcccggctaattttgtatttttagtagagttgaggtttctccatgttggtcaggctggtctcaaattcctgacctcaggtgatctgcccgcctcagcttcccaaagtgctgggattataggcgtgagccaccgcacccgtcctgtcacttcatttttatagtgctacagaaccatgttttctcctctctgttcatgttcccttttctgactccacctttgggtttttgtatcttccaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagattatcacatggctttttgtcttgctttcctccaagacattcctgattgtgatgagcagaacaggcagtttgccctactagagtgatattctccatgccagtggcacactccctaccagctttctaggctctctgaaattctcatcgtttgagtcacttcttcaggactaattcattctctcactcagtgtaatcagtgggcagaaacacccggtggggttgggacacaggccagatatgtttttctagagagcaagtgcaggtggagtgatagagaagtcttgaaaggagatgtggactcatcagtatttcctaggttccctagatatgtgccttgaatgtccagatagactactctctccctattttccagtttaaaagtaaaaagtatggccggacgcagtggctcacgcctgtaataccaagactttgggaagctgaggcaggcaggtcacttgaggtcaggagttagagaccagcctggccaacatggcgaaaacctgtctctactaataatacaaaaattagccaggcatggtggcacatgcctgtaatcccagctactcgagggctgaggcaggagaatcacttgaacctgggaggcggaggttgcagtgagccaagattgtgccactgtgctccagcctgggtgacagagtgaaactgtgtcaaaaaaaaaaaaaaaaaaaaaaggagagttggtccagtgggcccaattacttccagaatagttagattctgcttcccatttttcaccaatcagtcttgaaccctaaggctgttccgactgtgacccccacccccattctttcttggatgggcagggctcaagcaacaaatatctatcatgtccccagacctttgctaggtgctagggaagaaatgttacaagaggacacattctctatgttcagagaccctatgatctatttgcaggaacgatgtacacactgaaagtacgtgcaaacaaaaactagacaacaacatcaccaagtgtgaggttgtgccatgggaagtgagagcattatgtattcaatatcagggagggctcataggaaaatacttagatttgttttgtttgttaaataatgtgtaaggtttagattggtaaaggagagggaagcgggcaaaatcagggcaaaatcaggggggcaggaatgaccttggaagttggaagagaggacaactgggggtctggcccaaggagagctgagcagtgctaacaggagccgaggttgggaagggcttgtgcatcaggcagaacagtttggagacttttttttttttctgagacagagtctcgctctgttgcccagactggagtgcagtggtgcgatctcagctcactgtaacctccacctcccgggttcaaacaattctccctgcctcagcctcctgagtagctgtgattacaggcacctgccaccacgcccagctaatgtttgtattttttagtagagacagggtttcaccacgttggccaggctggtctcaactcctggcctcaggtgatttgcctgcctctgccttccaaagtgctgagattacaggcgtgagccaccgcaccgagctcggacttactttctgagccaatgagagctcttggtagttttccagcaggagagtcctatagttatttctcatacatctggtcttattattgatacgaaagctccttgtccaattgtgaaagtaactaaaagtggctagtaaaggcttgtctacaatagctccaggtggatttctttgcatgaaagatggtgtgctcctttaggggtctctcttgttggaatcccgctgtgagggggtctcgggaagacagctcttgaacactttcctctgttaggcatatggagctctgctcctagacagcgaagggtaacacacaccagatgttcttcccacccaaataaagagcttgtctagtcctgcctggctcatccttgcagccctctccaccccatcccatccccctctggcctcagactcagttcagcccccagtggc

SEQ ID NO: 13227 - DNA, 118923 bp, Human
ttagtttaaactattaatagtacaactttgatttaacaaatgaggaagctgagcttacgagatgtctgtgaagcccattgtctgatcttttatttccttagtacctgggaatgcgcttttttttttttttttttttgaagaacaccaacagttgttcacccttccttgaatttgggtacactgtatatacagagtataccaatttagcctgccattagaacatgtcttcacgagcaaaatctagtataaagtcttactttaatattttctttattatgtataaataatagatggttgttatggaatactggatagtacaaaagtttagaatttttaacattttggtttatttattgggactcttttttccccccagtgattcttgtttctccaacaatgtgaatgcgcactccattcagtgtgaacgtgaatgttaatttatgtgccagctggattctacaggaagcagacacagatggggttggaggggcaaagggcttattagaggagtaatgcctgtgaagaaaaggggaacggaacatgtttgggtatagggagccatcagactgcagtgcacacctgacgaagtctctgcccacccagattgcctgatagaggaataccacaagaggtagaaatggctaggctcttgtactaccactttgcacagtcattgactagagatagatctttgatcaatgtagagattttcagccttggcattgttgacatttgggactggatactttgttatagggggttgtcctgtgatttgtaagatgcttagcagcatcctaggcctctatcccctagatgccagtagcccagcctccctgctattagttgtgacagtcaaaactatctttagacactgccatatgttccctagggaagggcctaatggtatataaacaaccctatggtggcatagtccaagttttgggacagggaggagtgttctatactacccttactggaaagacctatgagctattcagaaatctgaactatttaagatggagctttgttctgtggctcctggaattttaagcacacccctgtgaaacatcttgttaggatatactccactctccaaaacaatccataatgtttaaatagggctgttttattgattgattgattgattgattgagatggagtctcactctgttgcccaggctggagtacactgtcacgatctcggctcactgcaacctccccctcctgggttcaagcaattctcctgcctcagcctcccaagtaactgggattacagacacccaccaccgtgcctggctaatttttgtatttttggtagagacggggtttcaccatgttggccaggctggtctcgaactcctgacttctcaggtgatccgcctgcctcggcctcccaaagtgctgggattataggcatgagccaccgcacctggccttatttttctttttgagatggagtctgactttgtcgcctgagctggagtgcagtggcgcgatctgggctcactgcagcctctgcctcccgggttcaagcaattctacctcagcctcctgaacagctgagattagagatgcgtgccaccatgcccagctaatttttgtatttttagtagatgcaggatttcagcatgttggctaggctggtctcaaactcctgacctcaagtgatccacccacctcggcctcccaaagtgctgggattacaggcatgagccaccgctcctggctattttcttttgagactgggtctcattctgttcccaggctggagtgcagtggcacaatctcagctcactggaaactccaccttctgggctcaagcagtcctcccacctcagcctgctaagtagctgggattataggcatgtgccaccctgcctggctactttttgtggagatgggattttgcatgttgcctaggctgggcttgaattcctaagctagaacaatctgctcagggatgttgtatatttctaaaggtatttttccttttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctaggttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttttttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctgttttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatcccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaataataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccagttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacggtgaaaccctgtctgtactaaaaatagaaaaaaattagctgggcgtggtggcatgcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctactgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctattcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtcccgttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaataatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgggtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaaatttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacgaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacggtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgaacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagtaagcagccaggatgaatcttaggaacgtaatgttaagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaattggttccctttgggttggcatttcctttattcagtctttttttaaattattatcaaagacagaaacgttcattcttcatttctgcctcttgctcttcccagtccacttttgccttcattccatctccaaatgtagtaattttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctattttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactccgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctgtggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggattttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctccacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacgccattcttctgcctcagcctcccgagtaccacccgccaccacgcccggctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtctttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctagtaactctcaactcatcctgcacgttggaatcactttggttgtgttagagtagggagaagcaggcaacagtattttaaggcccctagccctccgaggtgattatgatacacagcaagagcagtttttttgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcaatatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccacttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgtatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcggaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtcccaagtcactagttgttccccatctgtacttgtgttaactttggtacaaggctttacacatattttctcaccctgatgtttcattacatcagggtttttttttttttttggttttgtttgtttgtttgtttgtttgtttgagagagggtctcactttgtcacccaggctggagtgcagtggcacgatcttggctcactgcagcctcaacctcccaggttcaagtgatcctcccacatagccctccaagtagccaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatggaaggtgcctacatttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccaggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaatcctctttggtcttccagagatcttgagagaaaatccgcccatgtatacaaaatttagagacttttgatcagatgtggtggctcacgcctgtataatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccacgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccccgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattct

SEQ ID NO: 13228 - DNA, 45249 bp, Human
tagccgggcgcagtggcgggcgcctgtagtcccagctactcgggaggctgaggcaggagaatggcgtgaacccgggaggcggagcttgcagtgagccgagattgcgccactgcactccagcctgggcaaaagagtgagactctgtctcaaaaaacaaaaacaaacaaacgaaaacaaaacaaaaaaagaagcattgctgtaaatttatatttggtataaaggggtattagcaaagtagtaggcaaatacatggcaggaacagaatggtgtttagaaacacattcaagtgtgaatgagaaattattaatgaagaggacattttgtctatttgagaaaagagtggtttatttaaaaatgctttaggcagtttatctgagaggaaagaatttagctttcaccgtcatacgatatagaaaaataaacactgttgaattaaagatctagatgtaaaaattaggtaaacactggaaaaaatacaggagaccgatagtttaacctttggatagctgaggccttttaaaactagattggaaacctagaagctgtgaaagaaaaattgacagatttagctgttcaagtttacttttacttttggaagataatgttctaacacggtgaaatcccatctctactaaaaaatacaaaaattagctgggcgtggtggcaggcgactgtcgtcccagctactcaggaggctgaggcaggagaatcgcttgaacctgggaggcagagcttgcagtgagccgagatcgcatcactgctctccagccaggcaatggacgggactctctctcaaaaaagaataaaaaaataaataaataaaaagagaaagataatgttacaggacaggggtcctgatctaaacctgaagggaaggttctcggatcttgcgcaagaaagaattcagggcgagtccatagtgcaaaatagaggcaagtttattaagaacataaagtggcgcaagaatagctactccatagacagagtaggatgctcctgaaagtaagaggaggaacgcgcccaccctgggtacagtgctggtatacatgggaagatgtgctctgctacagggtttgtgataaaggaataattttcttaattactatattaagataacattgcaaaaatcaatgttatctttaaagcaaaattaggaatgcctttgttctgcagatatcgggatatctggacactcccaagtctggatctgttttttaaacattattaatttgttcccttaactggaaacacccggaggctcggaatgcctaattttctgggaatgcagcccagcaagtcccagcctcattttcctagccctcaccaaagacggagtcgctctggttcaaacgcctctgacagtaatactcattctaaggtgtagcaacataaagtatctatgactagttctaaagattttttagagccacctagcaaataagatgcggttgtccaaatttgttactttacttaatttatctagaacattttagaaaaattaaatggcttaattgaatgtggctggtatcactaggctgcatttgacgcccttgaatacttgctctgtggctctcccctcccttggcttttgcaacactgtcctctccattttcttattggtttcctcagtggtactttctccttctcggccccatggattggtttcttttcaaagttttctgtccttgagcttgatcttgtagatttcctatgtgttctgtttgggcattctcatccttctctttatggctccaaaatgtgtgcctctagctctggcctctctgaagtttcacagtttgtgtatatttggatgactcacaggaatcttaaacccgtattttcaagactgtatttattttctttctaccaaccatccaaccactgaccacctattttacttcttgtatttctgtcttggtggaaggcaccaagatcattttctctccttgtattgttacagctctaattcatgacttaattctatattgtattcagatacagaattcgttgttgggaaggactggggaaacagctgtaacatttgccaccctcagaagctgctggtcctgtgtcacaccaccttagcctcttgatcgaggaaggtaaagaattactttcactgatttttatctaatttctttgccttttgtttctgctgccttcacattgtcttctacagatagttattttctaaacctgcatttgtgtacattagaatgcaaactaagttcttttcaaagggcacaacagttcaacttcgtctcctcccggccctgctcttctggtttattttttgttgcttgaacaaaagacaaactttttggtgcttggtcaatctgtgtggtgccataacttctaaagctccatccctactcccactcccctacaccatcttcacttgtcctcagccttttaagatcacaaaaaattgccatttgatccaagaagatttctcagaaaatgccagaactagtctctaccttttactgtactcttcctgaagcaccattaacacttgattgatacttacctttaggttatatgatcaatttgagttaactttttgtatggtgtaaggaagggttacaacttttgcttgttagttatttcagtaccatttgttgaaaagactgttctttccccattaaattttctcaccaccccattgaaattcagttgtccataatataaggatttatttctggattcttaaattgactccattgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttatacagctgagatcttttttaagctaaccttagatttaatgaactagttatttaggtccaaaagaaaaggctgggcatggtggcccacgcctgtaatcccagcactttgggaggccaaggtgggcggatcacaaggtcaagagatcgagaccatcctggccaacatggtgaaaccccatctttactaaaaatacaaaaattagctgggcgtgatggagcacgcctgtagtctcagctactcgggaggctgaggcaggagaatcacttgaacccggaggcgaaggttgtagtgagccgagatcgcgccactgcactccagcctgggtgacagagtgagactcggtctcaaaaaaaaaaaaaaaaaaaaaaaaaatggaactcaaatattgttgaggtagcaaatattctatcatctgaaacctcagtggtaaacacaatacccaaatttaacatatttttgttacttgttaaatacatgcgtgtaaatatattcacttaagtaaactaagtggacaaaattaggtaagtcttttttcatatccaacttatttaacttgatacactttccagctttcaacataattgcaaatttttataatcttgtaagataatgttatgtaattcaacttgtcagtattattctagtgctattagctatattaattacataaagacattggtgtaaggggactcaaaaattcataggtttgggtagaaaatgagaactagacagtgatttcatcactataaatttagttgttacttagcgtcccctgaggctaatgtatggcagatccctgtagccataaattgcattctgggctttaagggattaaaatataattcaaatccttcaataaaatcataccattcacaccattacctttgaaaataaatacttggaattctagtacataccttagatcttgtttgtacatgccattcaatttattataatgctttaaaaaagatattgatgcaggattcttgctccttagttcagctaaatccaggttcttgtctcatgaccagaaaaaaattaggcatgtggacacattgaaggatgaggagggcggaatttattaagcaaaaggaaagctcagcaaagagaggggtcctgcaggcaggtttctacctcacaaattgaataccagggccaccacacaggagctgaagagtgcagacttctcctctgcatgaggcacaaattcctggtggctccaccctagggcattattcagaaagaatcagtcaggaaacggtgggcaaactgggacagactttctccctctgggtcacgggtttcaacctggaccagcagtccagtctttcagccttcaggttgctttaggcttgaaggtgaggtttcgccggggactctaccctatctgcctaggtatttgtctgcctccagcctctatcaatatggtactacaaatagaaggaagaaaaaaaagtcaaatcacaccttaggaaattacagcctagtagcatcagtaaaaatggtactgttagtcatgtcatgaaatagacgtaaaattgaaggttgattttctttttttttttgagatgaggtctggcttcgtggcccaggccggagtgcagtggcatgatcttaacttatcgcacttttcatctcctggtctcaagtcatcctcccacttgattccgcctcttgagtagctggtactacaagtgtgtgccaccatacctggctaacttttgtagtttttgtagagacagggcttcgtcatgtttcccaggctggtctcaaacttctgagctcaagtgatccatttgtcctggcctcccaaagtcctgggattacagttgtgagccaccatgctggcctgtttttcaattattgattgctttcaagttggaaagtgcattgtgaaacactcaaagatgttgctgggattatttagttcttttgatactatataaataaatgacagagtaacaccatagttatatgattggaactcaagaaatattaaatgataggattgaaaagagttatatgagtcatttgtccagaatttataaaatttttttctgtatcccaatggaataaatttaaactatgtatattctctgaaatagtcttccagtttgcccaacatgcttgctctcctgactagatattagctaaaaattaacaaaacagtcttttctcctgttactgtgtggtaaagatgtaaaaccctttttgccagcagggctgccctctactggactatttaaggtattcagtgagcaggtcaatatgactattttacaagaaggtaacacagtgggtataaatgtaaacatcccatatcccaaacaaactgaagttccctgaatagttaaaaaaaaaagccctttaataaacttttaccattaaaacaattatggtcggctgggcgcggtggctcacgcctgtaatcccagtactttgggaggccgaggcgggcggatcacctgaggtcaggagttcgagaccagcctcaacatggagaaaccccgtctctactaaaaatacaaaattagccgggcgtgatggtgcatgcctgtaatcccagctactcgggagtctgaggcaggagaattgcttgaacctgggaggcggaggttgcagtgagccgagatcgcaccattgcactccagcctgggcaacaagagcgaaactccatctcaaaaaacaaaacaaaacaaaacaaaaaaacaattatggtcattttgagaactggtagtgaagtttatatggtcttagtctccatttcaaccttggaggcagatctgtggcaatgagaatagtaatgtataggaacggtgggtctgctctgatgtcagtcttttatgatgatttgtatattaatacaaatcacgtttttgtgagtccattcatgctgtggatgttttcttaggcattagcataggtcatagtggacacatactgaataggtcatatctgttaaggctcttgctacaaagcatcaaaacttttcagaactatttcctctgtgaaaattcattttaagtagcaagttgtttttttctgtggttcattcccatgcctgagatttgcagtaatgtagaactagtttaccatcactgctgaaacactcatagaaggttccaaattcctggtccagggaaagagcaaaagcctgactcacataaataaacaactgaggttgcaagtttaaggaacttttttgatgaagtcaaggagtctttggatggttcgagttcactctactgcctgcttctttgttttcataataggaacatgtcccacagcctttagtaggatgtcagaattttcttgatgttgccagcaggatcctgtgtcccaggaaactacagtggaataaggggggtctgaggtgcttgctttggggagacctctagagtaagtcctttgctgccagcagcagttaagggaggtagctgtgacattgtcttcagcttctgccatcttgttaggtcccaggtgagattttgaaaaggattgttcaggggtggtaagagctcaaacaggcctgcctcagcctcacgataagccactgcatctggctaatttttttatatatgttttttgagacagggtcttgctttgttgcccaagctggagtgcagtggcaggatcacagctcattgcagcctcgatctccctaggctgaggtgatcctcccatctcagtctcccgagtagcagggactacaagtgtgcaccaccacaccctgctaatttttctcttttttgtagagatgaggttttactatattgccccggctggtcttgaactgctgggctcaagcaatccgcctgccttggcctcccaaagtgctgggattacaggcatgagccaccatgtctggccatgatattatttttaattcaaaaacaaacatgcaaaattaaattttagtgagagaacttagttggataacatctttcttctgggttattagggtatgtttattctttgcaactctgatgttctaggtgtagcaagaccgtttgttttcattttgccattttcctgtacagaaagctttaatgtctccccatgacctttatggcaaaaaccaaattccctcgaccagtctttggattactacacaatacattgtcaaagaaaatagcctggaatggtgaacagagcctgaggctcagttgggagtcctgacttctcatcagctgtgcatgagcaaatttggaggtgttccttaacttgtaaaatcgatttggatttttggtattttaagcatgatttcctttagttctttttttttttttccagagtgctagaattcagtcttttagttctttgaacatatttataatagctgctttgctgtcttgtctactaagtctgacatctgggccttcaaggacaatttctgctgcctgcttttcccttctttctgtgtgtcatacttttctgtttatttgcatgcctcatgattttgtgttgtaaactgggcattttagatagtattttgtagcaactcggaatactgattttccctcccctcttccagggctgctgcttgttgtgttgtttccttatttgttaactgacttggctgagctattacactgaggtttgtttattctgcacagtgtaccctcagatgtttctcctcaagagggtacacttgggcacgcacatagtcaccctggactgcccttcttgagagatgatagccgattttcagcagggctttctttaactctcagatctccttgttaagcttctgctttcattggtatcaccacccagcaactattcttcactaattgctaactgattgctttattgttttggacaaagctttgggccataaatttccccacttgtgatccagttaaattaagatgccctttgtataggggttgtgtttgatggcagtctttgaggcttgtcatgtcaaaaaggaggattcttaggtatctctttccctggttctctgtgaaacttctacagtagttggttagtctttcacttgctgctgtcacagaactaccagcctcattttttttttttttttagatggaatcttgctctgttgctgggctggagtgcagtggcgctatctctgctcactgcaatctccgcctcccaggttcaagcgattctcctgcctcagcctcccgagtagctgggactacaggcgtgtaccatcacgcccagctaatttttgtatttttagtagagacggggtttcactgtgttggccaggatggtctcgatctcctgattttgtgttctgtcctccctggcctcccaaagtactgggcagcctcatcataattgcttaccaccaatgtctgtgttgtttttgacagtgccattaggcatgaacttttccattctttgttctaaatatagtcggtcttagaaattgctaaggggctctgtgttcttacagcctgcttctccagcctgtgcagaacctttgtgccattgttctggagctggggctggggacagcagcttgattttcttatagttatatctgttctgtgagtggtctactaggccatcaatgtacccatcagtcttctctgtttggagcttcttggcctgcatggaacctctgctttacaagaggtgaggcaaagatgatctgtgcttggtgtccttggcctgatgcatctggggtagagcttctgccctaagaatggggactggatgaaagagaaaggattcttcagttctctcatctatctacacttgcctggaatagaatttctgcaacacagagctaggggtaggaggtgaaaaatgctggctgcttgcgtcacttgggaagaaatcgtagtcctggatttggagctgggtagggttaactagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatcctgggtgagatcctgtctttaaaaaaaaaaaaaaaaaggtattattacccacctgccacacaatggctgttcccctctgcccggagtgctctttcttacccaaataggcacatggtacgctctctcttccttatgagtctctgttcagatatcacttagctgtagcacctctccaacgttgccccagtcactttctattttccttacctgggtttattttcctcataacatttatcaccatctggcacgtacacatgcatgcatgcatacctacatatttgcttgtctacctctcccagtgaacgtgtaggttgcacgagagcgggaacttaggccgttttgtttactgttactttcgcagtgcttagaacgatatctaacatagtggattttcaataaatctgatgaatgcaaagtacagaatgaccaaagtatactgctttcttgcgtcatagtttaacctaacttgaaaactatctgtagagccattgtggaaaatgaattttttgtgtttgcaaactccagttgcttgttgctgactagagtgagaatggggctcacagggaaggaatgtggtgattatttggcagtggctgctggggctgtgagagaggatggatgtgttgtatttgtaaagtacttgccatccctaatgcagtgagatgctaaagcacaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggtaagatgatctttcattgcctttgaattctttcgaataaaatatcctgttagaaatgaagtaaagggcaagcacagcctgcctccattagaattcgctgttgaaggagaagcagtgtaggaagggggctagactaccttctaatttcttcctgtacttaccagcactgatatgttctgagttttcagaaggacatcgcaacccagtggtgtggagctcttccccagtgtctaccagggtttggaatgtctagggcagttttgagtatgaaaccatactccctgtctctagagcagctgggtgctggaaatggctccaggttttggggtgggacctgctgtgttaaatgtggcttagatgtgggttgcagtgagtgcttcatgtctttgtactttggctgtggcagttgcatggttcttaaaacatttcttttcagaaatatggagaaacctgccattgttgatttgaaacaacgggcaagatgttcttagaggcagtgtaacagcgattaagagcctggactccagacccagactataggtctgaatcttggctttgccacttaactggctttctgaccctggaaaagtaggttaactaattcgcctcagtttctttttctgtaatatgaagataatgatcattactgacactcaagagccaagctgttctaagagctttacatatatcatcttaagactcacagttaccctatgagttagttgttattattttcactttacagatgacagcactgaggcacagatagttaggtaacctaccccagggacactacagctagggaagctgggactggaatccaggccttctggctccagaactcataccctccattcttcactgatcacagctttcatgcttgtgaggattgagtgtgtgtgtatatatctgcaatgtgcttagaacaatttgtggcacttaatgtaaatgctctagcttttattattagattactattatcttgagaattcaatgaggaaaattatagtagaaaattcaatgaggaaaattagatcatggaatagtgtgtttcactggtagtatagaaatggcgtgagaatgccgtttatgaacttggatatgtgacttccttatgagcagttcttgaaactctagtaagttaaaaattgaagataaagtattttttagagggggtacagtgaagtgatgtgtagttggttgataatttggttaggtaataggtttaatatcttttaaccatttccagctactttgatccccaactggctttttttcctgtcagttacaaggaaaccgtcaactcttgaaggagagtccaaataactgcaactatggaatgaaaaactcagagctcctcttttactggagggccagagggatgttgcttaacctcctctatatatggcccattaattttgccacttaaacaaatttcatacatcattttcctcaaaacatgaaggagatgccaagcaagttgatgtcagtaattcctagaaactaaaaacattttaactcgacaacagaatatgtaaatttcctcacgtttaaatagagtagttgtgtatcttgttttatctgaaaccatcctgatttatacttgttgctgtgacattaatagtgcccccttacagtctcaaaagtgccctagtttggatagttatgtggtcaccttatttttaagacatattccctatttcttttgcagacttagaaaaaactgaatttttttctatttaagatctcgctgaagttaatagcacatttctagaaattgaaatcatgagttaagcatgtttgatttttcttttccagcctatggattgtaatttccaaaacattttatcataatgaagtttgcttttgtcatatttacatatctggcactgcctttttttttttctttttttttgagatggagtttcactcttgttgcccaggctggagtgcaatggtgccgtctcagctcaccgcaacgtccgccttctgggttcaagtgattgtcctggctcagcctcccgagtagttgggattacaggcatgcgccaccacgtccggctaattttgtgtttttagtagagacaaggtttctccatgttggtcaggctggtctcgaactcccagcctcaggtgatccgcccacctcggcctcccaaagtgctgggattacaggcatgagccacagcgcccaaccagcacagctttttatggcactctgttcttgagtctgtttttgagaaatggggtagttatgagaaggtactgaaaacagtacatttttatgtgcaaaagttttctacttttctatctgcttatagattcatttttttgtctttgatatgctatttgaattcaaaggttggattctcttttagtctaagcatatatacagaagtcttatgtttcaggaagcttcgtttttctccggtatcccacacatattttattcattttaatgtggctagtattgtctttcagtcgtcattcggtatgtacagcagcaaactagttctcaattgtgtaaaaagaagaaaagcttatgtggtgaatatgaaatttcttcctaattcgtgtatcagtataactggacaaaataaaatcctagagctatgatagttgtttcctaaatgtgcgtgtgtaagtgtatgtggctctttcctgcttatcttaaccatagtgcctttgtattcaatgattattcaacaaagtatgaagtatttgaactcataaaagttaggtgagacagactgttttttagcaactttttctgtctatagttcattactgtgaagttttatttagttagtaaaaggaggttttgaatttctatatgtcagaagatctgcctactagcatttgctatgaaattggcatttgtggttcatcaaactttgttcagaaggctgtgtctagactgtgtcttgggaacatgttatagttttctttaggttcattgggaaagtagaattaatttttagattttgcatataataaatgaaacaagtagtttctcttggccatactcaagaagaaagtgtgcagtgtcgctggttagctgaggctttagtttctgttcattctgtgttgcagctgtggcagtgatctgcagactgcagagtgggtatctcagctgcatgttaaacatgctaggcctttttcgttttcccctctcttggtttcttgttacacccattgcattgcatcagtagcagcatctgcctagggtgttgaaaaggggaactttcacaactggtgggttaagctgtgtactttctgctattagtgcctgctagctgatcaagctcagtgaagtgtgtcttcattaaatagtttccatatttgaagataatcttcaactggaaaagaaaacgaatgttgtagcaatatttaaaatattttttgagtaagacttttggggattaaccccagaatgttgtatctgatatggttgaaggaaagatgcacaagccttatttcaaattaatgaactttgaagctttgtttccatcttatcccaacagtctattttgaggtcctgaggggaggatgagtggatgaaaaaaggcagtggcgatgaccctgctctcgttgtgtccaaggtagagtagccaccagcttcactacgaccagattcttccttgggggacagaaaaacaaaaggcacttggttgcttggcaggccttttcagggtccttttaagtttcatatggttttataaaactgtagcagagttaagagctggaacctgtgtcagcatcacctgattccagtgttcccagcagtaaatgcattgcactaacgtcgtcttgaaatgaacagtgaaatgatttcaggacaactttaaaatacatgtatacctgaaatagaacaaagctgcaaagactaaaaatagaaacagaaaagagtacaagctggctcatatactttgtgagccatcagaaacacttgattttttcttagatattttataaaaataagaagagaatgagggattatgtaatatggtgcttagagaagacttcactatgacattccttctaaattgatccaaaaagataatagaaacactcatttatgtccttgtaagttgacttagctttcttttcctctttcttaatgccgtcttttgtgttatttcttagtcacatttttttaccctgtttgtgtatgtgtataaaacttattttctgatttattaggacatttgcatcatgctatatgtaacaaattatggtcagtctcttggctgggatttgtgggttggttattatattactcttctcttagtttccccttccaaactgtccctctcctttcatcctatttattaaaggcactgctgcataccaaattgttgaagccaaaaaatcaggggtgtctgatttacatcccttacagcctccccccgccttttttttagcaggcctccttgcttccacacttgcccccaactgtaattcactcacacacagcataaaaatgatttttcacaattgttaatcaggccaccttactcacctgcttaataagacccggacttctttctacagtgcagttgaagcattgtgattttatgcttaatctctggaatgagtttgcctgggttcatattctagtcccattacttattagttacatgattttgaacaagttatatttactctacatctccatattctcatgtgtaaaatagggataataatagtaacagttttttacaggtatggtaagagtttaataagttaacacttgccgtgtccttagcatgtagtaagcactaataaaggttagttaccctcattatcattatcatgattattacaactatccagatctcttgaatatttttactctgtggctcccctcagaataattttttcatagtgatcttcagttgcagagagaatggttaaatgaagccaggtgtactttactgaagaagacaggaatgtgtgtaattttgaaatatttctaaatagtgaaagtaaaacaagtcctagtgcttaaagaggttttcagtaggagacaagattaccacctgtaagtagagagaaggaagggtggaaggtgtgtgtgtacgtgtgtgtgtgtgtgtgtgtgtgtgtgtgtgtgtgtgtgtgtattttgagacagggtctcactcttgcccaggctggagtgtagtggtatgatcatagctctctgcagccttgagttcctggggtcaggtgatccttttgcctcagcctcctaggtagctgggacaacaggcatgtactgcacgtctggctaatttttacacttttttagacatggggtcttgctgtgttgcccaggctggtctcgaattcctggcctcaaatgagttgcctgtctcagccttccaaagtgttgagattacaggcatgagccagtgcacctgcccagaggaggctatttgaatagagagaaggtttcagaggtatttcagagggtgagaaaacgaatagaccagggatgtatgataggattgcttcagggtgttgaggtcctagatttaataaggttggctgttctgcagcagtgttcaatgatattggcaaggaataaatagtttaatcttgtcttgggctagccatagggacaaagttaggattagaaacttttccagcacaaatcagatacaatatagagtgggtagtgtcctctaaatgtaatatttatgaaaaacataattactagatgattcagtggtttaaagaattaaaatcatgagattcagatttcgttttatattttattttttacatatgtggaaatcttacgctcatttgattcctttgccacatggtggcatcattgcatgagtttacatatttagattatatatcaaacaccttttcagaacacacatagtctttgaaatttataaatcctgtcacttacatattagaatctggaaggtagtgcattcttaacctttagagtgtaaaattcttaataattataatccagttcctgcacattttggccaagttgtcatctgtcttctaaccctcacagagctccttttgaagtcattggagctccctgtgctgagcatttcatgggggtaaagagcaaggtgagagtttgggaccagtaaagtaaataagtaccatcttaaatgcagttgctttatccatcaaaataaaaatttatttcttaaatgcgtaattgcatgggacactagatggcagcatttatccttttccgtttttatccaacctcttctagaaatttcttaaatgtttacatttataaaatgaacatggtcagatgattttaaggtgtttgagatgtatattactgacacagccatgtttgggaattaattacctatatatttttgcagagagaggagctttttatacagtccgtatgtaattagggatttatggttttgtctaagttgaggaaaatttctaaagacaatatgttaaaaaacttcaaaagggagtttttactaatgcatatttggtattaccagcacttacgataaacagataaaatattgaaaacctggcggtgccagtaagcatttaaggcttgaatagagggactttgaataatataactagtccacctggttatgtaaacagaaacttgtttactttgcttttgcttatccagagtttggtatggcaattcaagttcagcaatcataaagatttctgttagcttggatagagaaagtttctgtgaatcattttataccgtctgatactgacatttaggaattcctaaatagagagaaattaaaattttggcatctgcggtacttggtactaggctaaatattaagttaacacctacatcatttaaatagatgaaatttataagtagattattagtgtatgaccatttggccaggcagttgacctttacgagcctatcaaactctcaatatttttgaaaaccaaaaataaagccaaaaaaccccccagttacaatataagatttgagttgttatagaagatgtcacaaaatagctaatttttaaaatagatttttcactcaaactcagtttctggctttttattaaaaaaataattctatgcaaacgtaactttctggttcatcataacatttggacgatattctggtttcttctgtaaattattattttgattacattaaaaaaattttttttgttttatcaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcgtatgtagactttcttatcttctggaagaatgaacttaactgatatttattgaaatactttactctgaagaggttaaaattctgatgttaattttcacccagtgtccagttagtggagaactctgttgtgacttggaatttttggtttattttggaaaataaatcaattatatgacaaattgtaccaatcagtgttgcagtgaggcttgaacctcttcatgggagactttcaggtcttgagaactagacctacacttaggggccgttgttccaataccatttctcaggaatcctctttagaagttactgtcaattttgttctgtcacctctatcagtaacaacagttgacctccgaaacacttccatactgaaacctggtgaacttcaaggtgcaggttaaacaatagagttttcatattgtaattatctgaatggtaattgtggtggctcagtctgtgagatagttctggaagcataagttcagaggtctcggtgccaaaatgtgacagtaatttgtggatgtttagtctcatccttcagatgaaacagaaaatacactttcaccagatttcttgctgtaaattcctccaccttttctttttcttttttttgagatggagtctcactctgtcgccaggctggagtgcagtggcacagtctcaggttactgcagcctctgcctcccgggttcaagcaattctcctgccttagcctctcgagtagctgggactgcaggcgcatgccgccatgcccggctaattttttgtatttttagtagagatggggtttcaccctgttggccaggatggtcttgatctcctgaccttgtgatccgcccacctcggcctcccagagtgctgggaatataaacgtgagccaccgtgctaggcctcctacaccttttcttttaaacaaacattccatttttgttgtcacaggtttggatttacattgtttcttttgaggagctttaaaagaattattttcaaagtcattttgtgtatcttttttgagttaggcagaaagtaaataaaaatctacactattcatgttatgtaatttcagcatttctgagaatgtttgtctttagatatttttgcttgagaataaacggtactgccacttgtttgtgctcttttcttgacatacactgtaaatctgacattcagtgtgccatcctatttgtatatgttctttttcacattgtaaagccaagtggccaacaattaagaatttgaagtcttagaaatcagttataattccttcacaatgtggtagtcccagagtaacatctgtaagtgaaacaaaataaaaatttaaatatcttcatctttaaaaattggaaatcttggggcatttaggggaggatgagtaggtgtaatgttgattagtatgataagataactttaaaaaacataacacttatagactgtggatttaacagtttagggctcctaatgcgttattatgattcatctccacattcagagactttacatttgtagttaaatgtttgaatatttgactggctgctgcttttccttttagttgttacattatatgccactctaggaggtccagccattgttcatgcattaaatgaaacagaggtgaccaacatcattactagtaaagaactcttacaaacaaagttgaaggtgaggactctagttactttctaactgtctgatactttagaattttcagtgtcatgagccctattattgatacttagttcttttatgacttttaagtccttaatctttgtggacttttatgaatatcatactttattttttcctttagaaaataaaaagtagattttgtatatattcatgtataagtaatccagagttataaattgttaagatgcctatgtttaaattgaagaaattacgactactttttctcttattgtgctcatctattttctagtttacttttagtaaatttgtaattttgaagggttatattttaaactagtaatttttattttacttctgaagcattaagtaattacaagttttcagaattgtttggaagttaaaaagggagacttttaattatattacagtaaaaagaggtttctttggtctctagacaactcccagaaatatctgggctattctatatgggggaaggaggagaaaattcacatgtaaacttgttcaaaaagaaaattttgaacaagtttgcatgtgaattttctcctccttcccccatatatttttatgtagtctcttgaaaatatgaggggcttctggtttctctacagtttaggcaacctgtgtttacatgcccgttttataaggcagtacccttcttgatcagggttttaccaaaggccaagggtacacacagtgaatctaatgctataaaataataatttaaattcagaccaatacttaatcatctgtaaaaagtgatattatgccagtgtaccctttcttctttcttttttgaggcaagaaattacttaatgattcaccgaatatggtaaactagtattcttattcgctaagctgcttgaaaaataatgaacgtgatgaatgttggtgtatttctaggatatagtttctttggtcccacgcctgcggcacatcatcactgttgatggaaagccaccaacctggtccgagttccccaagggcatcattgtgcataccatggctgcagtggaggccctgggagccaaggccagcatgggtatgttacacttttctaattccttacctgtgctttctggtgaccacattctccagaattatgccaaagttttgattctgaggttagctcaaatgacacatcagttttctaacatcagttaggaaaacaggtccctctaggtatactgtcatcttgtctttaaagaaagttttaaggaaaaatataaacattaattattaatgttttaaaggtagtatttatttgaaatttaaaatattttacattcagttttcatttcttttttatggtgatagttttgggtggtttaaagttagtttataaataatgacatttatcttgtcctatgtgaattacctgtaagtgttaacagagtggctaaacctggaggcctccttttactccctgttccagttcttccctttcctgaggtgaaaaccttaccctccaactagcacacctaggcatggtgactctacaagttcctattctcaaaaaagcgtcagaaaatgttagctagtgtactagtgtttagagatactgcaaaagctgctgggatgctgggactgcatttcctctgtagttggaaacctagtaattagatgtaagcattcactcaactcaaattttaggcacctggaatttgagtggtagtgggatatttagatgcagatatattgtggacagtggtgtgtaaaagtctagtactcgagttatgtttggacttagagatttggaagctagaagcagttaggttttaattatagctgtgggagtagggggtgaggtcaccaacagggaatggtggcttcagaggctactaaggactagtcagagaggaaagaagaaaatatctagtagtatgtggttcctggaagccaagggaaaggagatcttggtgagtcatcagcaggatcaggggctgcatgcagaggtcagatgacacaaggattgtaatttccaagaagtggtggtgttggagaagggtgctgtgcattgaaggagtgaagggctgatttggaagtaaagacttccaagtgtaaacattatttaagaaatgtatcttgactgacaggagaggaagggtattctattgggagtacatttaaataattttttcacactcatttagaagttcacatgtagagtagttctgggagtggttcagacatatcagcaatgccaaccatgacctatttctctttgttcttctgctgtgccacctctatagcttctcagctgttgtccttaggctggtactcttctgatttcaaatggttcacatcgtgttttaatgcaggactctgagtgtaaccaagttagtcaccattctgaagcagtgaatagtttttagcaaacacctagatactctagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctatgtgtggtccctgatagccacttgaccattgtttcttgccactcttcctcttgctcactctgttccagccacactccttgctggtctttagatatgctgagcacattcctacctttgggtctttgcatttgcttatttccttctaattagaacactcttctcccagttccagggtttccatggctcccttcctcactttattcaggcctttgctaaacgaaactctacagagacggtctccaggcttttccatccaaatagcatctattgtcatcttctcaccttgtcttgcttcagttttcttcataggttaatctgtttgtatatctcaatagaatatatctcccatacgtgcagggacttgatctattttgttgatctcagtataactaatatttgttgaattgagttaaattaactcaatttgattgagttatttatttgatgataatgaaaagaaattgttgatacagctgaatctcatgaaagtgtatgtgtgtgttttttctcttcaatgcagaaaaccaacctcatagcaaaccattgccctcagatattgcagtaatcatgtacacaagtggatccacaggacttccaaagggagtcatgatctcacatagtaacattattgctggtataactgggatggcagaaaggattccagaactagggtatgtcatagtaaagtaacattgagtagttaagtatttatgtctgttataatgttagcatttgtgtcattttattaatatatggctaaattagtccctcagagtctgtttgtagtaggcatttccttaaaaaataaaaaaggacattaaaattaatggcaaaatagttatagttgtgaggttgaaaatatatcatatagatatattttaaaaagtacagaacttaaatttgtatagttgtaaatcctttgttttaatcagcttgtatttgctgctgtagttttttttatatctaaatacaattcaggtgaacaggtaacttaatttatccactaagtatttgttgagcttcagtattcggtctctgatttttcttgttaatacaaactccagtggtagcagtggaaggtagagtggagtgggaaagagactgatggaggaaaccagatggaagtttgagggactgtcaaggaaacattgccagagatgcaattggtattctgatgaccgatagggtacagtggttggatatttttgatgcttttatgcacagaaattacaaacatacacgcacacacacactcacgtaattgctatggtactgaacttggggatggaggaatgtctcttacgtatgcatacatttcagaaaaaattaagtgcaacaattttcttacaggtttgcctcagttaccttctatattttggttatgggggcagctcttgaagtatatacaaatacttacacattttctgtatattaagatctaatttattacgtaatccaattcccacaacaagagtcttatctgtaaaatttctggcagatagttgtggattctactttaactcttctggttggcaacccactagatgtaaagaccatttcctccttggatgatttcttctgttcttcaaaagaaccctgtattattatttgtttaagccactgtttcttgtgcctcagtactttgcttcagcaacgcttataattcctgagtgcttttaagtaggacgggaaacagcattccttcctgcaagtgtgcgcctccttgcttttgggttgagctgtaattctttttccctcccatccccagcatctgcctatcctctgttttcacctgtctctctctctctctctctcacaaacacatacacacttgaccagcaaattgatgccctggggcccttccatgtgccttcaagcttgctcccattatagggcacttttggcatagacgacacctgacttttgtttctgacgtctcccttttcttttagagaggaagatgtctacattggatatttgcctctggcccatgttctagaattaagtgctgagcttgtctgtctttctcacggatgccgcattggttactcttcaccacagactttagcagatcaggtaagttcaatgtctgtgacttgaaatactaaaaaatcatagtgaattgtaatgcatttttttcagtcagtatgacagtatattgcgagagcgatggttcattttaaaatgagctttagccttttaagtgcttcttagactataagtacattaaaataatttataataggctttttgatctaagaataccattgaattttaaaaataaggatcactttatatggatcactttttcttattttgtagtcttcaaaaattaaaaaaggaagcaaaggggatacatccatgttgaaaccaacactgatggcagcagttccggtaagaagtgacccttatttaatattgagtattaaagaagtatcacccgctacaaagcattagtgctagtgaaaaatatattgttgacaaggtagtttatgtaggatttattccttattgattataaatattgccttaggcgctatgggatttcttcagtcttgttttagcttgctttcttatttactaagcactcaacttaatttcagcttctgtgtgtaattatcaacttgtttgcctaaataccttcttgttaaaataaaaattattttcatgatatctgttggtgaattcattgacacttgaagcctattgagagctaggagggaaagtgtgagatcacctccttttaagcaagctgtatagttacctcctgagtcctcagggaaagtctggcctaaacaccaaacaaagtgacagagaagctggtgcagctttgaatgacttaagaggggctgttcatccttacataatataggggcctgggaataagacaagggaaatggggcagcagtgattttctggctccttataacataggctgagtttgtttggaaatgatgggaattattgtcgggtacctaaatgcttacgtcaagaataattacatagttacttcaaagtcaaatataaataatcagtagtttcgtagtttctttctataattatagtttctttagtatccaacttaaattcttagttcacttaaaaatgacgtataatttaaagttgtggaggaaacattattttaagtcattaaagtatacttcacagtaatggacctagcaagcaaaatgcagcacagacaaggaaaacttcctggtgcaatatcgaaagtcaaatagccaaacaaaaacccccaaacgttgcatggtctttttgtgagcaaagaatgtggtactgtatatttttataagataaagttaggacattttgaaaaaccatttcagacggttgttcgtttattttgtgagtaggttttagttcagaattagtaagataagcaaagcaatataaagaatatcttacaatttatatgagtatctagatatatttctgcttttaaaaattatttttgtggaaactttatttttaaactaattgtggttcgattttaaaagtttgatcttgataggatacatctttttgaaaaattcacaaaaggttttttccttcttgctgaatcacatccacagttgaagagtacttcttttaaaatggcttaatattgctagaaatgttaatctaatgctaagtgaatatgtaaggcagctgttattattaactatgttaaactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacaggtaagtaaagactctctacctccttctttctcctcttgataatttaatcatttagttcacattaatagcccaattaattgagatagttataagaaagaaatatatttcataaagtcaagagaactctttaaaaaaaatccatcccaggccaggcgcggtggctcatgcctgtaatcccagcactttgggaggccgaggcaggtggatcatgaagtcaggagatcgagaccatcctggctaacacagtgaaaccccgtctctactaaaaacacaaaaagaaattagcggggcttggtggcgggcgcctgtaatcccagctactcaggaggctgaggcaggagaatggtgcgaacccaggaggcggagcttgcagtgagccaagattgcgccactgcacgatctgtctgcctgggcgacagagcgagaatccgtctcaaaaaaaaaaaaaaatccatcctggctgaacacggtggctcactcctgtaatcccagtgctttgggaggccaaggcgggcagatcacctgaggtcaggaattcaagaccagcctggccaacgtgacaaaaccacatctctactaaaattacaaaaattagccagagtggtggcatgtgcctgtagtctcagctgttagggaggctgaagcaggagaattgcttgaactccctcgggaggcagaggttgcagtgagccgagatcgtgccactgcactccagcctgggtgacagagtgcgagactcttgtctcaaaaaaaaaaaaaaaaaaaaaatccatcttgacatgggaggattgcttgaggccaggaaatcaagaccagcctgggcaacatagcaagattccttctctgcttagctgggcatggtgtcatatatctgtaatcccagctacttcagggactgaagtaggaggattgtttgggcccccagtgggaggattatttgggcctgggagcaatgactgcaccactgcacaccaccctgggtgaaagtgagactctgtctctttaaaagacaagcaaacaaaaaacctttgtaatagtatgagcagtttaaaaaacctgcaatgtcattaaaagtgtgttttcacttaagattttgctatttgtgagtttatattttctgtgaacacttagggagttttaattattttgagaaatagtttctcttttgcttttatatttatttcagtatgaatataattaaatgttttgtatttaaagctttaaatgatcagttttgttccagcttgtatttgtgtagtgttaatagagtacatagatttatgatttgatcataaaatagcttagaagttagaaaatggaagtatgacattcaaagtattttttatggtaatattaatatagttttcagatgcttcacataatttagaactttgtaagtttttttcctgccttacgttagttatttcttcagtgagttgtaaagtcggccctctgtatcaacaggttccacatctttagattcaaccaaccgtggatcaaaagtattctggggaaaaaacaataaaatataacagtggaaaagaaaatacagtataacaactatttacaatgaatttatattgtattaggtattataagtaatctagagataatttaaagtattttggaggatgtgtgtaggctttatgcaaatactatgccgttttatataagggacttaggcatctgagggttttggtatccagaggactggatgccaagggataactgtaaaagctgatttgaaaagtctgttaataccatttttaaaaaattgtcaccgtgtagtcttcaccttttgcaaagatttttttttttaagtactacctctcctttttgatcaaggcagtatgcaatctttgtattagtgtattttcagaaacatcaattagatgtttaacttgtttccttttttaaatgcttcacagataatttactagattatttttaacaaacaattcaaagcttgaattagtgaaacttcaaaaacagattgtggtatacaaattatacacatttctaataaagtacattaaagcaaaaattaatttgattttaatacatttcataaagatgatagaattgttcagtattaatatatgataaatattttatgtaaataatgatataaaagtggccataagcaagggttttcctgtcactatacaaaactaaacctgacaattcaaattcgaatatcacttgaaaagctcttaagaggaaataataaattctttaccttgttgaacttcaaaaaattaacatttggggctcaagagactctccaaattggctgtgtgaccttggataagtaacttaatctcaaaatctctcatatcaaaactgggggattagtttaagtgatttggaaaatcccattcagttttaaaatcctgtggttctctaatttttttctttagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcattgatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtctagggaatattattaccagagtttatcatgtggttgtgtttgaggaggagatctaccaactaatcagcagttctgagatgaatcgcatagggcctcatgcgtcccttttatgggagaaagttattttgctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagttggggatatctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactaataagtgaataatgtcaataaattaggagtgatcataactttattttgcagaagtaaaattataaaatttattttatgaaattgtggatttttgaatgatttttttcttttttttctgagggcttcaaccttgtattattagaaggaaattttcactgcaattccatagaagtctgtttattctcatgccatttaaaataatggtcacttaaaaatttatttgatcctgttaaaatatacaaattatctgtgttttattgggatgcacctttcctctacattaagtaaagataaagattctggccgggcgcagtggctcactcctgtaatcccagcactttgggaggccaagacgggcggatcatggggtcaggagttcgagaccagcctgaccaacatggtgaaaccgtctctactaaaaatacaaaaattagccaggcgtggtggtgcgtgcctgtaattccagctactcgggaggctgaggcaggagaatcacttgaacccgggaggtggaggttgcagtgagccaagattgcgccactgcactctagcctgggtgacagagcgaaactctcatctccaaaataaataaataaagaaagattctaaggcttggatgtcttttagctatctttagcagaattagtgggaatatttaataaatttaggcttggagtcattttgaaattatctataagaataaatcttaatatgtagtaactcactttttttttttttttttttttgacacggagttttgctcttgttgcccaggctggagtgcagtgtcaatggtttcggctcactgcaacctccacctcctgggttcaagtgattctcctgcctcagcctccctaatagctgggatttcaggtgtgcgccaccatgcccgactaattttttgtatttttagtagaggtggggtttcaccatgttggccaggctgacctcaaactcctgacctcaggcgatccaccctccttggcctcccaaagtgttgtgattacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattggtaagtcatctaatatttttttgaaaatgaatgtttctgaaatagtttacacaagaagcacaatatatttagaggaggcgctgaataatataaatctttatgtaatcttagtttgggttgttgcatcactcctggaatataaaatattacggactgtggaatttatgaggcctgacatgttatgagttctcaaagatggttcagcagcagtggtattttaaattactcttagataaccttcagtcattgtttcctgcctgtgtttctgacatctagagattagtggatggagctctcacagtctgaactgcacccttgccttgcccaggagaatagaggaaagccaggcagctcaagtactatgactcatatgggttgaaaaataccttattctgcttctccttttaggttctttttttttaaaagttaatggcatttcagttagccgtgtgtggtgtctttgtcgggcacctgtaatcccagctacttgggaggccgaggcaggagaatggcatgaacccgggaggcagagcttgcagcaagcggagatcgcgacactgcactccaacctgggcaacagagcaagactctgtctaaaaaaaaaaaaaaagttaatggcatttctatccctgtcttgctaactagaaacctgggaggagactcaagactgttctcttcagtcagcttcccatgcctattttatatcccactagtttattttatgagctatgtctcaaaatcatactcttctctctttgtctctcttacttgatcattggtcaggcctgtaccttctgccaccctctcccaataatttctctgttgccatgtttacccccttaaacacaccctctcactgccaccatgtaattactaaacatggatcttactggccacaaccatttaatgtctcctagaagctcagttcagggtgcccctgttaacattgttcccctcttcaccttcatcgtcagttgttttcctcctcctccttgatgcagctgaaattagagctgatgttcttctggcttttgccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgagcaacagagtgagaccctgtctcaaaatctcaaaaccaaccaaccaaccaaccctcagctcaggcctcacttgcaagaattttttccaaatccccaggttggagagtcttaacacttagcgctaccattgtagtaccaatgtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctcctgagtagctgggattacaggtgtgcgccaccacgcccagctagttttcgtatttttagtagagtcggggtttcaccatgttggccaggctggtctcgaactcctgacctcaagtgatgtgcccgcctcggcctcccgaagtgctgggattacaggcatgagccactggacctggcctgtttttcttttaaaagcatgtatttagcagtacaaaaattagggcctaattttaatatgtgcttttaatttcagcataaccattaatgcttaattttgcaaagttttaaataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagctgggaacctgtctacgacagttgacatgaattattatgggaaaataaaatctgttatcaggaaaactaatttagaaacagatgttgggggtacagcccaagttagaaatgaattgcatttatttataaatgattctggtctttagccatttagtattttctttagtgatgatacagatctggatttattcatgtgatagtaaccagaagcatcttcttcctgatgttactattttatggccttcaaaaaagtatttgccttcgttgggcatagtcagagttcctctatcaatacaaattctgatgataacaaaagaaaaaaaagaatatattcacatcattttgattcgttgctgaatttttaagatagtttttaatttatgttaaattttagttttttaaaacacatgctatgaaatactgatagggtttaaaggtgaatattctaatatttgtaactttcttttaaaatgtgtacatggcagtattcataacagtttttcatagttgaaattcatcatgaaatgtcagattgaagtttatttagcaacgagctctgccaaagcattggaaaatattatgaatcaaacagtaaaactggcggttgcatgaaatggatatgccagtgccaagtatggcacatgcattttaaaaaaaatgaggagttatttactacttgtcactgtaataataactgcagtcaacacagtttaccattttgttccttatctgttatcctttctatatttcagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcattcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttgtctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtctaataaaaacatctgtgtcttttgagttgttgtgtcaagcataaaacaagcgtgaattattttttattttatttatttttttaagagacagggtctcttctgttgcccgaaccagaatgcagtggcagtcatagcttactgcagccttgaactcccaggctcaagcgattcttcccttcagcctcccaagtagccgggactaccagtgcatgccactatgcctagctaattaaaaaaaatttttttgttgttttgttttgttgttgagatgaggcctcactatgttggccaggccagtcttgaactcctaggctgcagcgatcctcccaacttagcttcctgagtacctgggactacaagcatgtgtcaccatgccaggctccagcatttactttttagtctcttcacatttcagtaatgtcagattccacacagtcttttaagtcagccctgtggtacatgccttattggttttgctcatagtgtatattcctttggaaaccactcctgaaatatttttaatctttgaagactgaaaccttgtgtattatttctatgtttacttttacaggttagagttaatacatctttttttactcccaaggcactttatgtctttaattttgcatatttctttcttttattgtagtaaaaatctcataacgttcaatttactatcttaacattttaagtgtacaattcagtaatgttaagtgtatttacattattgcacaactgatctttataactatttcatcttgcaaaacggagacactatacccattacactaattccccttccctctctcccccttccctccacctttttactttatgtttctaaaattttgattacttgaggtacttcatacatgtggaatcatacggtatttattcttttgtgactgtcttatttagtgtatcttcagggtttattcatattgtaccatgtgataggatttttcttttttaggttgcgtaatactccattgtatgtatattgcacattttctttatccattcatctgtgtttggacatttgggttgtttctaccttttgggtattgtgaataatgctgtgatgaacatagatgtgcaaatatggctttgagattctgctttgaattattttggatatatacccagaaatgagattgttagatcctatggcaattattaatactatatttaattttttcaggaaactccatactgtgttccttaatgactattgatttacattcccaccaacggtattaagggtttccatttctccacatcctcaccaacatttgtatatttttttctaatatccattctaacagatgtgaagtgatatctcattgtggttttgatttgcatttctctttttattagttatgttgggcatcttatatatacttgttggccatttacatatcttctgcagaaaattgtcgattcaagtcctttgcccattttaaaatcagaattctgcaccctcccccccccaccccacccccgtagttaagttgtacaagtttcttacaaattctgaacatgtattagtctgttctcacactgctataaagacatacctgagactgggtaatttataaaggaaagaggtttaattgactcacagttctgcatggctcggggaggcctcagaaaacttactgtacatttgtggcagaaggggagagagggaagcaaagggacatcttacatggcggcaggcgagagagcaaatgaagagagagagagagaaagcgaagggggaagagcccctaaaaccatcagatcttgtgaggtctcactcaccatcacgagaacaacatggagaaaccgcacccatgatccagtcacctcccaccaggttccccccttgacatgtcgggattatggggaatataatttgagatgagatttgggtggggacccagaactaaaccttatcaggacattgcatttatttgtgtcttttaaaatttcttttagtaacattttgtagttttcagggtacaagtctttcacctccttggttaggtttattcctaagtatttcctcctttttgatgctacattaaatggtattttcttaatttctttttcagaacagttattgttagtgtatagacatgcaattgatttttcgtgttgattttttttatcctgcaactttgctggaatctttattagttatgaaggttgtgtgtgtgtctttagagttttctacatataacttttctttttgatcttctgattgttctattcataaatgaaagtggagtattgaagtctcctactattattgtattgctttctatttcttcccctagttatgtcagtgtttgcttcatatatttagaaacactcaagttacgcgtatatttgtaattgttatatcatcctggagaattgactcttttatcattatattgtaattaatgtccttctttgtctattgtgacaatttttgtcttaaagtctgttttatttaagtatggccatcccctttaggttcttattttcatggaatatctatttccatccttcactttaggttacgcatgcccttggatctaatgtatgtttcttgtggatggcatatacttgagtcttgttttatattcagttggtcaatctgtatcttttaattgggcatttaatttacatttcaggtcattattgatatgaaagacttttcatacctatttccattttgttaactattttctgtatatcttgtagcttttcctctcttgctgccttcttttgttttgttgattttttgtgtgtataattacattctttgattcccttgtcttttatctttgtgtatgttctatagacattttctttgtggttgtcaatacagttacataaaacatcttaaaattattaacagtatattttagtttgataacagcttaatcttccgtctcatataaaaacttgactcctttgtaactctgctcctccctcaaaaaagacctttttattgtgtagtcattaatatagattcataattactttttatgtctttgttttttaaattctatacagatttaaatgtgacttatacacctatatcaaattactttcagaattctgtatttgcctatgtatttacctttaccaaggagtattgtagtttcttatggttttgtgttactgtttgttttcattttgctttaacttgaagtactcctatcattattttttgtaggactggtctagtggtgataaaccccctctactgttgtttatcaaggagtcttaatttttcccttattttcgaaggacaggtttaggttacagtattcttggttgacaattttttttctttcagtattttgaatactactattttctaacctgccagttttctgctgataaatgatagttcaatgagagcttctttgtatgtgatgagtcatttttctcttgctgctttcaagattttttgtgacttttgacagcttgattacgagtgtgttttggtgtagttctcttcctagtggagtgttttgagctgcttgaatttatactcccatttctcttctcagatacaggaaggttttggccatgatttcttcaaataggctttctgctcctttctgtcttctttttctgaactcctataatgagcatttttccacttgatggtgtcccattcattccttaggttctcttcatttttacatttttcctctcttagtaatttcagaagtcctgtcttggagttcatagattcttttttctacctggtcaagttgctgtcgatcctctagtgaatttttcaatccatttattgtatttggttccagaatttctatttggttcttcattttaaaaaaatttctttcatttatactttcattttgttcatgcgttgttttcttgttttttttcaggtgtctgtctgtactctcttgtaattcattgagcattcttatgacggttattttgaatttggtaattcatctatttccatgtctttctggggtttatttctggagatttaatttgatcttttgatagcctgtgtttttctatttctttgtatgtctttatttttgttgggatgtcagcatttgaaaaatcagctacctttctctgtcttacagtctgcttttgtattgagaggactttgtccagtcagccctactacggattctagagccagccatcttaagccttttccgaggctgtgtcctttttgagtttgtggggtacaatctaattgaagaggtttgctggtttctactcaggagctccctctggtgtctgtctgtgatattgtggcctcactggtgctgtagttggccatggtactggagctctacctagtgtctgtgatactgcagcctctggtgcatgttaatctttgttcttgacagctcccaacctggtgccctgttcctgttatttagattcaggaaagacagaagcaagtttcttgcaccccagaagtcagaatattggatgtgtgttccactcctcttagggatttcttccctattactttgtactgtgctgaggggagggtctctggcaagcgaatgccttgcatttttctaccagcctttgatgcggttggtttccttctgtcccggagtgtaggaacttcttaagtggtttctgggtttcttacacaggcaataaataggcccatatagcattgttaaatccatgtttctgtaggggaaggagggactgcgttttcctatattgtcatcttgctgacatcactccttaacacatttctttcatgtatcatatggctagctgtttacccatttccctttgttagattgcatgctacttgaaagcagaaacttgtcatttttttgcatttttaaaagaatgtttagtaaagcactttacatgtagtaatagttttttaatatttgttgaacgaatgcttagaaaaataagtcagtcctactgacgacatacggtttttcaaaactacatctgccccttaatctcctttaaatgttttcctttcttcccttcctttctcccttcatttgctgctatcatgaatctccttagtattaggcaatatgttagtaacacaatagtgagcaagcattctgtatccacatagcttgtagggaatatcctggttcaatgacataatttgtcttaaactttattattttttaatttctgaagtaaatgtgctctgcataataaattcaaggaaaacaaataggcataaaggaaaaggtgaatttccccatttcctttctcctggataccaggctctagaggtgtggagtttatagcttggtatgtatccttctcctcacatctaggtgcatataagtttatgcagcctgtgctggaacttgtcttttttttttttttttttaacctaacaataggcatttatgcagcatataatgaagtttcagtcagtgacagacacagactgcatatatgacagtggtcacgtaagattataatgtatttttactgccttttctatgtttagatacacttaaatacacaaatacttaactattgtgttacaattacctatggtattcagtacaataacgtgctgtgcgggtgtgtagcctaggagccgtaggctagataatgcagcctagatgtatatatagtaggctataccatcgacattcgtgtaagatatgctatgatgttcccatgatggcaaaactgccaagtgtgtgatgcatttctcagaacatatccctgtcattaagagatgcgtgactatattggataccctattagatacctgtctaaatgtaattttttttttttttaaatgagatggggtttcgctctgttgcccaggctggagtgcagtagcacgatcatagctcactgcatcttcagatctcctgggctcaagtcatcctcccacctcagcctcctgagtaactggtactacaagcgtatgccactatacccagcttatattttttatttctattaaaaaatatttttaagttacttattttagagacaaggtctcgctatgttaccgaggctggccttgaattcctggcctcaagcgatcctcctgcctgagctttcagagttactgggattacaggcatgagccatcatgcctggctctaactcgttttcaatgacagaatatatattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttttttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatcccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagca

SEQ ID NO: 13229 - DNA, 11584 bp, Human
gtgagtggggtacaggtaaagcacacggacacccgccgagccatcctccgcctcttccgttcccaccaccatggcgttgtgatactccagagtgccccaggagctgtagtagggcgcgctcacctttgtcccactcagctcttcctcgtcctctccctcttcctcctcctgcccacctgccgcagattctggccccgcctctgctttaggaacggtctctgatccggacccacgggccgctgctggtgcctccaccgcctcagtgatggcctcccggaaagcctggtactcagcatcttcctggcggcccgggcgctcttcgtccagcgcggccaacaacctgctcttcctgacagacaccaggctggcctcggtgagctcgatgagctccttcaggtccccctgcagctggcgcaggtcagcctgctcagacgaatccaggccggcgcccaaggccagctccacctgctgcagctgcgcacggtaggtctgcaaggccgactccaggctctcctcgtccatgctgagagagggaggcgctggaccagggctgcaagaagagaagccagctgagccccgcgtctcgggaccgaccccacagcctgagggcgggcacgggcacgggcacgtcccctttccctcggggagacaccggctcagaggcacagctcccagcgcagaggtcgcagcccgggtacccccgctcaggctccgcgcttcccttccgagccgccgtgggctcgccgctagccgggtcccgcgtcactccggagccccttccccgcggggcgccccgccgcctcaccctccgccgagcccacccgccgcgcccgccgccttccaggccggccgcgcccccccgcccggcgtctcttctgtctggccagggccgcgtccccgcaaaccgcggccacctggtccccggccgggcacctcctccgcgcggtttcccagccgcagccacagagagcccgccggcctcaccggctagagcggcccggcgcccccttttcgccccagcagccgatcggcacttcctcccgagcgccgccgcttccggaagtgcttggcgcgcgggggcagccgggaagcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggtaggccgcaggctgtgcggtgaggcgcgaggcccgaggggcggcccaggactcgaggtgggacgcgggtgtgacaggagccagctttggctgcttgtcggggagcctcagacctggcggcggcggcttggggcggacgtagccgggggccgcgacccaggttcttccttcgcagtcgttccctgccagccgcgcgccgcctccaggtgcactccaggagcagccgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacggtgagtgcccacgcccttgcgcgcacctttcccacggcctggcggcgcccccttcggttttgtgctgtcagctgcacgttcactacccagacggaagccaaatttcacctgagacggcaggatagtcaccaccagcctcctgaagagcagagtgttgctctgtttctgtttctgtcttttaaagaacagacctgagtaaggatatttggaagccagtatagcccctccttgatgtgtttcgcctctgcctctctcctcagaccttcctggagcagtcgaaaacccgatttaacaagaactacaaggggatgagtctatccaaaatcaccaccaccgtgggcctaaacagtaagggtctcaatagcaggctgtgggtttggggccttgaggatgccgtgatattcacagtccagctggcccgtggccacagccctgtcgggcccctctcaagtctcatttgagtggcaccagcatggtttgccccatcccctgggagagctgggactgggtgtgtcgaggaccaaggtcatgagccttgcctgtttcctcctctccccagtcggcactgtggatgtgggaaaggctcggctcatgttctgggacttaggagggcaggaagagctgcagtctttgtgggacaaggtaagactccctggccaggaccacccccaccccagccctccagtgccacttctttccagagtgccctttgggcccttcctcagcagctttccttacccactctgtccctcgggttttctctctggtcctgtcccaggttcccgagtggctccctgttttgtcccagctgaacccttagctgaagttgccccaaaagtggtggtaggggagtttcccacttgggagttccctgcgatggggccagtggagaattccagggaaagaatcactaaatgccaaggcgatcagatcagagcatgtattaggggaacctgttgacagagtgcggcatcctcaggtgaccagtgagagaagggcgtgttcactggtcatgcctgaagccgggggggatctgggttcagggctggggctagtttctttcaatgttttgaaacctgaacattatgttaacaacctaaacatcttacaagtgtctgggaatgttcaaaccctggcttgggtttgagcctaagggcaacctcgctggccaagtcagagaggtcagggcagtctgtttctttctcagtcaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctgatgaggttccttcagttctagcttaacatttgttcttccatgatcaccagaagactcctcagggtctcacagcggcagtctcctattttgacacaggttttgggcatttctgagatcccagtgtggtgccccttccccacacccccaaggctgcagtttatctccttctcagcctgggccaggcactgagtccagcactgagcagggcagagcctgtggcttcctcgggctccctgccctaggctggcacagtgggtgtggggtgtccccagtgccttggctgccctgatgccatctctagagctgagtgcccaggtcctgatctcttttttgatcctagttcccctttcctaggcgcccccaaagtgtcccctcctgctgtgacttctagccaagaagacatttctcccatggccaagtgatctctgatagatcctgtaggaccactgaagtcagacaggacaagttgagtcagggcctgtgtgtccagtgcgcagcatgcttggggagtgacacagatgatgatgatcttgtcacaggccggtgtctcaggcacagatgctgagacaggtcgaggtacaggatgcacactgggggtcggcaccaggaaggcagggaggacgggagaggagaggtcgactcaggcagcaggatccgcagagctgtggttggcccagcagggagccctggaggagaactggctatgctgtgccatgtggggccaggctggccgggacttcacaccatggcctggtgggtccccagtgtgggctgccctgggcaggtgtgacctggcagtgtggctctttgcagccaaagtgggtcccacagaaaccaaaatgagaccatctgctggtgcagtgttctccaacatgaagcaagaatacagtggggccagagatgcctgcactggccacagctgcagccctatgtggacccacacttccacgttggagaggggttcctccaaggtcctgagggcctctcttaaggcgaaactggaagagggagacttaagggggccactgtagcccatccttgctgctggtcttggggctgcacagcccttccttgagtgccctcccaattcactaccacttctgctggggtgcgacttcctggcagtctgagcccttctccagacaccaccgtggtggggccagtggctccctgggtccccagctgtgggacagctgtgggatggcagccccatctcctgcccaccagggtctcctagacatgaggtgcaagtcatgcccatgaggcagctgtggctcgtcattcagcgtgtctgctgagtatgtgctgctctagtggccgggacccctgaccctgctgagctcagagctgggaggatcagctgcagggacccccctaggtcactgggagggaccggaagggaggcccctgctcccaccctggttcctgtatcctgcatccttgtgcagagccagcaccacagaaaggggcgtcattgcgaattggcctcgtcctggggctggaccctgggttggtgtccacatgtgtggcatgtgccaggacctcagctcctgggttctttgctgtaacactagtctctcaggctggctggcactttgcagttggggagctcccattgctgctggggagaaaaactcagacccacagtccctctgactgctccactggggtcagctggccagccaggagccacgctgggacacctccctcttccccctccttgtggggcaccccacaatgaccactgctgtgacgcctccactggggcgtggggctctgggtcctgcccgcactcagccctgaggtgtcgctcccgtccactgcggccctgctgggctgtgcaccttgtgcctggtaggtgtgatgggtggctctggccacgtggtcccatggtccaggacccggttgcacatgaaccttctgccaccctgctcagaagccccaggagccacgtggagattctctcactgggcttgctgcagcctccacagagccgcccctcctgccacagaggtctccaccttagggtccgcctgctcccttgtgtcagcagcagacagccggcacactgcagggtcccttgaggggttggcggcctctgtgtgggacctgtctgtaggccagagaagttcctgggggtgggggggcctcgctacctgcagaaccctggagggcgcctggccttgggcctcctctccactgtgggaagttcctgggggtgggggggcctggccttgggcctcctcctttccactgtgggaagtgcaggtgcacaggcttctctcctctgtgggaagtgcaggtgcacaagcttgtctggcactgggatggggttgtctggtactccctgctcagacaccctaaggatttcggagagttgggctgtgcctcctggcttctcatgctctcgggtgtgtgtgtcttaacacactgaccaccagcttgtcctacctggtcagcatccagttctaggtctctgggcactcatgcctggacaggagagctggcacagcctggaggcaaagtggcaaatgtgagctgttgtctgctccacgtggacgcggagtttgctgtgtttttttctgattgagatagaggtgcactcatctggtccagggctcagcacttgtacctgaggctgcaggggctgtgccctgtcttgcccaggagtgttgccagcgagcccaggactgaccagcccaggctgcagaggtctgagctcagtgactctggccctgtcctggcagggaaggctcgcttcgtagatggtgctggtcagtcttatccgcatggccacactccctccctgtgcgaggtgctggcacagagccccacaggtgcactccctcaacgggccaggctgtggtctaggttcctccagcccccaaaccctatcttttttttgagacagggtctctcattctcacccaggctggagtgcagtggtgtgatcagagctcactacagcctcaacctcccaggctcaagccatcctcccacctcagcctcccgagtagctaggactgcaggcgcacattaccataagcttttgtacagacggagtctcactgtgttgcccaggttggccgtgaagtgggctcaggtgatcctcctgcttctgcctcccaaagtgttgggataataagtgtgagccaccacgcctggcccaatccctgtctttcacctttggccaccatcaggccaaaggttgccggcaggttctcaggagcagcgtctggggacacctccaccagatctccccgcaaccccagaatgcatcccagaagggtcttgcagttgggggctgccctcttgccccttcctcatgtgagcccctcactgtggccatgacacaggcctggctctgctggcccttggcagggtggggactgagccccaactcctggtgcttcctcccagtattatgcggagtgtcacggcgtcatctacgtcattgactccaccgacgaggagaggctggctgagtccaagcaggcgtttggtgagtgcggcctggctgctctgggagggatggatggtgagtgggggcaggtccagcttgggcagctctgtgcctggggcaggctcagtgtctggtcagaagtgctcctgcctagtgggtgacggggggggggggggcagagggagtggctgtcacagtgtccacgcctgtgggcccctgggcagtcagaggcaggatgctgggtgtgaggcgctgcctctcctgccctccccagagaaggtggtgaccagcgaggcgctgtgcggtgtccccgtcttggtgctggccaacaagcaggatgtggaggtgagccccacccctgcctcccgcagcagcttcccgagtccccagcctcccccacagcaaggggagtaggtgtgcacccagacaccccaggcccagtgactgcccagggggtacagagccattctcaaggcctgccctgcccccagcagcttcccaagcttggttcctctccagacctgctgctgccagccctggaggttctcccacctcagggcaggcgcccagaggcctcttcctgctatgcagggcacctctccccaggagggcggccgtgtctcaggagtgtgtggccaagctgtggggacacccaggtgaaactcagagctcaaagaagtgatgctggggccctggtgggagtcagctctgacccttacctgttcctgctacccttggaggtggcatctgtgccagccccacccccagggcagcccctcaagacccctctgaggtgccactgcccccgggagcactggccacgctgagttctagctgttctcttggagtggctttgcacagaagcagcccggcgtccagagggccgggtgaatcttcacttcctgccttctctggggtggctctgttgcccccagcctgtaaggctggcctcccctacaatctcagccgacaagagggacatctggtacggggcaggggtctcccctcggaggaaaaggggaggggagggctgctttttgaagactgggcaggtggttgtgagcagaagccaccatgactgcagactgcccccatcactgatgcagggctcccacctctccatcatccccggctgtgtgggcccctgggacctgcctccgccactgcccaggaggcctcagtcctcagcgccccacctcggggctcagggtgtcccccagggaggggatggggggtggactccttggagccgtgtggacgtctagtttgtctcaggcactaccagccatgttcagcctcgggctgagcacagggtcctcactgctgtggtctctgtgggagacactgggaccctggtggagctctggctgtttccctggggtgaagggcatacgcccttctgagagtcccgggcccacaggcaggacagggccagacgtgggggctgctcctcacggccttacctcccccagacgtgcctctcaatccctgacatcaagacggccttcagcgactgcaccagcaagatcggcaggcgcgattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctcgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccctggttgctctgggtgcatcgggaggcttcagagcctgccccagagggggagaagcttcacttcccgggaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctcatttcttctatttaaaaaaaagcctctttcagtgcaagtggggtgccaaggatgtagaataaataagagggggccaggatcagtgcacagggaggaagcgctcacggacgctccgctccagcccgggcatcctggccacgcgcagcgcctgcagcagccgcaccagcagcgccccgtcctgcgcccccaggagctccgtgagccgccgacgcagcttcagctgcaaggccgcgcggcccgcccttggtgtcggaccccagccctccggggcctcgagggcctgcagcagccgctgcagcctcttgatggagatgtcctggaaagccacaaagtcgatgacggcacgctcacactcctcagctcctgcagtggggtggggaggcagcggtccgatcatttcacccacacacactggcgggggctgccaggtaccctgctttctgggccccactcggggggtttgcaggagagagaaatccctgtgcagtgagccgtgctggagagggcagtgcaacgatggggactggagaaggggcaggagccttcggtcagagagctggagcaaaggcctagggggcaggagcggccactcggaccttggctgcaagaggcaagggggcccaggcaagggcttggggctcctgggccatcggaaggggcgagttgggacctgcagatggaccggacctgacttgatgttaagggggtcacttccccctgtgacttctcaacagtggttaacattgggcctcggtttccccatgtcagaggaggcagccaccttcctctcaggcagttaggagagttaccatcaggcctcggtttccccgtgtcagaggagccagccaccttcccctcgggcagttaggagattgctgcccactttcccagagctccccaggggaggctgtgccctggctcagatccaaattctcagccacccctgagagggcagacttggtggggatctagtggagggacccctgacccctcaaatccactgtggccccttcccagagccagctggcatgcctcaggctagatgcacgtgcaggggcaggagtgagggcacaagtgggcctggcctgcagtgtgctgccccctcaggcctctggctcacctggtaccctgg

SEQ ID NO: 13230 - DNA, 121433 bp, Human
aagtcctttgcttttttttttttttttttttgttgttgttgttgttttgagacagggtcttgttttgtcgcctagactggagtgcagtgacacaatctcggctcactgcaacctctgcctcctgagttcaagctattctcttgcctcagccttccgagtagctgggattacagagacgtgccaccacgctcagctaagttttgtatttttagtagagatggggtttcgccatgttggccaggatggtctcgaactcctgacctcaagtggtccaccctcctcgacctcccaaagtgctgggattacaggcatgagccactgcacctggcctagtcctgtgttttttgtgcaacatgctattgacttaatgtatgcttatttgtagccctcactcccttagctcctcaaaggttgtctttattcatgtgcccatgaacttaccacatcgtagaagccattatataggtgaattgacttgactgtttttgtggttgcatattagatgtgaaaaacatttttaagttatttttattgagaaaatttacatatcacaaaattcacccttttaaagtatacaatccagtggttttggatatattcgtaaggttgccagggggcgacggggaatgcagagtgactactaatgggcacaggatttctttttggagtgatgaaaatgctctagaattagtggtggtggttgtaccactttgtgagtatactcaaaatcactaactgtatactttaagagggtgaaatttatggtacatgaattatatcttaataaagctttaaaacaagtgtacttttttttttgacttattcaagtttgtaccacttaaaaagttaacacaattttttttttttttaagagatggggtctcactctgtttctcaggctggcctcagactcctgggctcaagcatgtttcttgtctcagactcccaagtagctgtgactacaggaataaccatgtccgtctcttaagtttttaccacctttgaagatagctgggacactactcgttgtccagggtgccaggactctgggcacttattattggcaagggaggggagagcgaatgtgatcggctatctccgcaggccccgcctgttgttctttatgtcagcgtgctgtaacactttaaaagtccctctttgcttatgtaaaatttagttattttcagaatttatttaaattttgttctaattagttatgataagaacaatcgtcagatgcattttttccacctcataatgtcctcatttggtttggattatggcccttaaatatttttcttatatatagaaagaaaagtgtgattatggttgggtgggatggaggttcggagttttgattagaatttgagtaccttttccaagattaacttttgcattggaacagtgatggtgaattacgggatttaatattggaacacagaataatacatttttgttattttaccttcttggctgttacacaccatacacttaaaactgttttttctaatacctaacattttgatagattttgggtttaatgtatgaaattgtagtgaaatgtgtctcattgctttctagcactgttgataacatcttcctgttacagaataaagaataccaagtacagataaaagtaatttttcttaaaaaacttggattttagatatcaattattgtttataacaagttgaaaccaaataaaagtaatccctgtttcttgagttcttgatgattttaagttctagctatatggaactcagaacacacagagttctattgtgatgctagttttgggtctgtgatgctgatagagaattctaaaagttcgagcaacagtctccattttgtcttgtgcttttgaatcttctttcttgatgtgctttctccctgtcatctgttactcttcttctcatctttccttaccatgcccctcgcaaccaaactaaatttgagagaacttacaaaatgacattttatgatttttgttttgattacagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcaggtatgtttgggaataattgcctggaaatgaaaacctgatagcgtaaccacataataaaaagggtttgtttgttttggatcatttccagatttcttgtactgagatactgctttagcttaatgtatacggaatgggtcttagattggtctaccatagcctttccctgttactccttgaaaaaaaagtcccctatatataccaattactaaaaaattcatgtctgtaacctgtttaggtgaggtagatactccgagccctgccatctcttttttaaacagaatgctcttttatgcctctttaagttttcactggacagtaagtagtagatttgtgtgtgcgcattttagttgcctaacaaagcctaggttttgccatggtataagattttaattggaaatgttattatttgagatgatacttaaattgtagttgctgggatgtagtttctttgattcatttaatgccaaataaccaacttggcaaaatgagaattttggccatgaaaagaggatgaggggaaatatcctttctattggaattttcaagtctttaaaaatctgaaagttacagtgtttaaagtaacgatcctaattcttatgaaagattttccttttagtatgttgtcatctgcaaggtggttgactatagtatgaatttatttttttttcctcaacagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggaggtgagatagggagctgagtgagagctagcttgatatgtggattgtggcatggcatgatgaatagatttttgtgttttattaagttcctgtaagccagttgattacagttttgcactaaaaaaaatacattgaagtgggtcatcatttctgtcacaaatatttcatgaccttgggataagcagggatgctattctgccagtctgcactagccgtgtttactggttcgtgtgttaatgactgggtgttaaatatttggaatattgcttttggctagaagatgtttttcttgaggaaaaatgatagcactaggctgacatttcagaataaagaagtttcagcagtaaacttagccccaagtgttttatcctgagacagatactggcttaacatctaatttatttactttcatttaattaaaaaacatctatgatttgcaaaacatacagttcattagcgctggtgctgacagaagtcactttaatcttttaacgcatctagtaccttataattttatgtcaatcagaagagtttgttgctttccacaaattatttacgtaacgtatactaatagctaatgtttgctgaagaactgtgtgaagtgctttgaatggattatcttgtttaatggattatcttgttttattgattaagaatcaataaaggtagatattatcattgctattttcagtgttacatgttacaacggggaacttagggcttagagaagttaaattccttgcccaaagttttagggctgggtgcggtggctcaagcctgtaatcccagcactttgggaggccaaggcgggcggatcacgaggtcaggagatccagaccatcctggctaacatggtgaaaccctgtctctactaaaaatacaaaaaaattagccaggcgtagtggcgggcgccagtattcccagctactggggaggctgaggcaggagaatggcgtgaacccgggaggcggagcttgtggtgagctgagattgcgccactgcactccagcctgggcgacagagcgagactccgtctcaaaaaaaaaaaaaaaaaaaaaaaaaaaaaagaaagaaaaggactagcaaaagaggattaaaaatccttgtcttagtttttgctgttgtaacaaaataccgtcaactgggtaatttaaaaacaacatgaatttattgcccacagctctggaggctaggaagtcccagatcaaggcaccagaaaatttggtgtctggtgaggggcttgatctctgcttccaggatggcccctcctttctggatcttcacatggtggaaaggccaagtgctgtgtcctcacctgatggaaggacaaggcagctcccttcaacctcagttacaggggcactaatcccagtcatgaaggcagagtgattaagtcatttcctaaagacgccacctcttttttgttttttttttaatactttaagttctagggtacatgtgcacaatgtgcaggtttgttacatatgtatacatgcgccgtgttggtgtgctgcacccattaactcatcatttaaattaagtatatctcctaatgctatccctcccccatctgcgcaccccatgataggccccagtgtgtgatgttccccttcctgtgtccaagtgttctcattgttcaattcccacctgtgagtgagaacacgtaagacaccacctcttaatgccaccaccatagggattaggtttcagcgtgaattttggagggaagcattgagaccatggcagtccttaaagctttcttttcttctcctgctctttttaacactttgtttgccctttcctgagactccctttctatcccagggagagaggagaggtcttagggataggagtaagagaccataaagaaagggacagaatggttttttgaacttgattacattatatttgattgcatgtcccttgtctttcctacctatcctagaaattaggggatgtagatttttgagaaccaacttgatgttaatgtgaccttaagtcatttgctcaacctctgtagacctcagtttcttcatctgtagaatatagaattatttagatcatctagaatgcccttttatttctgaagttctttatatcactaaaccacaagactgaccaacgtactttatggtttaaatctatctttgttctcttttttaaaaaaaatcataaaatattttaaaaatacaaaaatataaaaataatagaggagacagttgtgtatccagcacaaaaatttctatcatttgttaccattttgccatgtgttttagattttttttttttgagatggagtcttgctctgtggcccaggctggagtgcagtggcacgatctcggctcactgcatcctctgactttctggttcaagcgattcttctgcctcagcgtcctgtgtagctgggattacaggcatgagccaccacacccagctaatttttgtatttttagtagagacggggttccaccatggccaggatggtctcgatcacctgacctcgtgatccgcccaccttggcctcccaagtgctgggattacagtgttttagatctttaacaaaatagaacatttaagacattgccaaagtctcattctcatcttttccttcttgtcctgcatgtatctttttgtgatatataaatctattcatttagactgttgtatagtatttctttgactaaactagtttattcccctcctgagtcacagtttctttgtatactataagaaatagttctttagtgaacattttaagacatgtttccttgtgtaagagtttcttcagggtagatacctagtggcggaattgctagattgatggaatccagttttacttcttcagtttccccagatattgccaaaataataaatgaaattgataaaattgaccatttacatttcaaccagcaaccattaagtttgattttgccacattgtcatcggtgattcttgttaccagacttattaatttggaccaatcaaatgtatgtgaaataccttctcagtattttaacttgcatttgtttgatcactgtcagctttcactaggttatgttgcagtagccaaaaaatctgcaaatcttcacgacttttaataaaaatggtttatttcttgctcatgttacatgtgcttggtgggtttgttatggctcttttccacaccatctttatttctgatcaagactgaaagaatagcctctacctgggatatgctggtttcatgataaagggaagagaaaacatggtagaaccatactacagttcttgaatcttctgcttggaagtggtatatattactttaactcacatttcattggccaattaagtctcatggccaaggctgataacagtatagtgggcaagtatgatcctctcatgggaaggatactcaaaaccatgaaaacagtactacagcttatattaggctggtgcaaaagtaattgcagtttttgccattaaaattaatgaggctggccgggcacagtgggtcatgcctgtaatcctagcactttgggaggctgaggcaggcggacctgaggtcaggggctcgagaccaacctaaccaacatgcccccacaaaatctttaccaaaaatacaaaaaatttagccgggcgtggtggtgagtgcctataatcccagctactggggagactgaggcaggagaatcacttgacaccatggggcagaggttgcagtgagccaaggttgtgccactgtacttcagcctgggcgacagagtgagacttttgtctcaaaaaaaaaaaaaaaaaaaaaaaaaaaaagtactgaggctgagcatcttttttctcctcccctccccccctccccctcctttttttttggagacagttgctctgtcacccaagctggagtgcagtggcatgatcttggctcactgaaacctccacctcctgggttcaagcaattttcctgcctcagcctcccaagtagctgggattacagatgcatgccaccatgcctggctaatttttgtatttttggtagagacggggtttcaccacattggccaggctggtctcaaactcctcaccatctttttatgttttatttaggtttatatgatcactctgaaatttttaaaaataaatattatttctcagattaaggactttctcccctagtttctagacttactcatgagtaggtggtgaattttatcaaatgtattttttgcatcaactaagaggatcatgtatttttctaacccgctaatgttgtaatctacattattttctactgttaaaccatctgaatttctaatgtaaacttggtagtgatgattctgcattcattttgtattatttttatttaggacttttgcatatattgcctttaattttcttttatcgaattgtcttcctcagattttgttatctgggttgtattctatcctcataaagttgcttcccttttaccattacctagaaaagccttggataaattactgttggtctatttttggtgatctggtagaacttgactttaaaactgtcttggatggtagcctttttgggagaagagtggaagtggaaggtagtttttgttttttttaaatcgttgattcaaatttttaaatttttttttcccgagttagttacagcaattaatatttttggtagagattgtccatttcatctaatttgacaaatttattggcatgaaggttttcataatattcttgttttgtgcatttgatttttatttcttatttctagtgtcgtttgcctttttaaaattattcttactatagatttaccattatatattttttcccaaaggaaacaacttggttttatcatttctattgtatcttctctattttgtaacatttcatctcgttttgctctttttctttgggataactgtgctttttctaatttcttaacacttaaaacattgctttcatagctctaattttcccttgaagtacctctgattgattgtacaaatttgaaatacagttgacccttgaacaaggagggagttaggggtaccagccttctgcacagttgaaattttacatataactcttgactgcccccacatgtaactactaataatcagtctcctgttgcctggagcctttccaataacgtaaacagtcaacacaattttgtgtgttgtattatatactgtattcttaacaataaggtagagaaaagatgttcttaaaaaataagaaggagagaaaatatatttactattcattaagtggaagtggattatcattaaggtctccattctaattgtcttcatattgcctgaggaagaggaggaggaagaggagggactggtcttgctgtctgtttcttggtggaagaaaatctaggtgtaagtggatccatgcagttcagacctgtgttgttcaagagtcaactatatagtgctttcattaccattcagttttaattttctcgtcctatcccatttgggtctcccctctcctccactctcctcccctcccctcctcttccctcctcttcccttccctgtcccttttcttcttttttcaacaggatctctctctgttgcccagactggagtgcagtggcagtccctcttcttgcctcagcctccagaatatatggggctacagatatatgccaccatgcctagcttatctttaaattccttttatagagatgaagtcttgctttgttgcccaggtaggtctcaattactgggctcaagcaattctccctccttggcctcccaaggtgctgggattacaggcatgagccactgtctctggccccattatgtatcatttttgaccactggattttttataggtgtgatttaaaatttccaaaagtgtgtgcatttgtgtttatgtatgcatgttttgtgggaagagagaatttttttgtttgttcatatttccagttttatgttacagcgtggtcagaatgtggtctaaataatagagattcttaaatttattaagactttgaaatatatagtcaatttttataagggttctttttgaatttggaaagcatgatcttcttattgttgataccggtttctaggtctgtccacttggtcagacaattatgtgggtcatgttatctatctctattaattgtttaactgcttagtttatcagttaataagagaggtgtgttcaaacctttccttgtaattgttgatttgataatttctcttggtattcctgtaagtttatgctttacaaaatttgaggctagattgttagatgcacacatgtgcagaattatatattcgtggatagccctttctttttttaccatcatataataccttgaaatttattttatttgatatttatgttattgtactagctttattttagttagaatttctcatgactctcttctgccttttatctcctgaccttttttttgcgtttaaacattgtatccttatgtctttgagatgactttttaatcacatttgagaattctgtctttaaactggtaaatttagaccatttatttttagtactactgagattagtgactctattttgccatttaattttggattgtctatttttcttcgtttacttgaatttgcttttttcccttttactgctgctcttttagaaattaagtatattacagacacacttgagttaataaagtctaatgctaatcactatgcctactcgcctctttccccatcttatttagtatgcatttcgtagatctcggatctcgttttggaatgatacaaaaacaacaatttcttatctgtgtaactagtccttctatgatctactacctgtagggaatcaacttactgtgttgcctgaagcagagttgagatagtatccaaagcgaaaagcagcagtttagtcttctaattcaccaagatttaaattgggaaagcataggagtcttcatttttatgactgtattaatttatagttagagtatcttttcatttaatagatgattacttaatattgccattataagaatgaactttggaggacaagacatgatgaaataagcttaaaaacagcatttgtgttgagtaatcctttctttttcttttgagttcatagcaaaatggagtttgaatagattttagtgatgctatcccacagcagatcttatgtaccagcagttcacttgaattctaagctgtgactttacatctcaacataggccataattcatcaatatcctaatagctattataacaatgcagaagttataaattatattccccattttattgcattttccttttatacaagttttcctcttattttgattttcccgttgcttgcttagtatcattagtttgggtctgttactcatcagacctgttcttgtttcctcctcaggagtggagcccagagtacagccatcatggggttgagcaggctaatgtttcccaattccagtgttgaccttaggcagattggatgatatgctgatgctgcttatcggtggttctgtatctctacaccggaaatcaccgtctgaggactatttggggaagtagatatgggaaactgtagctattaatgaacttttgagcactcaaggaaggagaatagaatatgggaaagaaatacttgtatttggtttgagagaatagatttgtttccatctgtttactctcagcaaatattgtatttctttatggctcttcagaggactgtagttattgtttgttctttttctttctatatgtacatgtgtctaattttcaattaaaccttgatataacatgcccactgaagaagacctaattgtcttcacttagggtgtttacaacaatggagagaagccactcaaagcatgggctgtgcaggaagtcatgaggtgatagcttggcttacagggatcttatagagagtagggtgaggttctaaaaggcctcaaatgccaggatgagaagattaaaactgatccatagcaaaaaggagctgcttagtaatggaccagaggttgtaaagtcattggtatacaggacctagcaaagtcaagggcgctgtttagattttggaacattgtagctagctatatggctgcagtaatttaaggggctggggggggggtcttctttattcagtgcattgcttatgatgcacatcagtggtctctatagataatttttttttgtgatgcgattagaacattgggtatgttaggcactttcctgttcttgttacctatcagtacctttggtcaacaaaagtaccccctttaaaccatttaatgtgaatattgctatatcaatggaataatttttttaaaatcaaaaaacataattcatgggggcatttttgtttgacatctgaacatcatctctgcttcctagcttactcactctatataattaatatattctgtataatctatattaacatgttgttatatatttatatgtattttatgtgtctatatccccatgtatctgttcatatcccttctttctcccctcatcctctactttttatggcttcctgtttccacattgtttttcctgtgggctatcaacctattctttatctcctaaacttcaggaattagataaagacaactgtccaaggaaccaatacagtactgtttttaaaaacaaatcgccatctttgaaatttgtgttcttttaaggaaagagggcatttgctaatattaagtggataaaaaatttttatgccacacagaattttctggattccccaaggctggaaataataaatgaacataaacattgagtaacagtgcatttttaaatgatgattatagttaagttaaaaaaaatactatggaaatggcccaactttaatgttatttttggcttatgtaacaataggtttattgctaagccatgcgttaattttgacctgaggcctaggctctctttgtgcatttgttccaaatctttgtggtaggtactgtttcattgttgtcactgataattacaatttacattctatactaatttatcatctattgatagtcaactgagatctcaaaaatttttcgaaaaaactttgaagattttttaatgaagaaactttataacttgatttttttggaaatgtttttatctcattgagatatttaaatggtatgtgccaaccttctttggttccagagttaaattgtagagaatttttgggtgtctcttggatcctgcatgtttacttcagggacttgactctagcactctttatgatgttgctgctaaggtcatttacatactcagtgtgttaaaacagcagagctctttcctctaagcgggggaaaaaaacaataaggtttagttgaagccatggatataaagtcaggcgatctatgtttacttttctttttactctttgggtatcttgggggagtcacttcctctcttctattctcagattgcaaagagaatgaaaatatttgcttcctccatttctagaattgagctggttttactacaactgataagtcggtatatgtgttttaaagtttgcaaataagtgtgaaagttcctgcaagactttggaagcttgagtgaatgtgcattctgagttagagttgctcacattttcctctggcatctcaaagttgttcccacatgttgattttgtctgagaatcaagggcattgtttctgcctacacaggaatgtcagtaccgttttttcttagttatgaataaggctaacaatgtaggctctcttcatcagtgttctgttgataaaagtatttctcagagagcagaatgtgtcgaggtctttttgcctttcttgtgttgagttcgggtctcggaaatccaatttgctatcattactttgagtgtgttttatttgcttgtttgtttattgttgtttcttttcaccctccaaggtggtatttcagacctatagtactgacacttactaagtttactagttaaacagtttcaactatctacatatttgtagaggatctggaagttatggcactctataagattccataaaaatagtggcagatttatatgtcattttgggaactaggaataatttaatgggcatgtattatgtgcaatttaaaattccagtgacattggtcaaggtggcatgtctttatccttttagcttaaaacaggatttagggtggtaattctattcaaaacttaatttgtatttactaaatgggaaaagactgccgtgccatgtaagtgatagaatattttggtccagcttgaagaacacaaggagctcacagcagcagagcctggcctcataatcaagtcactccttagctggacctcggcccccctccctcctccactcttggtcacgtataacctcaggctatcttttgacctctgttaccacttgattttctgagtcttcccttgtgtcaagttggtcctctaatcagacatatgctgagttgcctggccttccttccagtttctgaccctaccaactccacattttgctttccccatcacatgattcctgcctatcttagtttccaactcaaatccagctctcagaatgttcttttcttccttggaacttgtttgcaccattagtttggcaattaagcatgcactgccttgtgaaagactctcttgtattgctgtgttgaacaactgctaaactcttgtattgtttgatttttctcatgctgatgttgtttcttcacctggtttattattagtttctctggaaaaataactttcttctctctccccatagagtcttaacggaggactttgcctaaaatacttctcatagaaagtaattttgatttatttccctgtactttcttgtacatttataaagtttttatctttctatccaagataaatgatagcatttgtttatttatgttcctaagtcttctctccatcccctctaattagaaaacaaagatttgggcatttgtgtgtgtgtgtgtgtgtgtgtgtgtgtgtgtgtgtgtgtgtatgtacgtatatatatataatccacccaccctcatcattgcgactgctgtccattattgccctgcttttcagatgcttggaaacagcagaccgacttgttatataaatacttcaaaggcttattgtaaatgaaaactattatgtttctacaaaagattgtgaaactctaggcatgagagccatatagaagttactatggtgtgaccctggccctttaggagctcacattcacagctcagagggaattgcaggctcccggaagctctgttctttcacttctgttggagctgctatcagaccaggttgtttgctggctgggcgtaggctgggcttgaagatactataattcttattctttgtcccttgttttctaataatgcctcctcttctcttgaggaaactaaagaatgataggccattttatttctcagcattcgaggaattctttcacatgctttttttcttctctgtcttctccacatttggtttcaaaaccaggggattactttgtttgcccctgcatcactggtattttaaaagcattaaacttgaaagtaatttctaactgtgagcagccatcctgacatacttttgaagaaactgtccacctcttgctggataggcatgctacacactggcagccatgccaactccttggtgatttaccacttagtaagtttttaccctcatcagagggtggtagtagaacaggaactagatctttgaattatttctctgttttggaatgaaaattacttcagggtcgagtaaggttagaaatgttgggaaaagttattttcagaataaaatttatgctttaaaatcagtttggacacatttttgttactttaaaatatgtactcacgccagttagaatggcgatcattaaaaagtcaggagacaacagatgctggagaggatgtggagaaataggaacgcttttacactgttggtgggagcatgaattagttcaaccattgtggaagacagtgtggaagatccttaaggatctagaaccagaaataccatttgacccagcaatcccattactgggtatatacccaaaggattatcaatcattctaccaaaaagacacatgcacatgtatgtttattgcagcactattcacagtagcaaagacttggaaccaacccaaatgcccatcaatgatagactggataaagaaaatgtggcacatatacaccgtagaatactatgcagccataaaaaagcatcagttcgtgtcctttgcagggacatggatgaagctggaaaccatcattctcagcaaaacaggaacagaaaaccaaacaccgcatgttctcactcataagtgggagttgaacaatgagaacacatggacacagagaggggaacatcacacaccagggcctgtcaggtggtggaagctaggggagggatagcattaggagaaatacctaatgtagatgacaggttaatgggtgcagcaaaccaccatggcacatgtatacctatgtaacaaacctgcacgttctgcacacatatcccagaacttaaaagtataatttaaaaaaatatatgtaggcagtaaaatttaaaaaatctttgccagagttcatcaaatgaagggatgtaatctaattacactctctcatgcaacaacaattatcagtatcttttgttaaatccactgtgtttagaatcattctgtcatcattactgttttatttctagtctttgatttcttttctattgcttcctgttcttctgaacaaatttaagatgatgttactgacatagtttttgtttttcagctatcaggaaattttaccaattatttgctttcctcatcctacctccaccttcccagctgccaggcatgatatgggggacagggatttgagaatcttgtctccacctgtgaatgttgtttaatttatcacacaaaagctggaattaggtgcattctattcatccattcccttagcaggagcacatactctgtggccaagtggaaacatggacagaatttatcattagtatttatagcactataacataatatgccagcatttggagcttaaagggattgaatgcggtataacataataaaatacagtctgtaaaaatccgtggattattcagaaaaatagttttatgatgcaaggtggctaaattattaaagcactgacataaatgatctgtcagtttgctatttaaatatttatttaattatgctctacaatggagttatacatcaactctgaactgtgttagaaaaattatgattaggagtattaatttatcttttattttgttttgactcttatattctggagaggcacctgagggcacaagctccattctgtctagtaatcaaactacatctcataagtgtacttcatttgcagaatatgccattttagcctgttttgagattaagcctgattttgtgcatcagtctggttatttgcacagagaggaaacttaatctgagtgttaccaccatctacttgttgtattcactgacatctccttccagatttctgtcagcaacaatttcaagtgaatcaaataggactgctctgataagctattcttccgtagcacagaaagcctgtatgaatcaaatgtcaaaattcattctaggcaaatagtttacagagaatgtgctagcctacagaagtttgctgctcatggtttttgaaataagttttcatggaaatatggtgcttagcaacttttatgaaagatacttaaaaaaatttggtgtgcgcttctggctagaagttcgatactagcctctttattatctaacagttatagtcaattctccgtcttttaaaagagattataattcattagagacttaagctaagtcttgctgtttaaagtgagtagtagaaaaagttggacaaaaatcctgggttttcatttttaaaaaattaatgacagggttgctagtctccctttgtgatggtatataatttttaagaaaaatgagaagttaaggaagtcatattttcacactattttacaaatttcctctcaaaatagtatttatttaaatatatcctatgtgttcagaaataatttttatccccagatattgatttggttcctacttgagctgagaagataaaaagaaaagtatgaagtatcatttttccttttatttatgaattttactttcagagataagctttacatataagacagtaatagcaggtgtttatacacacacacacttatatccacatacataaacatatgagtcaaattgataaagtattgtttatagttctgaaaagtaatacaaaagcacagaagtgccaagttactataggctggagtcggtatgcatgtcttcactgaggagaaacttttggatttcaaagaatgatatatttagggctgagcacgctggcttatgcttgtaatcccaggactttgggaggccgaggcgggcagatcacacttgaggtcaggaatttgagactaacctggccaatgtgatgaaaccccatctctactaaaaatacaaaaattaactgagcatggtgagggggcacctgtagtctcagctacttgggaggctgaggcacaagaattgcttgaacccaggaggtagagtctacagtgaaccaggatcatgccactgcagtgcagcctgggcgacagagtgagactccatctcccaaaagaaaaaaaaaaaagatatatttaggaaaaactcagctataccctaacctaacctattacatttttcattttaaaactgcttaaatagtagcatccaagcaaaaattgggggttacaagaaagaaaaggttttaatatatccttgcgtatcaaggatgacataaaaaaaatgtaccagaaacatttgttcagggcaaaccactttcctggctttacagggctagtgttgccatttttgatccaggctttctttggcttggcattaactaggaatcttcatcttgcaaagccagtgtatttattggggtttaaataaattaagctctttgcttctgctaaatctatggagaagtggattcccacccatgggaaagaaagcataaaatacaaatgcactgatcctacctcctatcctttttcagtctgcttatcctaattttgcttttcccaggttccttgcattgggggaagaatcacgtgtgcatatgtacacagtaacatgtacactctgcattgtcttagaacagattttgtagggaacagagctaagtgtgcatgttcattctaccatctttaattggaagtctattttctacttaataaaagttgaacgatgagcatgttttgtcacatactaaaataaagtggactcttcccctgaatatagcacatgtcaaagttaccattaggctctctggatatcttctaaaaagacttttgattgtggtagctttagtagcatctgttttgacatagttcattgttttcttgcagatgcttttcattagttttcattttgttgctttagtattccctgctggtgtctagataatccgttttattttgcatgtgtgtttaattggggggtgggtcctaggagatgaaagaggatagaaatgcttttctccttaaaatatgttatttggggccgggcgcggtgtcttacatctgtaatcctagcactttgggaggccgaggtgggcggatcacgaggtcaggagtttgagaccagcctggccaacatggagaaaccacatctctactaaagatacaaaaaattagccgggcttggtggcacacgcctgtaatcccagctacttgggaggctgaggcaggagaattgcttgaacccgacaggcggaggttgtagtgagcggtgatcacaccactgcactccagcctgggtgatagagtgagactcagcctcaaaaaaaaaaaaaagttatttgggtttttggcaaataggtgcaattcatttgttattcacttggtttgggtcactatttattatatatagttttgtggctttattcattaaacatttctggaccaagcattggtgatatcatgagggatttttagtctcctctgcccctggttggagcctgtgcagtaaaggggaaagatttcattcctgtgttcatggttgggtttcacactgatttacttttctatttcttggtgcttttcgccgttagactttcttgttactagttccatgatgatatccaggtgttcctttatagtattataatacaaaaaatgttctaagcttcctgcctactttttcttcctctggaaacaaaatccctactttttcaaatctagcagataagcagctaagtaacagaggatcagcagtttgagtgaatgactttagtgtgtgaattacctgtactgccttctaagagatctctgtattttaaaagaagatacctgtttactctaaagaatctagtggtcgaattctagtggtagaatttcactattgaagccaagagaagtaaaaaaataaaggcattttggggtgggaggaggctagagggctggatttttggcatctttggatcaggtgggcacactaccagtagtacagcctttttgaaaggcacggttcagggccatgttcacccaaagctgcttaactttcctgcttctgaattctaggttctttctgatgcctcagagtttcctccttacatagttgtagcattttttgtgtatgtgtgttttaaatcaagcaagaccttaaagattcacccagccaggtccccctccctccacactccagtggtgaacaaagaccttgttgtcactttgtcttttattttactttgttagtcatccaccaggaatgaaaaacttttacttggaaaaaatgtcaaattgaatagaaacactgttgccccaagtagatcaatgtttaaaaactgagatatctcaaaatgaagtggatttttccctagattgcctagaagttgcttgtcatcaaattcaagaatcagaaattcaggtggtgaagtatatggcaactactgttgttaggaaactcatcgagacctctccttttgtgtcacgtcctatctccctctgctttacaaccataataaagtaagcgtttaagtgatataagattattctgcattgtaacttgtcttctactttggttagtttttaaaagaataagcactcctggctaatagaggtaagaacagtttcaatgggtctggcttgtgataagatgtaggatctccagtcgtcttgtgtttttccacctgatgatttctttcacaaaggtagactcaaatatagttgtcattgaagattgtcagataaatcttattttagcaggctgtgttaatcttttttttttttttctttttgagatggagtctcactctgtcacccaggccggagggcagtggcacgatcttggctcactgcaacttttgctgtcctggttcaagcaattctgcctcagcctcccgagtagctgggattacagccacctgccactgcaactggcaattttttgtagtttctgtagagacatggtttcaccatcttggccaggctggtcttgaactcctgacctcacggtccacctgcttcggcctcccaaagtgctgggattacaggcatgagccaccgcgcccagccaatcattttttttttaaagcattttaagtgaataattgagcatttgatttattatcctggcttttctatctgggtctttgaaagggacaaaaggagcacatatacaccatgggatgtagcctggccagattgaaaactgaaaattgatggatttggagtatgcaggcagatagttgaatgctgggacagggatcctctttgctgactgcctcatggttaagcttttaaaaatttgttggttaagcttttaaaaaaattttagggtttttagggcaatgaagttactctgtatgatgctataatacatcgtggatacgtgtcattgtacatttgtccaaacacatagaatgcaggacaccaagagtgaaccctgacataaactgtggactttgggtgataacgacatgtcagtggaggttcaccagttgtaacaaatgtacccactgtgtgggatgttggtaattatcccaatgggggaggttatgcatgtgtgaaagcagggaatatatggaaaacttctgtaccttatgcgcaattttgctgcgaacctaaaactggtctaaataaaaagttacagatgcccaggttcttcttttgtagattctaattcagcgggtctgatgccggctggagcatttgtgcagccagagttaagaactgctttgagaggcctcacgttaagactgtaggaggtcttactaagtgcatgtttgggttcctttacttcacagctgtttgctaactaatcgatagctgaatttggttatgatttgttttgagcaatgcctaggacatagtaagggcttgataaatattaactctaattgttattatattttaaaatcctgattatatatttttctcaggattttaccagctttcttaaatttctgatgaaaatacttaagtcgtatgccttggataaatttctagtattcttgtattttatcactaactatttggcttagaagggccttaatgtaaacgtatgccacttatatatttgcaatgtctttgtaatttaaataacttggttagactgaaaaattaaaccctatttagtacttttacaagtaagaaaaaccccacaagatttaaaaatagtatattttatcttgtaattttgaataaaccaatccctagtgtccaaggacttacccttctgttggagggtcagaagagagacattggctataaccagttgtgttacaaaaatgtagaatgtcaaaggtgaacttatttcccactgaaataaactctaagagtagaaatatttgttttttgcagataagaagttgcaaatttagcaggctatttagcagctgtttacttagagcaaatgaagatttagataattcttcctcataagctagaatactattccattaaacttttattaccaaaggaaggcatttatggaatgcctgcagggctgtattttatgaatggctgagcaactgacatactagaactgacagaggtgtttattgtcttgtttaagcaaaaaaactttttttgtataaaatttgtgggtatttacatgtcatcaaatatggttttcttagcaagctttaagatccattgctctgggggcttttttgaggttttctgcatcttcattccagaggttggctttgggtttgttgtggagctagaatgtaaatgtgaggagtgggaattggttcctggaatagccttctgcatacctgtttggagatagaagtcctccaagtgggcacaccctagtctactagctgattcttgtgtcttgaaaactattgaaaatttctgggctgcaggagataaaaactacaactgcctaagaaataaattcgtgtgtagttatgaatgagatattaaaaggttgatattgtttaaaactaaaaattagcatttattttctttttaaaaaaaggggccatatcatagacttcaactgttattgacagtgggtttttttgtgttaataatgttggtagcaggatttcagatttttttggtgccattttccacatagcataaaaatgaaatatatttttgcatcttgtttaagcttaccgagttgcttatgagattaattatatgctcagttaagaattctgaaatatttcaaaacccagcagactggggtggaagaacattccattgaatactgctcttagacttgatgggcttggaagcatcgtgctcatgaaataagggccttacttatataacatgtaagaagggcaagtaaggagtcaaagtatctatgtgattttattaaaggtgaacctgtgtgcttatagctttactaggatttccttttaaatgattgcaggttacagttactggagggtatctttgcagtctgttctagtctagtgtgtgtttttctaagcagcagctttttaattttaatttttagcaactgaaactacattgaatggtattttgtgtcattcctgtcaacaacactgcaaaattcccccaatattctgtcataatcctttgaatcctgtggaatggaaaagatgtggcaatccttaatgaactgtgagaagttttcctttctccctcccttcctttttttggtttattctctaaggaatagtatacaagaaaaatatgttgtaagaatccaacatgtttacgtaaatctcttatctatcttaactgtttacttgtatacgtatatacaaagttttcctgattaatgaaaattaagtttgaaaaaaatttttcagttacaaaaaaaaaaaaaaaagaaaacaaaaagaaagggacgggtgctgtggctcacacctgtaatgccagcactttgggaggccaaggtgggagaattgcttgagcccagaggttttagagaccagcctgggtaagatgatgaaaccccatctgcctctaccaaaacattttaaaaattagccaggcatggtggcatgcacctgtagtctcagatactcaggaggctgaggcaggaagatcgtttgagcctagaagtttgaggctgcagtgagccaggattgtgccacttcactccaggctcagcaacagagcaagaccccatctcttagaaaagagaaatatgtatttatgtatatgtcttctatatttatgtatctacatgcatatgtttgtatattatatataatatgtatcttttttgagtatttggaaaaaacgttttcaaacttaattcttactaatgatcagggaagcttttcttaagaatcttcctttactatatcaatgtctcatttactactggaattatgtttttaacacacacacaaaattgaccagggtttctttttcctggggtttgaatgaactttgggaaagagatgtgttgacagctcccttagattggtaagaaaataattatctgataaatcacagccttggatttgagacactctctcttcttccgtatggttttattggattcccatcctcctcccccaacaatgtatcagttgttgtgtttgctctgtgcatacctttctttccttggccttttatatttgcatagtgttgtttggagctagtgcaaaatacatagcttcagggctgtaatgtatagattgcattgtgcgcttcccatcatcgtctcctcagcacacaataactgcagtgtggagggccctacacggagacagtgatggtgtttataaaacgccagtggtgtgtggcattcactacaatctgccgggtaagcagttgcacaaattcctccaagttgagaggcctccagaaatgtcatgttttggcctcagtgttgaatgccacaaataacagcacaggcatgggggactttgctcagcctctcagattccagcctgccttccttgggctgcatctgcagtagatttcatttactctttttctttttaaatgaaagttcccaaaagctagcattctaatttttgaataatgtattttgagcccatccaaattgtcttgttttgtctctcttttgtgggtatctataatatagttaggtttttaaaaaaactaaaactctgatacctggaaagtagaccaaagggctttttttgtttattgttttaaagttttcaacccgttaactttatattgctagtgagtggtataagtagggttagggagaggcagacagacgaaaaatagatagctaagcttgttgatatttaatatagaaagttatattcaaaatatttctttttgaagtgtatttggcaagttttattaacagttgcatggtttttattgtttaataaacttgatatcatattattagaatagagattgactcggattgtactttatgaagattctactgtaagaacagaaacaaagcaaaggcatgcttcagatagcaagaagaaatgacagcgaaagtgatgtcttagtggaggaatgtgcaagactaggaaaccccctgtcctttctgcataaagatgaggtatggcctactcttaagaggaaggggcagattggctttttccctctagttcccaaaatgtatttggaaatgccctagtttactaaggaagagtataagcataatgtagaattgtgaaaatgaagtgttggtctgtgctggtcttctcccagaaactagttggcagtgtgtgtttggtttaggtccttgaacattatgggttggtagtccatcagctaggtaaggaagattgtgtaagaaaccagcaggcctgaattctagactcaactctgccaactttttgactggccttatggcattgagccgttccatcagcagctatcttttggcctactagtcagctaattactcagtaggaggcattgaagtaagatgtcctctttcttaaagaactcagtatctgaaagtaataagtatcaaaaggagtagaatagaagaataagtgccatagatgtgaataatgctcttgaaggagaatgatgcaatattgagagattggaacaggcttcatagggaaggatattttggagatttgtatacaagtagaggtagttttgacacttgtaaataaatcagaggaaaaaaattagaatatgtcttgataagtcagtaagtggttctctttatctggggcaataccccaaaattgctgtgacaactaatgaagcaactacgtgtactggtatcttaggtgaaagttatgaagcaaaattatgtgtatattttgcttggttaacaaatgtatatttgtagtcctttttatacagtagaattcaagttgttgatttttttttttttaaaagcaatgttaatggaagaaaattactttcctggatagaagtgtggaatattagtgtatattaagagcatacataataatttaattattttaaaagaaattcagaaatcagactgaaaaattagataaactttctataaccttatttttcttatttgtgaaataagaaagtttgattagataatggaaaactttaaaatcatatttaaaatcaattattattttagagcagctcaaaaaggtcttgtaatttcagctggctttaatgaatccatgtaataagccaaacattttattgatcactttaaacatacttcatttaattatctcatcaccattataaggtgggtacttttaaagagcggaactgaggcatagagaagttacgtaacttactgtggttacagagctgttaagagtagggctgggggtcaagcccaggacactgtgattatactgcagtacttttcttccgtattgttaagaattggtgattctcaagaaagatggaacataccagaatctcgggggaaaggaagaactattttgaggaacaatttcaacttacatgcccctgtacatttttatgtgctaccattatgcattgtgccttggttcttcacccccaccccaaagagaattattatttatggaatgtgttgtgaacagtgtgaagacaaagttgtgagccactagatggtgttgctgtctgagccgacccaatcgagtttgattgaacattagtgctataaatgttataacttggaacattcatatgtagcatttaatatgtgtcacctgataatctgatgctttttagaatataagaagaaatgtactacttattttgtttgcctttttgaataagcctccaaagcacatctgttttaggtttcttaggagtgacttttctgtgtttttttgttacaattttccttctcagtccttctttttattccctagcttatgtttcattccctcttgtcttgatgactttattatagctatttaaaaaaataatgcgtgttagaaccttttatatgttgagtataaataataaattagtagaataaaatcattgtagattaataaattttattaattttgctagggattcattgagctttcttaatttgaagttttatagcgttgtttcttttaatattgcctttcccttattctctctcatctccatctaggactctgatgagatatttgtagacccctcattctgttctccatgtctgtgaagttctttcatattgtccttccctttgtctttctcagccacattctggatagtttttttcagatctatcttccagttcactggttttctcttcagctttgtcatatcctgtccatttggattataatttagttactatagttttcatttctaggtgttttatttgattattttcaaaacctgctttttcatattcactttttccttagtcatattttaaaatatttcttataaacacataaaacatatatattttgtgttttgttcttgataattctactatgtgcagtctctgaagatctgattctgatactgtgtctctcaataatggtgtctggtttccttgtcgttttgtgatttttaatgtatgttttttgagatttttgtctatgagaatttcttgcttctcccaggcagctgggcatatctaatcttggaccagtttaaactggattatcttttggcatttttgaatcaaacagatgtgaataccagtgtctacatctgcgttagagtcagatggtggtacaggttgagtatcttttatctgaaatgcttgggaccagaaatattttgtatttcaagttttttcagattttgtaatacttgagcactccaaatcaagaaattggaaatccgaaatgctccaatgagcattttctttgagcataatgttggcgttaaaaaacttttggattttggagcatttcatattttgggtttttggatttgggatgctcaacctgtaattctttcctacctcatttagtgaggtgtggtctttaaaacaaaaattctgttgtagaatacattagtaaatgttgtattaaaaaatagtgggctcttttgctaaatagttttgggaaacatcaggtttcccaagtgaaaggaataatgggaaacagggtttttgcattgcaggactcctcagggtgtctgttatacaaataggtgttttggtgctcagtaatcatatgcaacaaggagaatttttcttgtctcactctgctgctctttttgggaatgaggggtgtatataactcatgggatgagtgggaccagtggaaaataactttggcaaatataggttggcctcgtgatacctttggcttctgctaattgccttctcgctgtctttcctactgtttataccactttatgactgtgcatgtatgtgtgtgtgtgtgtgtgtgtgtgtgtgtgtgtgtgtgactgtctgtcttgtatttaatctccctgagggaagtcgtgattctatctgctattcctcatccccagagcaaaagattgttgttgtgcagagctcttgtatcaggctatcttgtaggctactggtcacttttctttgagccaattgggccaggtacctaattatgtccaaattggtagatacataatgctttatttttggcttcccattcattctctttctctgccagttgcatataaatttcctgagaccatgtttgtcgtgctcatcattgattccctggtatcttaacataggaactgacacatatgggtcaataaagattgagtgctagcttggcaagtcctcacagtcatctgagagtcggacagggtaaccagcagtcatatcgcatggcttgtttattctggatggcttccttttttcattttactgtatcctccagtatcttttgaacagaaattcactcagtctctataaacatccgaagtaaaaagtaagctctataaacatccaaagtaaaaagtaagttattttgaatatctgttttctctacctcaaaaaatcatttcctcctctaagattcccttcagatatcatattcttggcgcagctgtgatttctgttagtcacatttactcattccattcctggtgttctgatagcactttgtacatcgctctctcaacatgtgcttcatgtgttgttgcatttttgcttttccttccagattttgagttcgttgagggtggagaggcagatggaagcttaagtaatgtgtatgtgcaatcaggatctcatcaagcattgagaatatctgttccctggagagagaaggaaagaatagtagagaagcagctttagcatctagaaacattttggtgtttgttagatgtggactagtgaaggaatagttgacagtagagtactgctatggttggttgaggcatattccatctcactgggttaattttattctcacgtgagctctgaggtagctattaccctcattttacagacagggagacttaagtggttttactttgtcacactggtgcggtgcagtaatagtaaatgcttacaaaatgttgaatgatagaggaactaggtccgatagaggaactggtccagccatcatgctgatacctcatgtactgccaaattgtagtggtgagctgtgtggatgttttttcctcttaatcttgtaaggaaattctgcccatgagggcatgttcctatttttgaaatggaaaccaatgagaacatgtgaattattagtaagagttgacttgaagctagtgttggaattggaacgtgttttctccttgaactgaggtgtatttttgtagacatcagttgtcttaaatatcctttttaccctaatttcaaatagcatcataaccaattgttatgtactgcaactcttttagtactcaccgcacctcctgtggtatctgctatctgttatccccatttcacagatgagcagattaaggcaagcagacgttaagtgtcttgccatgggtcacatagcttgtaagtagtggaagtgtatttagaactttggtgtttgacatacagagcccaatactcttattctctatgctgtatttgtatatacttttaatatgtagacaaacaagcacatatctatcttaaacatgctcagtaatttaattgactattaaatcctcattgcaaacctgtaatatgtatgtgacacattgttttatttttaaattttttattatttatgtatttatttattgagacagggtctcactgtcacccagcctggattgcagtggcgtgaacacagctcactgcagcctcagcctcccaggcttaagcaatccttccaccccagcctccggagtagctgagactacaagcacacgccaccacacctggctaacgtttgtattttttgtagagatgaggtttcaccatgttgcccaggctgatcttgaactcctgagctcaagagatatgcctgcctcagcctcccaaagtgctgggattacaggcgtgagctaccatgccaggccttacactgcttattatgttgaaataatgttatctgtgtggcattctccttcttccctttacaatttgatgcaattctattcttttcagaaatgttaccataagaggcttaataataaaaataccagattctcctcctcaagatacatgtgtggggaacattaattttcacacactggatgagctagtacacattttgatagtgagagggcattcgttttgaggatggaaaagtctgatggctttttctttttcactagcagtgcattggtggcttttatcagtgcacctggggaggaggcgtgtgtctgacctgacctcacagttgggttgttccaggggtgtgcatcttaattggagatgagtcaccactctgcttatgttttgccattgaagagacaatgagcttttcttctatggctgtcaaaggctcttacatctctgttcacagcagcttcttaaatttatatatatatattcaaggtaaaaatatgttaagtccttaggggcagttgatttcttgtcccacttccattatcttgtatttttagaatttatcccaaggagcgaacaccatatcattttctaggaaattgtaaataggagcatagctcatatagaaaataaaattctattctacagatatcatggaacaaaaaatcaaacatgaaaccaaagtgttgataggataaattatgttaggatctactgaataatagggctaaatgattttcctggggagtagtgtactttatagatatgagccaccttgaggaattgatggaagcagtttgaacatttttgaaataagaaaatgaacagctaacattttgcctttttcgtcctttttatgtctatattgagtagcagtaaagcagacggtgcttgcttatgcttttgtttcagattttatgctttgtatatgtgtgcagggtgggagggctaaagttaaaaaattaatcacttttatattgttagaaaatgagaaaacaaatatttaatgttaatttataataaatcatgtatctgatatgatgtcttaaatttatagcagtcttggaatctttagtacttgaaaagtaaagttattattttttctccagaaacatgccaagggacaagtgttatttgacaaagtgtgtgaacacctcaatctcttggagaaagactactttggacttttgtttcaggaaagccctgagcagaaagtaagtgatttcaagtttatttttatctttttagaacatattgtatttttttattaaccagtttatctcagtttaaaatttagctttaaaataacttaggtgtttattatgacttcactgtgaaatttggtaaatactgaaaaactatcttgtgtagagagaaaccacctgtagctttttggtgtatgtgtatttgtgtgtgtgcatgcatatgtgtacatgctttgcacttacatcatgagcagacagaatagaatgtcatcagtggaaaagtgatgttctggcataaagagaacacagaataaatggtattattttaatcacttttggctctcaatcactcagtctggcctttcggtactaaataagtaaagaagctggtcacatctgctcatattgtgcagtcacctgtatgctaggtattaaagcatacctgaaaggcagggaaggcggcacattggaacgattctgtctgaggataccaagaacacttggtcacagtgaaagggattactctccatgatctaacattcaaatcacagtcagcagaacagagcaatcaatagaagaacagaagtgtgaattttatttgcctacattgctatcgttgttagtatttacatgtcctactaatgaaatataagataataagagtgataattatatatactttaagttttctcaacttgcttagctttaaatacttgatatctaatttgtggtttaattctttgtttagactaaagacagttaaattacatgcctgcctgctgaatactacatgagtattcttaatagaactctgtttagagtactgttttcagacgtaatagcacatttgactgaataaactaggttttttagactgtaaattataaggtggtcttgataatgtttccaattatgtgctcttctgtttgtcctaaaagctgcaaaagagaaagtggtgggaatttggctaggattacctcctttttttgagatcacatactggtagattcataggagcatataatataatctttgtaaagtagagggacaattcagtatgttgtacaatatgtagaataacatgttctcttagtaggcataggatatactacattaagaaatctgggctaagcgtggtggttcatgcctgtaatcccagcactttgggaggccgaggcgggcggatcacttgaggtcaggagttcaagaccagcctggccaacatggtgaaaccccgtctttactaaaaatacaaaaattagccgggcatggtggtgggcacctgtaatctcagctactcgggaggctgaggcaggagaatcacttgaacccaggaggcaaaggttgcagtgagccaagatcacgccactgcactccagcctggatgacagagtgagactctgtctcaaaaaaaaaaaaaaaagaaaagaaatctgatatttttgaaatactagttttgcataagaaaaggtagtatttagtagtatttatttagatagtaggatatactgtttttttattttgacaactctcaatttatgtcaattcagctttcactgaatctcagactcatattcttaattgcctactggatgtaggagttggcaattccctctgtctgtcatctacacatttagtacacaccttgtttgttactctttctccccattattctatgaattcctcgagggtagaggccatgacttacttatctgtatagcctccgtatatgtagacattaactgctatttattacgtgtgtgttatatcacacctataaggatctccactctcatgaaaatagaaaatagcaagtgttggcaaggatgtggagagactggagatgctgtgtactatgggtaggaaggtaaactgatacaaccactctggaaaacagtgtggaagttccacagaaaattaaaaatagaactagtggccgggcatggtggctcacacctgtaatcccagcactttgggaggctgaggcgggcagatcatgaggtcaggagctcgagatcagcctggccaacatggtgaaaccccgtctctactattaaaaatacaaaaattagtcgggcatggtggcatgcgcctgtagtcccagctacttgggatgctgaggcaggagaatcgtttgaacccgggaggtagaggttgcagtgagccgagattgtggcattgcactccagcctgggcaacaagagcgaaactgcatctcaaaaaaaaaaagaactccatgatctagcagtcccacttctgagtatatatacaaaataattgaaagcaaggtcttgaagagatatttgtttacccatgtttattgcagcattattcataacagccaagagatgaaagcaacataaatgtccattaatgggtgaataaagaaaatgtggtgtatacatacaatggaatatgtatgtacatatcaatacctactcagccttgagaaagaaggaaatcctgtcacatgttgtatcatggattaacctagaggacaccatgttaagtgagttaaagcagtcactaaaagacaagcactataggattccacttatatgaggtatctaaagtagtcagactcatagaaacaaagagtagaatggtggttgctaggggctgggggagggggagttgaggaattgtttaatgggtagtgtttcagttttgcaagatgtaaaagttctagagctctgttggacaatgagaatgtagtttacattactcaactgtatattaataaatggttaaaatggcaaattttatgttatgtgttttttactacaattaaaaataatcccactacctgtgtacaaaccagcgtgctcgctgctgaggctctaaccgtaaacggtgaggacgtgactctgccctcagagatgcccctgcttatgttttagttgagaaggcagagtggaaaagctaattctgcagttagtgaattttgattactactctgcaggaaaaagtcaggatgctaacaggaggactctgcttaggaggaagtgatccttaagcagaaacctcatgtgtgagtggactttggctgggtgatgggacatgggaagcacatacacgaggccctgagactggagcagctgtctgcttaaaaactggaaagaagcctggtgtgggttagtaaggggagaatgagattaggctaggggaaagactgggtgttaacaaggctcagatcatgcagggccacttaaggctatatgttaaggcttgggacatttcctttttgctaagaaaaatggcaaaccattgataggctgaagcaaggatatgagatgaccagttttgtctttaaaaaggtcactttggttgatgggtggcatgggatgagaggggacttgagtagggctgtacacccaaagcacaaaagtagccttgagtaaggttttggcagtggaagtagaaaagcgaatgattgaagagagaatgaggaaggaggctgactcaatctgatgaatgattgaacatgaaggatgacagataccaagaattaaggcctgggtttctggatggttggagttgttcagtaagaagggtaggaggactcgactggggggttggtaggggatatcatgagtgtagtttctgacatattgagttttaggttcaataacttacggaaagagcaagtaaataaatgaatttagttttggaggtgtcttaaagaatgacagcttgcatggaacaaatactccactctaggtataatctgtcttagcagtgcagggtgcatggggtagctttatttcctgatgtgaatatcatattcatatggaggcttgtaaccaggagtacttctttgtaacttacttgtttttaaaaaaatcagaggtggcttttaccttgcaaatattccaaataaaatataaatggctgttaacagctgatcattctggtattctcactaggcagcaggcaccttccctgtgttgtctcatgtagttctcagaataaccctaaaaggtaggtactattaactacacttatagatgcagaaatttgaggcatagaggaagttaaagaagtcacccaaggtcacctagccaataaatgttggtgataagattcaaattcaggcaaaaaactgagaaggaaaaaatacattttagattttaaggaaaatgccaacagttgtaaaccttctgtcagtcaaggtaaaaatgggcacagtttttcatagctatcacaactggaagtagaagaataccatgttgcctcagaggaatttttcatgttctcaaattctgaaagtcaccttgcaagactttaaacatagtgtgttgaaggacattgtaagctgagttcctaggatgagtttcacagttgtcatttctattatattgtcaacaaatttaagggcatgagctaacttattgatggtgattctgtgatggtctgtgccagtgctgctcaaaagagacttcttcctttgtgttagaatcacctgggagacagattttcaattaggaatcttatttatctctcttcttcctccattgttcgtaaacacacgtgcgtgcgtgtgcgcatatgcacacacacatagaaatgcacattcattgggtatgccatgattccttcctttccagttaaaaaatagtgccattactgtttaatttacatataggatgttgaaggatgttatgggctgtgcttccagcagggatatgtcctattcctcagatatgttgggacagaaaacagattaacctttggtcaggttgatattttcaagtatatagctttccagtaatctaattcagtgatagagcttaatataccctgtcctaaataccagctggacatttattagggactagataggagagacacttgcaagttttactacctgacaagggcctgtggtatgaatattttatattggtatattaaagcagatctataaattttggaaatcatatgagcagtttagtgttgacattctattatagctattgagaattacggccagtattctggatgtgggcagggaagggacattttgcacagaagaaaagtaatcgttccagcatgaatgatcatgatgtgggtgcggagtttaaagtttgtccggagggctggaggatgtggcagttccagcctctctgaataggaaagacctgtgaggggtaggcaagctggcagggggaggtagggactcgtgttttctcatgagcacactgttttaacttagatcatgggttaatttgggatgactttgtggggagtgctaatggagtttatgggaaagcagctggaaaaataagcaaatatcattctttggatcttgtatctcatgctgaggaatctagattttaagtaggaagtaacgtggtcagatttgcatatcagaaagaacctgttgatggtgtggagcgagatgataggggactgagaccagaggcaggaaggtcaggagacagttgcggtagtctagtctagaggtgatgaaaaccagggcagtggtactaggagtgaagaggaaaggacagagattctgtgtaggtaatgtctgcagtcactttgtgactgccacctgttagctatgacagcgaggggagagttgaggaaaagtcctaggtttcagggttgggtagctggggagcttgatggagacttttacacagggaccttggaggaagagcagcagtttgaggtatgctagggagcggagatggaacttaatttttattttgccaagttggacacgtttgtaagctgttggctagattggggatcagggagtaggtgaaggatgaagaaatttaaaagtaaagaatttgagaggccaggtatggtggctcatacctgtaatcccagcactttaagaggcccaggcgggaggatcagttgagccctggaatttgagaccagcctgggcaacatagtgagactctgtctctagaaaaaaattaaaaaattagccaggcatagtggcatatacctttagttccagctattcggaggaggggagaggggtgctgaggtgggaggatcacttgagcccagtaggtcaaggcagcaatgagctgtgattgcaccactgcactttcgcctaggtgacagagcaagaccttgcctaaaaagaagaaagaaaaaaagagaaatttgacagtgagtgtaaattgttgtttaaagaagtgtttggctgtggagaaaagaacagatgggagaatgatactagaggatgtaaacctgcaatgtccagtacaagttttcatgatgatgaaatgtttgatacctacactgtccagcatggcagccattagctgcatatggctattgatcacttgaaagagtgctagtgtgtacgaggaaatagacttaaattttatttactgtaagtaatttaaattgaaatagcctcgtgtgaccagtggctatcatattgcacagtggtgacagttgactgagagttttggggttggcagatttactttgatggaaataactttgactttagctatgagaaaacccaagagaagttatgtttgaagaaagaggagagtgactatgatgatgaaagtcatgaagaggattagtcttgaataaagatgttatgtcatcctgagtctgcaagaaacagaataaaaggtggtgcagttgttaaaaaaaaaaatcttagttgagcaaattgtagtctccaatctctgtgaaatagagggtaaaagcatttgcttaagagtgactagggtagcagtgggacaagagaaggagccaaccaagaattagtatgtggattgctgttaatagttctgctgagattgtgggggtcatacatttgggatggcagcagaatatatttgtgtgtgtttttctctaattgccattagcaaccttagtgtcatagctgaaaaaatggagtattagcagggttctcagttgactatgttcatggaggcaatagtaagaggatgcaggattgtgaaatctgaagttgctgatgagatgtaattaagctgattattcacagggtcacaggaaagaaaattactgaagctgtaataggctgatacattgggagaacgtggctggggcaaaggatgaatgttcaaagatgttgaagagtaggtacagtggggatacatgggtagaaaattagagggagaggaaatgattgcatctgagaatgagctgatgaagtctaatgaggtgaagaactatgtgatgatgacaagacccagggtgtggctgtgaaaggggatggctgaagtcaaggagacagattaaggtcattaaggaagaaaatactaagataaaggtacatttgtttgggtctactgtagcgttcttattgacagaaagacactaatgctaaataaggaattcataattccttattatacgtggtagtttctcttatgaaaggtaagatgaacatataaaattagacacatgctttgtatatagactttaactcaaaaactttgggaacttaagaatgaggtgtcctttctgagacattcacttttcaggtgtgaatatttaaatacaattagcaatatctttaattattcatatataatctgatttgctataacttttatgttgtgtaatttttaaaaatttctatctgcttatgtagacaaaatccagtcctcaagacatctaggcaaaacaactcttattcttccactatagatttgtatggtatcctattttttcccccacataaatttattactattatactaactcagctcaatcagtcctgctttgtttaaatcccatgcagttttaacaacagaatataatgatgtaaggatctttcctttccatgccgaatattatctgtacttatgggaaattttgattcttaattcaacccattataaagtaaaggtgagtgaaaaccacgattatttgtatacaaatttttcatggagagaaaatctacacatttgtttggttttaatacagtactatatctctcatggttgagacactgaggtgaaagtctttttagttcattctaggtatgaaaaatctgtcattgttagtgttaaagcttttttaatgtctattgagagtgcttatataaactttactatggaaaatgttgttaaaaatacgtggaatcaggcaacatgttattcaatatggaattccaagtccatatagttcttgtattcatgtctaaatgaaaccatcgttaagggttttggactctctttaaagggaaaaatattgtcttgaatttttgatgttaatagtttggcatttggcccaaaatgacattataacgtcattttgctgcaagctatattgaaaaaggagcttgttagaaatgtagttgatattcacggctaactttatgaaaattagttgaagcagtcatctaatagaccattttgttccagaaactagaactaaaaactcaaatattaaactgtttgcatatataaactattctttaataaagttctacattcaatctagttaaactttataatcccacattctcccagatgtgtagtgaatgtttcactgtgatacagtgcctgtaacttttctcctaacaccagcattatggtagagttctcttaaacccaatttaggcaaaggtatattaaaggggatctgtttcagcactataaattcctgtgagaaaatgcagattctagacaaaactacttttaacatttagtcatacactgtgaattgggttgaatttgttaatttctcttacctggccaaattagagatcacctaaagcaagtgaggaaggcatggcgaggcatttgagaaacttcgaactctggggtcttagggtctaacttaaaggagaattaaatgaatgagatagatttttttggggggaaaggaactgttaaagaaaaacttattctaacacttgttaaaatggtaaggcagactttattcaggactgttgtaataggtataaggacctttgcagtggggttttgcagtaggcaagagagattgggctcagctccagatacgacaaggagaagtggaaatttatagtcaaggagcagggtgggggttagtagatgggaaactaataagaggaaacatcaggggtgcacttaggggaattctggttaaaccaagctaacaggattcttgttgaaggcaggtgagggtgatctgatatcacttgggggatggtggaggatgaggaaccccatcagatatcaagggtaattagttatcaaggatgggggtttcccactaaaccaacttattaacaggattcttgctaaagttggatggtgtgtagatggacacagaagtctaaaacctgaagcctaattgggaagaggattcagaggagcctgactaaagtttggtcaagaaaagactctttgtcttaactagaagatggattttatgactgtattttgggttgttatccaggtcaagcatggttaggaccctgctgtggacaactgcacacccagactactaatgccagttgatgactgtggttgcatatctcttctcaggtgaaagtggttagcaagtagaataaaaagacctggaattctttggtacagctgcttattgtgatggggaggagttcaaaggaacacttagatatgggaatgtggaaactgtgccctgccagggctttctgcaggaagctgtcaaaaattagaaggtttactcagtgaaggctgacaagccagtaggacttgaaaaatgtctctctatattgagctttcaggaaaagaaagaaatttctacataaaaagaactctagggctatcctactcaaagagtggtccaaggaccagcagcgttggctccacgcagaagcttcttagaaatgaagaactctagcgctcaccctagacctgctgaaatagactttattttggctagatgttcaggtgattcatacgcacctttaaagtttgagaagcattgatgtagggataaactgttcttttgatgtagcagagagcattacaggagtttgaaatgtcatgaaagccacgggaggaggggagtcctagtgggcccatgtggttcatggtcccagaagtgttcaaatattcgtagccactgaggcaagagttaggccgttccccaaatatggacatttggaccattattctgaggttctttctaacactggtattctatgaatataaatacagtattaggattcataattaagctttttttttccccctagatgtttctgtcactagagcataattgagaatcatgtttaacactttttctgggaacccgtaatgaaaatgttgtaggggaaatgtcataagacaagactttcatcctcagatttgtggcaaataaagagtaagattaaggagattctctaattaactaatagaaagattttagtgtaaaatacatataagtacagctattcactgtgctgcttagtttaaaaaaaattctgtaaccttttaaggcaggaaaaaaaaatcccacctctttttgtgccttgaattcctttggcagtctgctgaattctataggctgcttctcagaacagtgttttcaatgtataactataataaaagtacacagggctacaaagaaagccaataactaaataacattcccaaaatagtaatctaaaattggagacaaagtaataggtatgtatattagtctgttttcatactgctgataaagacatacctgaggctgggcaatttacaaaagaaagaggtttacaattccacatggctggggaggcctcacaatcatggcagaaggcaaggaggagcaagtcacatcttacatggatggtggcaggcagagagagagagcttgtgcagagaaactcccgtttttaaaactattagatctcgtgagacccattcactatcatgagacagcatgaagatctgcccccatgattcactcatctcccaccaggcccctcccacaacaagtcagaatcatgggagctacaagatgagatttgggtagggactcagagccaaaccatatcattatgtgtttttatttatatattaatcatcagtatcaaatctagtagctactgtgacttcaaaatattggctagcataaatggtattttaagatctgcagctactacaatgtgatgtggaaatgtttttgatttctgcaggtgacaaagaggttctgctgatattaaccaggtttttttctgctatgttcctaattgacagtgatgctaagtttcagttagaagttagtaaaaataaagatggaacatatttccccaaacttgagttcattacctcccaatttcatgtttgaaggtgatttaacaatacttgatattctttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggtgatttaacaatacttgatattctaaggccacattttaattttattttacttctgttggaagcctgttttaggattccttataacttttattattagtctcttattttacctgatgttcatttaggagataaatatttactgtgttcatgttttgggtttggattagggaatggagaggagaaagtaaggagaatactgaattgagtaagtgactgttcctgctcttaagtagttggcaaaatccttgttttattttttttaataaaacaagataaattttattgaaatctgatataggtcagctctcgagttttgcatggttgcttataccttaatgtttgggaaacactgagaagatccctgtcttgcctgatcttgaattgcctgaagctgtcactttcctgagttccttccctggagaatgttttaggatgttctgggcagttgtccatggacaaagagctgtcttttaaaaaatttgccgggtggatttttaccatcggccaaactggataatactttaacatgtacatagaagctcttagactagtcatatagaaagggcttggttttcatgtcatctcgcctgtgaatacagtgaccctattttgtgaaccgaaagtctgatttattaactttttgtgggtagaaatattcatatagagattaaattctttaatgtatataacacatcacctatggatatataaaattatgtgaagaagatatatataccaaaagatgataatttagttttattattgcaaatagtgatctactaatgatgatctgctggggaaggtacttgtatgcatatttattcttcaggcttgaatattgtttgaaaagaactaccctatgaggtagatgttgtgatccccattttgtgtttgaggaaattgaggcttaaagaagccaaggaatgtgcccaagttagagttgatagaaaaccagaattttactgcgtgtatttctgattccacggtttatatatgtggccacagcagacaaatctttaagtctaaaacctggcaatgaatactgtagtgtatcatggggtgagggcggttgttgtatgttgtgcacacacaccctcatgcatttttctcattctctgatggcattttccatctttttgtgtctgcttcttggtctgctcaaccctcctccttaagtgtcaaaccaagaaattaatttttattatttactgtatttatttaaaagttttgtttgttatttctttgtaactggtaatgcagatcattaacttgtatttcttttaagtcatttaagtcattttttttttacttaggaatttatgatgctataccccacttaccatctaagtactcattagagatatgtattcaagtaaaaataaatgtaataaaagtaatataacgtgatcatttaagatgatcacagcgtggagaggaaggaggcaagcaaggggcatatatcagtcagcaggtattaatttagttctcactggttgcctaaaactgtattaagtaccctggaagatataaataatatggtctgttccagcccttgcaaagttgtagtactggggagtgagaagacagcctaatgcttggcaggaatggaacttacagtgtgaaagtgagtgtggttaggaaagggaaaacgcggtgaggaagtcatgctgctgtttgatcacatcaggtaaaccccgcccacttagtctttggatggttgaaagtaagccatttcagccttcagtaatctgtctggcagtgttgtggaaagtggcctgagaatgacaccaagtctgaatttggctgtctgacttttcactcatattgctgggtttatagagctgactcttaccatgccctatagaaactgttaggtaatttgtacaagggccgggtgctttaggtgagaatagaaggtgccaggtggctgggacacagggttagtccttgggttcacaagcttccaccatcttctggaacagagaagggtcctttgttgctcttctgtactggggatctgtatcactgctcacacttaatgaaattggggatttggaagggtctgtctttaagaccagcactttctcttaatttctctgtgttaatattctggggactttttttttcttttcaatttggcgccattcaatttcgtttttcttgctatggttgttccttgggtgaaaattccacccatttgcccctttctcacctctctcccagcctccaaccagtgtgggctagaggctgaatgatgtgttttttcattcctgtgcacttatcgaggctggccatttgtgagccagctgttgggtgggacagcagctgcagtgcatgcaaactgaatggcaggctctcttctgaaggggtaattagagctgctccctcacatggcactggaggcacccttagagaggcctgctgcccctcacgtcagtagtgcatgcagctgggacaccagtaatatgaaactagaccatgctctggtagttctttattgagaggtttgaatataaccagtgttagaacagagccatgtacaccttggatccttgctaccccgagtgcgggccatgaacagtagtgaaacccgaggggccatgcggctctgctttcacagcatcttactgttttactttttaatagtgtcagttaatgttccgttataccattttaatatggtattaagacagcaggttattttctgtgtactaataagcattttaattgtttgctttatatatctgaataaaattctgtttaagcacagatgttgtaatacagtggtccccaacctgtttggcaacagggaccggttttgtggaagacaatttttccacataccggggtgggggtgagggaatggttttggcatgaaactgctccacctgagatcatcaagcgttagtcagagtctcataaggagtgtgcagcctagatccctctcttgtgcagttcacaatagggtttgtgctcctctgagaatctaacgcgggtggtgatctgacaggaggcggtgctcaggtggtaatgcccacttacctgctgttcacgtcctgctgtgcagcccagttcctaataggccacgatcggtaccagtccgtgggatgggggttgaggacccctgttatattattttggacactgcttagaatgagtaaaacttaattagactcatttatttgaattagtttattgtacctcaaaaattgcacttctcctatgttagtgataacttgagggtagaaaaatgtaaatataaaaatataaacaaaaaaatctaaattttttattggacttttgcttgtagcttcgaaaaacaaaaatttaatgtccttgggtggttcgaacctagtggtttaaatttggtcttttttgctttaagatgctgtaacagtttcctagcatttttttaaagctttcttttttgttgtttagttggagagtttatttaaccattggatgtaactattgacttgttttctttttttttattattattgtactttaagttctgggatacatgtgcagaacgtgcaggtttgttacataggtatacacgtgccatggtggtttgctgcacccatcaacccccgtcatctacattaagtatttctcctaatgctgtccctcccctagccccccacaccccaacaggccctggtgtgtgatgttcccctctccgtgtccatgtgttctcattgttcagctcccacttatgagtgcgaatatgcaggttttctgttcctgtgttagtttgctgagaatgatggtttccagcttcatccatgtccctgcaaaggacatgaactcatccttttttatggctgcatagtatttcgtggtgtatatgtgccacattttctttatccagtctatcattgataggcatttgagttggttccaagtcattgctattgtgaatagtgctgcaataaacatacgtgtgcatgtgtccttataaaagaacgatttataatcctttgggtatatacccagtaatgggatggctgggtcaaatggtgtttctagttctagagccttgaggaatcaccacaccgtcttccacaatggttgaactaatttacactcccaccaacagtgtaaaagtgttcctgtttctccacatcctctccagcatctgttgttttcctgactttttaacgatcgccattctaactggcgtgagatggtgtctcattgtggatttgatttgcatttctctaatgaccagtgatgatgagctttttttcatatgtttgttggccacataaatgtcttcttttgagaagtgtctattcatatccttcacccactttttgatggagttatttttttcttgtaaatttgtttaagttccttgtagattctggatattagccctttgtcagatggatagattgcaaaaattttctcccattctgtaggttacctgttcactctgatgatagtttcttttgctgtgcagaagctctttagtttaattagatctcatttgtcaattttggcttttgttgccattgcttttggtgttttagaaatgaaggctttgcccatgcctatgtcctgaatggtattgcctaggttttcttctaggattgttatggttttagtcttatgtttaagtctttaatccatcttgagttaattttctataaggtgtaaggaaggagtccagtttcagttttcggcatatggctagccagttttcccaacatcatttattaaatagggaatcctttcctcattgcttgtttttgtcacatttgtcaaaaatcagatggttgtagatgtgtggtgttatttctgaggcatctgttctgttccattggtctatatatctgttttggtaccagtaccatgctgttttggttactgtagccttgtaatgtagtttgaagtcaggtagtgtgatacctccagctttgttctttttgtttaggattgtcttggctatatgggctcctttttggttccatatgaaatttaaggtagttttttctaattctgtgaagaaagtcaatggtagcttgatggaagatagcattgaatctataaattatttttgggcagtatgatcattttcacgatattgattcttcctatccatgagcatgggatgtttttccatttgtttgtgtcctctcttatttccttgtgcagtgctttgtagttctccttgaagaggtccttcacattccttgtaagttgtattcctaggtatttttttctcttagtagcaattgtgaatgggagttcactcatcatttggctctctattattggtgtataggaatgcttgtgattttcgcacattgattttgtatcctgagactttgctgaagttgcttatcagcttaagtagattttgggctgagacaatggggttttctaaatatacaatcatgtcatctgcaaacagagacaatttgacttcctttcttcctatttgaataccctttatttgtttctcttgcctgattggcctggccagagctgccagcacagcagtctgagtaaagctttcttaaggagttccttgtgattgctacttccaacttagaatgaggttaagaagaaagaagggtgttatattaagaccaggaagggaaatattgtctccaacctgaccttacctctccttacaattatagagttggagggaaagggaggattaaggaggaggagtagttcgttttaggagttgagataattgtgttcgcttggtatgtatatacttttagccaacagtttcaattttcacactttatccttcatgactaggaatccattattgtccttgaagagctctcatttcagtgtctgcaggggctatttgttggcagttctacagaataagactgtgtgaagatatgtctcatcatttggaccattttagatgcaggagaatgaggcccatgggacccaccttaaaagcatgtgaatattttacttatagtacacacttaccacatttacacacatatgtccccaaggacaaagcaatacttagcccagtggaatgctgataggtgcaagttgctttgaataatactttattaaaatgtgtttacacttaaataattatgtgaactgtaaactgttctattttagactctagaatatttcttatgaattaatttttttccctcatgcagaactggttagatcctgctaaagaaataaagagacaactgagaagtaagtatataaataatcattctttgaagttaaggtgtcttgatatctatttgtgatataaatgatcagtaatagaatggtcagttctattttgcatttatgccatcttagaagttaataatactaataatatttttgtggaattgtgactgtttcgtacatggctcaggtgctcctacttttgggaaggttctagactcacattcctaaatattcactcagaatgtcctaccaagtaacatctgacattttttttctgggaaagaaagagaaactacttttctgtaaattttactttctatgtaaattttactccagtgagacctgatactattgctttgtctgcttcattttgaaagtgcataattagttcaatatgcacatctttggccacagagacatagagacactgttcctggatgtactggagtgaggactctttggggagaagcaaggggaacaatcttttcagttctctgaggtcactgccatctctgctcattggttctacaatccaaggccactttgcatactctttgagcctgggcttgtagttaggcctcattgttcatttcttccccttttcccatttgttcttgtacaatcccaaaatgactccaagagtcccactctaaccagcttcagttctctctatacgttctgcctctgcaggttgttttgcctgtggctgtttttttggtatctgtgccaagaaacatgataaatagagagaaatctctgttaggggatctggatacttaatttacttcagggtctgtgaatgactgaagcagagaaggtaggcagctacaggcagttggaattttcggtctggagaataaaatctgaaggctggtaaattcctaacagccttcctcgactgtggagcccagagttgtcccaggagaaacctcttctccaggtgccagcatgcaagatgccctttgtactgttgatttcatttccttacttacttattattcctaaggtcaaaatactgaaaccaatctgtcctttcccttcttgcccttttcatctaccatctagctcccattttaggttcttcacatttgttttctttatttctttctctctcgaattatttatctttttggtagtcttcctgtcatttctttgcttccctactctctttttttattctgagcatataccttatttttcccatttcctcttcctgtagactcatctttcttttcctttttaaaaacgtctttgattagagtgaccaacctcctgatttgcccaggactgaggggcttctcaggatatgagactttaagtgctaaagctggaaccagtcccaggcaggctggaatggttggtcactatccttttgattattattcctggtttcccacattctctttcttgcatttattttcttggtgtttcatccatttatgcttgcttcatgatggaaaagggagaaaaagaagaggaataagtagacaccagatacattatgcttaccttatggaagaaacagtaccagagctttgaaactttttcctttgtcccttctgcagttgttactttgcaaagtgcatgcattcaaaaaggttacggatgcttagttcttacactttctctgaaaccagacctgccaagtgacccaaacagagagaacagggcaacctctgaaacatgattgatgttccattgagttgtttcctatggttttgtttgggttcttgtttgattattattattattttttttttgtgccactctcttcagagtcatggagatttcctaacttttggaagccaaacctcttgccgattatgaatcatgttcttatgttttgattatctgtgaagtttcaaaaagttatttcagaacttttacccttgtggtttggcaatatgagtaacagtaagattagactttttaaaactgttggaaccagttctttaaatggcatcctgtactgtacccatcatgaaagcaggctgaggaaatgaagctttagcagttgtatctacctctttctttctgtattaaaatggaccaaaaaacctgcctattctatccttggtgtctgctataattttatttttatttttcagctcataggcagttagcgaagataaatattaatcttttttgagctacctatgacaaccaacaacttaatgattctcatttaaaatttgccttaaaacctttattttctgaaacataaataagactatatgtctaaggcttgcgtatgactagtatgtaaacatttctgtagctagaaggactgtttataaacagctaggtaaaaattatgatgataatatgtaatcaaattaaaagtttaacttgaaaactgctaagggagtagattttaagtgctctcactgcaaaaatagtatgtgaagagtaatgcatatgttaattaggtcaatttagccattccacaatgtatacgtattttaaaatatcatattttgtaccaaaatgtataccatttttaattgtcagttttaaaaaagcttagcattattggtacatttcaacagcttttagatttggaagtatattagaaaatatgtggtctagtagaaatgtctccgagtcctgtccaggcaagcatgttctagtgttattacctagaaaacaaacaaggagccattaagaaatgataatcctgtgataactttacttaattcgagactagcagtcaccttgaagaaatgcttacacaaacacgatgcatggatatttgacagtcatcatggcgctataggccaagaaacctcatatatcttgatattcaggaaaatcttatatcccattattatgttttaaatgtgtaaagcagaactgaaatctgcttcttaagttcagcaggattgacttcattggttgaatcagtggtgcattgagccaaaatccagcaaaaaatgcatttgtatacaacagtagccatttaataaatatttgagtgagtgaaaaggtagtgtgctgatggtaagacaaaggacaaaatgccacactgaacaagagaatgggattcaaggaatttttcttcaggttcataaattaaacatctcataaggtctttaaatatgtatagaatggaataacttggctgggcgtggtggttcatgcctgtaatcccaacactttgagaggctgaggccgggagattgcttaagcccagggattcgagacaagcctggcaacatagggagaccccgtctctgaaagagtaaaaaataagttagccggacatcgtagcgcatgcctgtggtcccagctacttgggaggctaggatgggaggatcacttaggcctgggacgttgaggttgcagtgagccatgatcatgccacggcactgcaacctgggcgacagagtgagactctgtctcagaaaaaaaaaaaaggaataacatatatacacacacacatttttttaatttaaaaatattatgaacttgaagtcaaactctaaattcaggctagtggaattatttggattccattaggaaaataatacctgccctttcccccatagttttacttttttaaagttatcctacacatgatctatcaaaatagcagttaaattttacgtataaatagcagtgttttaacttttaacaagccatttatgatatggttgcttgacttattcattctttatggcacaatacagccaagtgtatgttatatacgaatatacttacacctactctactaaaacctgggaaataattgtattgtcctaaagtatcatgaaattataccatgctttcccttcttgggatctcttttaacaccttcttcaaatagcccattaataattttttgaatagctattatctcttgatcattactctccttccccacaacaatgtagaaaatcctgaattttaaaaaaaaaaaaaagggtggagaatatttggcaacaggagatcctgtggttaaattgaatcttatctcagaactattacatggaggttatattaaaatttttgtataatagatcaccatataaaacacatgttgaggtatcagtaaatgtttataagaaagagaacctattactctttaatggtggcttatttatgtaattgatttctattttattttttatttcatttttattttataaacaattttaattttatttaaataaaaaaattctgcatgctgatttatagttggattagtctgtactgtttgatccttgacctttaaattttatcacaatagtcattcttctgttaattgggtgcataactgtgatatttaataattacagaccttccatggctattcacttttaatgtgaagttttatcctcctgatccttctcaattgactgaagatatcaccaggtactttatatttgcatttttaaatgaacctttccttacagctctcgtttatttttgtgccctgggagcatagtggtaatttcaggattgaaaaccaaaacagtttttcttaagttttagaagtttccttgaaaatgggtacatccaaatagtttgaaatgttgccagtttcaaaaattttattcactttctttaatatcttcatttatattctagtaatgaaaattttaaaaatgatactgctgacaactttgttttctatgttatacttttaaaagtcactaatatttaatatttgagattttaataccaaggtcatttttattgtatataactcatgtgtgcttatatactagtctcatattacaaagatgatatgaggttagcaaaatgaaattattttaaaagtccaattgaactggtaatttctttctctcttctccctccagaaccaaacaaggtaggatttcttatgtagagtcaatagctagttcatttccatctccttggagattgtgtgagctataagaacatacacttgaattgcaaagaaaggattctgtttaggagcaagagaatatttattgattctgagtacctgaatggcaaccaagaaacattgtgaatcaacaagtaccttgaaatcttagcccagttagactgggtaccagaaacattgtgaatcaatcaacaagtagcttgaaatcttagcctgattacactgggtaccagggatagcatttcttagctttggtgagaggaagtataaagggttgatttttttttttaaaggatgatttttatataccatatttttaaaaggttacttacatggtcaagtacaactgtgtgcagtgcatgacttttagaaaactagaggggcttagcaaaagagtctgcttgtctttagttcctgtatctttgatgctttctgctgggccagttttgttgtcagacatcaagttgtggaagtggttaagagttcataatatccatgtgaaatagcaaggatggaaatttctttccaatattgggtacatagcaggccggccttttttttttttttaaactacttgttgctgaatatgaatgcactaattaagctctgaatgaattagcttcacctagtaaataataaatagtagcttttgtaactgcacagtgagctacttagagcataaaacctgaccgaatggcatgtgtaggatgcagagcttcactgcaggggtgcctctgaacaatgcatgtaactggggctttgtgacccaacactctgtacatacactcctcctggcagtaatttgtttggagaatgataatcctttggtgattgcaagtttgtagcatcagtactttggttttccatataaatggaacttgaacagtctccctgtctagtgggaggaacaatatagtctgctcagctaactaaagttctcagtggtgcagcctgagaccagccacctgcctgtacttgtggcctggaagcttaaatgtcatgatcgaaatcttcaccatgacttgagtgaacatttagaagctggggtaggcttctgagaagggcaagaacactatttcgaataatgtttgaagaatgcttcatagtgctgtgtgaaggtacagttgggtaattcaggaagctcatgccattttttgtttgaagtttttaggatttagacttaggctttgaaaacagaggaaaggaccaatgtgaaaagcagagacaataatataaaaggaagcaacaagatgaaatctttgtgtttaggttctaaaacttccataaaatgtggagaaccatcactgttgtttattagagaatttgaggataacctggacccatggttgaaaattcagttgtctgaagtatgtactgttaatgcttatgtttttctacgggtcaaggaaacatataatcctccttaaaaggagatctgcaaggcataaaatactcaaaatactgtagtgatagcgagaagactttcagtctctcaattaccgagcacttgtcatgtggcaagccctccagtaactgtgggactatagtgatgataaacagagtccccgccctgcctgatgatgtatttgggtggtaatccaggttctgaactgacctggccccatgtgctgggttgtgctctctgacccagtaacaacaaggcctggaccagaggccagcactccccatttgattgtgtagggtagagagcaggaagaggattgggccctaaaacccaggccaggcaagtgtccacaggactaagatggccagctgccagtatgaatgccagtctctaaaaggtcttaaagaatgaggactctgctgttgatttgggaggatccatggtgaccatagcaagtggtgaagttaaagagtagaaatcacattttaaaatgttaccaagaggaattgatagtggggcttaaaaggtgggggaaacccacagggtatatatgacatgtttctgcattttatttcatggaaaacggaaattcttttataaccgtagtgagccacatggaacattgaatgagaaacattatagccactaattattatagctactagttattgattcttaagcatgtaccagatattttatttatattatctaatgttcatgctcatcttcaaagggaggtagagttcttagcgtcttataggtgggaaattacccttaggcaagtaaattaacttgctcaaggtcatatagagtcaggtcttcctggcttcaaagcccaggccttttctgctaaactgagctagctactgctttaaatggggtaaatggaaaagtaagggcttcaaagtagagatttaccaataactgttgttaaaggtgtttctggaaaagaagaaatgtcaagatgataaagggtgggtgaccttagcttttcttacaaatgattaagactagtttttttttttaatctattaatccttacatcttttgaggggcgtgctaatttttattacagtttgaaatccaaggagacagtttaagtgattgaaatttttacttcagttataaaactcttatatatatacacacacacatataaattagccttctggactcagtttctataaataagccacaagtttagaagcccaaggagcaagttgaggctttttattagagaagatgatttttgctgtttatatgaagagtgcctatattgtatatttgttttcaaaggggtactagcttttaaggactgtgagtgctccaatctcacctaatggttctcccctgacccatttctccctctgctcctcacagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggtctgttgccttgcttactggagagaatggccatgggagatttaaatagcttctcttgtagcacttactagacatttgagcatgatttacaggattatccaatttttccttttggagtttcacctagcactaatcaaggcaacgtggagcccttgaggtatcctttcattatttttataactaccgtctgagaaactatacttgtaagactgtatgttttcatgtattggaaaaatgtacttttccccatgacaccttcttctccctatccccctaacacatacacattggagacaaacatgtccacatacttatttgacatttactttatatttcttctgccttataattgtccttattactatatgtggtaagaaagctagggagataaggaggcattgggatttgaattaccagtgtaggtggtgatggacgtaggaatagtaactgaaatgtacaggtgattccgttggaagatgacccgttggtttagctaagattacttaacattacattaataccatattacgcttctagaacatttatatgtgtgtgaaaagaaaatggactttttacacaaatttttataacgctagctacaaaatgataatttgttctatattgcaaaattacagttttattaaatattactaaagtgatctgaaaggaactttcaaaaattaggtttttaaacaggccacattcattgatttttctttaaaaaaaatatggtatttgactctaaatgttttcttattaatttacttaaattctactcaatagacatttgttgtataattctgatgtgaaatatcaggtactgacatgccatggggaatgtgaaaattaatgggacatgatcttgctctttaggagcttaaagtttacttagttgggtatatagataggaatggaaataattttagtatggacaattgatttgtgttacctatcataggtataaaatcaaatacaagtaatttcaatctttattatgatcaactctagtgaaataaaatgaaggagtaagaatgtgtttatcacagaaagatgagatcactgttttttattctccagtacttatgttgtacactattgctggggcttttttcctcagtgaaaataatcaaaagcaactttttaagataaaatgggtaagagtggaggtatacctccatgcagtttagcaggtttacattataggatcttaagggaaaaatgttagaggttgagagttgttttcttaccatttcctacttttctgcaaacttggctgggtaactttctctcctccaaaccctctgagcacagacactcctcccattctgactacatttgctctgcatccattaataagataatactgtttcttttgattctcaggggcttatcgccagcacaagctgattcccagttcttagaaaatgcaaagaggctttccatgtatggtgttgacctacatcatgccaaggtactgtaaatgtaacggggagtagcatcatagtagtctgttgactgaggttttgagagggctccagtttcaggatagcacagcttatttttgggaaaaggatatttgctttcaattgagggtctctggaatatttccttggtgactaattatggggtgtttggttgtgggagggaccatgtattctgtctctaccacttgttttcccagtctttttaattaatgccctttcataggtacttactatgacacaccttgtcagccttttttttttcaccgcttatcctggtttattttgcattgcagcttctgctaggccaagtgctgtgtctgtcccagttccctctcccacctctgtcttgggagaggagagaagaccttagcaaccataaaagggcaaaagtagcatgggaccactttccaaaaagcttatgtttgatgaaggagccctagagttggtcttttccctgtaggtgtgttttgtactttgtgaaagataacgtaggtgggcccaggctctgggtgataaagcaccttcagtctaatttgaaagatggtaaaagagtgggacaatggggacatgggaagccagtcataatcctgaacaccgtaatcccaaaagatcaaaatctcaaaaatataatgctcgaaaaaataattttaaaagttatttaaaagacatttatttacgtttttaaggggggatttgagaaacataaaacacaacagaagttcataggccactttacacgataaattaggcagtagtaacatacattttttttgcaagcataaacgttcggtatactaacgagagtcacagggtatgagttatgaatagacaaatcctgttcataaagaaataagtcaaaaagtgaaatgtgtaagcgcacatcgctatagttggttgccagtaacaatatcacttacatcatggttctagtttagatgattatgtagtggggagagtcgaggagaatgacaagcaaggtgaaatatgaatttggttttaaaaaatatgtccagagtcaacatttccttatggtagcctgcttttaaaagaccctgccaatctgtagatgttgtttagaagcccagattatatgatttgagaaatctctaggaaagctccccacacaatgatgtctttcctccctaggcctctgattaataattcttgcatttgtgttattaatcatacttcatatttacaaagcactctttttctcctcagtggcttcctttatttaaatatttttctttattacaaaactaatacatgttcatcatagaaaatagaggcaaacagaaggaaataaagatcacttaaatctttttatgcagaaataagcattcttaataccttttttcttttctttttttttttttagacccctgggcagttgaattcacatgccttctaaaaatggggtcatactatgagcatcatttttgttagttttttttttttaacttactattataagatttttctgtcagtaagtagtctctggcagcatcatttttaaccactagatgctgtatgcccttaattttaaaaagtactttcataccatctcattttttacaagtataccatctcatttaaagtttgaatgttttttaattttacagctacataaaacagtgcagagaatgacttgtttaaagccatgtattgttaaatggtctatctgcctgataccgtctggtaaatcctagtaggaggtgaaacagattgtcttaacactccagtgtttttcagatcattttctatgtaatggggacaggctaggttagccaagaaacagaaatagggaggaaggaaaaaatatgtttgagaccaaaaagagctcccaaacctctcctcctctagaccctgccattcttaccacatgcaaatcttgcatctctactttgttgattgttagttagaaaccaattcttaaatggcaatgctgtatgtaaggtttcaggattcttgtttttaatgttgtctcttagaaaagtaagaaattgtggactctgttctaagtataatactctttcttgctgtgtagttaggagcagaacactaaaaaaattcaagataaccttcattctgtttatcatccgatagactccttaggtaatatttgataagcaagatatttgtggcttattgaaaagaatatatgtggcagtttaaaagaacttttcatatttcatgtcgtttaaagttttgtgtctttatttttcattgccttaaaatcagatttttttttttaattagaagagtttgtaatgtcatattcatgttaggatgagttggagagagttaaataaaaggaatctcaacaaaggtgcagagaaaccataagagaagcgggacacccgtggtagccccaggatagtatctgcagctatcctaatctctctaggtctgtctgaaggagggagggcagagtggtttccaaaactcccaaggagagatatgtgtggagagggccgtcttgtggggagccattgtcagagggacatagtcagcctgaggtgaccacgtagggagggaatctgggtattaaacaccctgacctccctttcctttctctcctgatcctttgcaagaactccctttatactgaactcatttgaaagccagccatctccatgcattgccccatgcattgctccatggagcagtgagcaatgcagagaaggtgctcctttccattagtttatttttctgattttgataccatgtggcataacttacatgtgaaggatcaaggcctgccttttcctctttcacttcctacccttcatctgtcgtttctattcacacaaatactggtaattctaaaataattacatagaacaacaaaaatcaactgatttacttgaatctgcgttgtgtctatttttaagtcagataaaatagcttccttgtcctgtccaaagattgcttcagactagagatggctcattcaatgtttcaaatgcgggttgcctccccacttgtggtaagaacatgccgtctcgggcaatcttctgccttgctcccggtggccatgggcagtgatggttttggcaaacacaccatggggtctggtgccaagttgcttgggcacctgtgcctgattcaccccagctttttagtctattcctagagagagttgtggctgccaagataagggtgagtaaagcaattgattggattttttaaaatggctcaagttggtctaatgtaattttatttgtatatatgaattactcaagtgtcacagcagagaaagcaactggcatcaattagctaatactatacttttatttataaaaaactgatttaaatggtatcaaaatgttctgagtaataagatagacaaaatgtccttttattaaattgggagttagactaaatatggggtttgttgcaacattttttgtgagaatttgtttcgtattgtttgtgatttctgaaaatgtgaatgtctttgagcggtagtcttcaattttacatatgttgaatgagagccagctctcctcttagagataaacaataatttgtatgttttgaatacatgcatcttagatcttcactacttgaaatgtgaggagacaggttttcacttttgcctgtaaatttgtttggtttttaaaacataatttaggcctgtgattattctagattgtcatcgattccagattaaagctctagggaaagaaaactattaataacttcaagaatagtctgcagtcctttgaaacgtgccagccaaaggaatgcctaatgagaactggatgtcagcattctaagttaatgaaaaactgcttgaaagaattcagagatttcagcactgtcagcctggaagagaaattatctgcaagggattggtgttttgcaaaatattggcataattttaagagctattagctagggtaatccatctgaggtaaatgcacctaaaggaaaatggttgaacacatcttagggtaggccaacagactgtccctgaggctggactagcctacgggaaaagctcattttatttcccgtatcttcaggatctctagttctgcttcctttcttctctgttagctcctacagtggagcttgagaacatatgcattacgccttttgaaggacactgtgtcttatggtcatgttgccgtaactcttcggcaaatcacacctgatccctgaagatgaataaatttaacatgtatgtgtgtgcgccatagttttcattaacgtgcgtacttgtcactaaactttaaatacaaacctgttaaactgtcattcctgatcatgatttgagggagctaattagcttcttgatttgtgtaactttcacagctcttaaccatggttaattgggttatgcttggcaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagaggtaagccaagacatttctaatcagttgttgttagtcggcctgtttacgaccatgaatttaaaaattcttttctattaattctaaaattttaagaaaataaactatttattcttccattgtaaaaggtcagggttcttaatggtaaaattgcagtatatatacgtctggtctgtttttaaaaaaagcaaccatcacgctttttacaaaaaagaaaatgtgataaggtgtgggctcgttttttcttgttgaatcaattaagttgtgatcattaggaaagcaataagatgagttttagtgaacattgaaggatagttggtttatgtgagccgttgttacttgctttttgtagaaaatagtattgcagtctatgaaattcatctttatatgattatattagatatgcaatatttaccttttttgagaagaataattgcttctcacagaaacatctgaatgcatgcttttcagtaacttctagtcagttcttaaggaaatatgctgatttgttttacggatttattccagctggaacagtttgagagtaccattggattcaaactgccaaaccaccgggcagcgaaaagactatggaaagtgtgcgtggagcatcatactttctacaggtaattttaggaaaacagctcggaagccgggcatgatcgcacatgcctgtaattccactgactcaggaggcagaggtgggaggatcacttgaccccaggagtttgagaccagcctggggaacatactgagactccatctctctttttttctaagaaagaaagaaaacagcttggtattgcttttagtaacctctgtgaattaggaggtggtagtggtggggaatgtggcagatgcattaacccactgtctttgaactcttttctcccctccttgcctcatctcctttgtctgcagtccctcccaggtccatttctgtccatgcattgtcatttataactgagctgcccctgcagctgtctagagctccactttctgactctaaccacctttccttccaccacagccacactgcctcatgcctgctaccattcttctttccactatccctcctcttaggtttcacttcgatattctcatcagctgcctcctgacttaacttctttcccaaaccaacttgaaccctatggtctgactgctttgtcaggaacgttctgaccccctcaaactactctcctctttgcacatttaccttctctgtctgctagtcctggattagtcctgtgtcctgacctcaccagttttggacctgtgctgtccaagtgctaccttaaaaatagtacaaccattgtgacacatgcagttactctatataacaaaaaatagcacaactctatggattagtgctattacagataaataatttccagcatgagctggatcctcagtgctgctaggcaagcaatttgtcttttgacttcctttgccactccaaatgctcatggtcctcgtgagtccctaggcacccctgcttcctcttctgatgccctccactgtgtgggtcactgaaagaagaagctgtgcatgagtgttcttggtttcatgcaccttcccttcttcccttttgcctttaatgaagcatcgctcctctctcctcccattcattctttcccacttctcctgtctcaaggaggagataatcattcctctgctttgatccctcattttgtgcctcttaaattatcctgctttgtaaattatttgttccctagtgggtacctttaggttctttggccaataaatatgtccacatcttgctctttaaaaaacaacaacaaatatgtatatatggttatataagattttgtatataaaatctttgatcatctaaccatctttagcttgtatcttgtctctttttatacttttcttcaaggacatgttttttacatgtagtttgcttatctttgttttctccgtttcctcagttttctctcactgcagtttagctagctgtgtatctagatccttcatctttaaggtttttgctctggacttatggtctaatactgttctaccaaatacgagctgtgtcaccgtgataccaacctctctgcttcacttccatcatccatatatgatagtaatactagtatctacctcataggattgttttgaaaattaaatgagataacacacatgaaacaacttagaaccatttctggcatatcataaaatttatcttcaccattatcattattcttcgtttggtatcacagtttgctatttttaatgtgaattatcagctggcacacatgattctttcttgacgttaaattgataatatctatttttcaagactaatatgttaatttttgaggagaaatataactcataaaatatgcttgaatccctcaagttacactgatcatataaatctttgaaaactttataatttttcttggtagccataacaaatttctcctccagacaacatgagccagctcatataaagctagtagatgacatttatgacacaggtccaagctgggcagacaacagctttccctgtcacataatgataaaaaaaaaaaaaaaaaaagcaataatctgttcagaaatggcaagtgctagcattcattgaacacttattagagtcagacacagaattgattgctttatatcgtggtctatttctcgccctaggcaagacaactgatgcttagagatcggtgcctgtggaggagcacagcagccaggcatctgagcagagatggggaccgggcttcctgattctgacacctgtattcctcacctctgtgctgtcctcttcttgtattcttgtagcaggagtttccgaggtgcattagctgtgcaaagcctcaggcctcctcatttttgctaatgtaccatggactccagtttaaaagtagaccaatttgctcctgcaaacttttgatataatggttaacaaaagcagttttaaatttttaaaccttgcataacgctgcttacaaagctatataaaagaatatatctaacacaaagggccagtcatactttgtctatagattgctttgaatcaggtcagtggaatttattctgtttcagtttatcatgaaaggtacaaatgatttctttagaaaattacggtggcttgcagattgaagccattaatctgtaaacagatctattaattgatagccaatcagctagattgatactagtggaataagaatgtagtaataaaactgatatggccgggcacagtggctcatgcctgtaatcccagcacattgggaggctgaggcgggtggatcacaaggtcaggagtttgagaccagcctgacctggtgaaactgtgtctctacttaaaaaaatacaaaaattagctgggcatggtggcatgtacctttgtaatcccagctactcaggaggctgaggcaggagaatcactcgaacccgggaggcggaggttgcagtgagccgagattgcaacactgcactctagcctgggtgacagagcgagactccttctcaaaaaattaaataagtaagtaagtaagtaagtaagtaaataaataaataaataaagctgacacccttgcttggagcatttaatagagcctgtcaccattctgagtgttgtacagggattcttttttttttctttattgcagaagatgatttctaaaaaaattgtacagaaagtctagaaatacttgaaatgatagtgttctttaagaaatcactcttccatagtaaatgataggaaaagtttcggtggaattcttcatgtttttgagttgtcaacaaaagtcttcctatttaataaattaagagctctgagattatgtttctgttaagatatttgtcaacttttgatcaaagagagcaaaataatttcagttgaactcccaaaaagattggtccatttgctaaaaacatgcttttgtataagcctagaaatatttgacatcaagaaagtttgatttcattctttatgaacccagggattaagcagtagaattgtgctggcaagaaggggtgttagccatctctacagatccactgtgtggcatgttcttcatgggaaagaatcacttaatggaacagattcctgagttagatgttttcttcccaggagaaataggcataaatattaagaattactaatggtaatggattgttacttggcgcttatagctagaagcaaaaattcagacatgtgtttatataaatgatttaagctaatacaaataaataacctttgatatactgagaacagctgtttctttgcttaggtggagaagaacattattcatgaatacatgaatgtggatttactcatcaccatcataaagctgtgtgtgtaggagggtttataaataatgttctttagaaagtttagtttttgagtaatcatacttaaaatgagatatgaaagtacatagctttaaagtttttttaaaaaattccgtaaagtctaattttgcttcccctttctctctctctttttttttttttttcctcccataggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggaggtaaacacatttatgataattttgattttcattcatctttctctaatcccatgaggtcagaaaatgttaatccagttaataaagccaccagaaataccctacagggatagccattttttcccgagtaaataaaatgctattacttacacctacaagagaataattttgttgtgttttagagttgttactcttttttgaagctgtcacacttttttctttttttttgttttaaaacaggttgaacattccatatctcaaaatctgaaatgctccaaaatcagaaagcctttgagcactgacatatgctctaaggaaatgcttattggagcatttcagatttcatatgttcagatttggggtgttcagctgctaagtatatatattgcatatttcagaatacaaaaaatattagaaatccgcaacacttctggtccctaacatttcagataagggatactcaacctgtattgtcagtgcacacaaatatttgttaagagttctcatttatgagatgttggacacatatgttttactgatttctcttgatcatgatgtgttttatgtggttcaatttcctgaaccttttaattaatggcaaaatgtaattctaaggattttttcgtatggtagcatatgaaccttaatccagacgaacataaaacattccctgcatcagcaaattttcatgagtgaaacaacttaccaaactttccatcttatgagaaagctttagtagcttcaaaggattcattttaaatacagcattttaacaaaaagtaaatataatgtgtttgtttgttctttagcccaagggaaaatatgtataaatgtgaatttttttctattagaattctaattagctacattttgtagttttatataaactacacatgaaataagttttatataaactacacatggaaaaatatatatataaattacctggtccaaaatgggttaataataggttttctataaaagagctaaggttaaatttatattagaatgccttgtgaaggaatattctttctttgtaatagaaaatgattagtatggatgattttctacccaaagaaatagttttccaacatttttggttgattgaactaaaatatatatataataataatactaaatttgaaaattgtattttactactagttattagcagaaacattttttcttgtctattgtatttttctgaaatatatgctcgaacaacttatattttaaataattggagtaaaacagatcaaataatgctaacagatgaaaaagctttcttaatagtgaaggattcatatggattgccttcatctgctttttctagaagaaaaacttggaaaacaaatgcaggtggacacatagagatatttgccaggatttgttggttgggattttggtatatagttattaaatcctgaaatgtgcaagggggtggtgaactgtgctttaaacaaatttccagaattgtggaaatgatttaaattcagttgattgttaatgtactatcactgctaaagtatcttttaggtcttcaacaactgagcacttttccaagtaaatctgaaaaatgtgccaacccatgtaaatatttcccaagccttgccccttgccacagagaatttatacaagtgccgaataaatgcagtcactgttgtttagtaccctgagagaaatgattgctctttctggaacactgtctgttttcagcatttgtttgaaactgtgaggctgtataactcttatattgcaaagtttagcatttaaaaagagcagtaaaacagcattttctttgaggtatacaaactgtgctcaaggaaatccaccatcttgtatgggcagttagtgcagagggttacaggaggtctgtatctgaaaacaatgatttttccaagtgaaaacaacaaacatggcacagtaatccattatttttctctttgtgttttggaggccgtaattcatcagatgggtaagtcatcaaaaggattattgtgttattgtgaaaaataggaggcttttaacgccaatacatgaccagacagccagtgaactctttgattagggcttatattctccgttttttcccccagagcaaagctaggctgtaacctggcactgagcttttattttctttaccactccttatcaacataccatttgttgttgtagtcttcatgtattgtattttctttttcctgtttactttttaagtaaggctagaataatttaggtatattagcctcactttaaagtttggcaaattaaaataaatcctcttatgattacatagcaagtgaaaagtgggattcaatctaaagatcaaatatcaaaatgaaaatcaatctagaacagctgttttaggacagggagtcccctccgagattagaaaatcaaaccccaaagaagacaaatcagtcatttaagagaaccaacaaccaagatgcatttgggggttgaggaaccaagtgatttcctgaaggtggaaagtaaaatgaacagggacgttacttaaataggatcatcagggaaggaaggcctatttgaggaagaaccaggtcagttgagacttgaaggatgagaaggaggcagccaaggaaaggacaagagatatttaataataaagcattccaggtagcagaggcggcaacgatgaagctataaggtgagggagagctggatacattcctggaacagagagaaggcaagtgcagtcagagcttaggaagtggcgggagaggtaagcctgggtcagatcatgcagggccttggaggccatggtgaagaatgtggtttttatttattccatatgctctaggaaaccattgaagggtttatgtgggtttatgtgcccgcaagagcacagcgttatcttttaaaaaaaaaatcatttgatgcaagagaacaattagattgagcaaggaagcaggcaggctggttaggaatggtccaggtgaaagcgatggtggtcttccctttagtgggagtaggccaattagccatttggtatcttgggctctgccagggcctacaagcttctcagatgtttaagacctgaataaatgtatcggcttcaaaatacaagaaactgcatgctgaaattaataagtgtttaaaagtatgcaaagtcagcattttgtcaactttaataacttttaatttgatattcaaattttaatatcattacatttgaagccatttctaggtcagatttttttcattttgcaaaatttctgagtatgtataataggtgtgtagaaatcataattgtaagcaaaagaattaatcatagccatatactttccaagggaaacttatttagatcttgttagaagtttctttattaaaaaaaactgctggaggctgggcacggtggctcacacctctaaccacagcactttaggaggccaaggagggcagatcacaaggtcaggagtttgagaccagcctgaccaacatggtgaaaccccatctctactaaaaatacaaagaattagccaggcgtggtggcgcgtgcctgtaatcccagctactcaggaggctgaggcaggagaatcgcttgaacctaggaaatggaggttgcagtgagccaagattgcaccactgcactccagcctgggtgacagagcgagactgtgtctcaaaaacaaacaacaacaacaacaacaacaaaaaccgctggaaaataactatacttaatgtaaaatgcaaatttattctaatgttgactatgatttgatatgggcattcaaagtgtgagtatttaagggctgggaaaatctccacaaggtgaggtagtagaattagaaatggaaagaactggccacatttagaaatatatacaaggaccttgttggacttgctggtgttgaggggtgaagagtcttggaagatgttcacgttcccagttcaagcaaatgggagcaaatatgagaagagcgttttgtgaaaagggcaagactggaaaagaattaagttttggacagggcaggtgaaggctgtggattgagaggtagcttgggatacatgtattcaaagtgcttgaggcctctcaagttcagtatggtagttcacacacaatcctgccctccaagagcttgcagtctaaaggtgtttgtgttgaccaggcttcccttaggacatggaaccagagtaaacttcatggtgtccgtagagtactttttatgtaaagtgaaatgaccttgtggtagttctgttgtttggggaggagctacagatggacagaggtcctgccacctactactcactttgccttgctgatgtttgaggtagtcttggtttgatctgcactatgacagaattttcaatacaatgtacatttctgcctatctgtaggagagaagaagagagcacatgagggccaggttttctgggatgagggaggtgtctatgtatagatttaccatagttcgtgttaaggcattgaggaaggggattaaaaaataaaaaatattaaacataaatatagaagttaaaatccctaaaatttacctttactgtcttttatttactattttttcttttgaagggtattcaaattaaaggttcctttatggagcaattcttaaaacttattggagcaaatcatcttaataattgcataatcatttgttgcaatagatagattcagaaataaatcgtaggagaccaaagagttaaaatactgcttaccttgtaattctgtttgccttaactctggtgtttcagctggtcttagagctcctcctactggccagttccatgatctgagtttatccttccaatacctgtggtttgagaccctggtgtagctcagtgcattaaaattcagaatactttcagaatttggtaaacgtttaaaaattagtttattttatatggtgggtattttcagagctcaagcaatgtctctgttcctgttcactatttatatgctgcctgtttatctcctgtaagggggaaattttccataaagtttatgattcatatgtcctaaaataatccaaaattgtcactctttactagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaaggtatggtaaattagcacagtatgtggttttaaacatttacttaacctagagggtatctgttgtattttctgtttcagaaatcaagtatttaaaattagttgttctatgttctctgctggtcatttatgttttcaaatatgcatagtggtctctaacctttgattgttgttcaaagcagaatatttcaatgtaagttattttaatgcaagtaagtaatttactggcctttttgactgtcctcataatcaccttatctaattgaatcctcaaagtagaaaagctatgatgatttgaaatttatttttggtttggtccaagtaaaatttaaaatgtagcttcttgattattttaattattgacttgaatttttttacatcaccaaagataatctttatgaacaaatgtattcattaatgatctataattaatgaaattctcaagaaaaggtaattgttttgtgaatagagagtgagaacatggtgtgttgcttttggctttatcttgtgcgtacaccatggtgaaatggagaagtaacccatattgtgttctcaaatgtgtcactgttatcttttgttaccttgggcagtaacatcacttgaatattgatttgagaagcctttgaattcttcagatctcttttctgtgtctgcacaaagcgacttttttttgcatgcaacattggaagtaagcacagataaaaacaaatgaatccatcatattgatttcatagtgttttctattttattttttttattttttcgagatgaagtttcgctcttgttgcccaggctggagtgcaatggctcgatctcagctcactgcagcctctgcctcccaggttcaagtgattctcctgcctcagcctcccaagtagctgggattacaggcgcctgccaccacgtgcccggctaattttgtatttttagagagacggggtttcaccgtgttggtcaggctcatcttgaactcctgacctcaagtgatccacctgcctcagcttcccaaagtgctgggattacaggtatgagccactgagcccggccgtatagtgttttctaaattttaactttgaaaatttttaaaagacataaatgtataaagacatgctagatgaagtagctgccagtgcctcaggaattcctacactgatagcctctgaggcccagcatggagaaggtctcagggaccaccacatgggcccagtcttgtgccacaaggtcaagtgctacctgtatagcaagtgacatcaaatcatcgacattccatcgttaaagaatttgtgactgtcatatggaaaaattatttggtggggaattcagataaaaataacagaaattgtgaccaacaaggtttctttcaattgctgacaagttgtcaggatagttctttaaaaattttgctaacaaggcacccaggagagtgactgcttacatctgaaacagaagagctcagcatttcagaatatctctgttccattttgcctagttaacttgacatatctagttattttccttaaaaaatgaaaaagttcttttaaatttcaaaggaaatcctccttgtctgcggtgaacaactgggtacactggcatttttgctaatgctttgaatgtctgtcagcaaccaggtttaaaagtaaataatgctgtttgagtttcatgggatctatttgcaactagtttgaaaataattaaatgagtcatatgtataaattttatgtgacacaagtagtctagtcttttctctttaaaaatgggtcatttaattcatttctaactacactgtgttaatatggtccctcctttaaagtaaacgttttcactaactactcattttttcttttgtcctctttctctcttgcatctgtttttcctttgattgtatctgttgtgtaatttcatattcaatcatgggtttgcacttgagaatagactgtttccatgtgcccaccttcacctctcatccaccgtacttcatctttttccccaaacctattgcctgtccctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatctttgggctacttctgtctgcttctcagtcagttcctttttctcttgccttttcccttcctctggctctatccctctgctatctggaggctaaagccgcctcctttaatgtttcttatgactgtgacttgaatgacaagctcgaggaagaggaagtagttgctggcatgcctacgtaagctcagtttgtggagtcaacacaatacactttatcttaaacccttcctaatatagagtgtaaatgtgtgcatacatttcaccactgattaccctcaacatagtagtacctgcacattttcacacacacaatattttagtgcatgagaaataagtgtagacacttctccttcattgataccattgaccagttccacacattctaagttaggagcgaaattgtaggattattttacaaatatctagatcaaagtagatttgtaacagaaggtgtgggggaggagggaaggaggagggaacctgtattgcccgtaacaatccatacagggtctctccattttgcaaacagatattaatgctgttcctttaggatgacatctttttgttttgatatagaatttaggatgcagtggacataactgttcctgatgtatattagtagaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctgtggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggttggtaacactggttcaccatttaagttcaaatacagcttctttgcactgatggtagagtttccactaatactccccttctttctggccgtttgctgtgtgacttttcaggcgaagatggaagaagaggaaacgcagctggaagaggtggctgagttttccctaaagttaaacatctcatgactgctgcctgccattagtattgtgtggggagggtccactctcagggtttatttgtgagttgtgtttgttgtggctttaagttcataagatttgtattcctcttttattttaatgtcttagactgtcgaactctgggtcattttggtgcttgctgattgatacacttatgtttatttgccttttcccccctgtgtgtgatttaatttcacagaaaaattccttgagagtagaaggggataatatttatgtcagacatagcaatttaatgttggaggtttgtataatctaagaaaacaactctgtcctaatggctgcccggctgctgtggacgggaggtcacgcctaggctggctggcaatgttcttcaagcacggtgcatgcagtgcatgggggaattcagctcgggagtgcatgttaccagcctgacggtgttcctttcaagtggcttaggcaggactgtatctactagaagttctcaaagtgacaagtgggaaaaaaaagtttagtcaaatgaatcaagtttttatccagtactcttgaagttgttctacaagtaaacctattctctcctaaagggttaactctagggcatcaacctgaggtaacacaatctcatccttaatatgtattaactagaacagagatttgtttattgatctggcattaaatcatgtgactcttgatcttgatctgtgcccactttttttgtttttttggttaaaatccatgattgggaatgtggtccactttcagtattctgtttgagaatatgctaattaaagaaattattttaattagaaagaacaagcaaaagtgagagagaaggaaaggagaaaaagaaagcccaatcacccaattatgaatgtaaagtgtaaaatatgttccccgtgtcacgtgagaacatttttttttcccttcttattttacagtagtatgtggcaatgtattcaatggagaactgcagctctcagtaatctgactaatctgtttggttgcttttggcagcttggtaactgatggaaatgtatttttgcttaacttactaaaatgctgtacagtgtaataagtaacattgctttgaaccaatgcaagaaatgtgcctgatctcaagccacagtcatttttccatgccatgcaaagatttttagattttcatgagtttttgcaaatggctatagaagctcatagatgagctactatgcttgtgcatgaatatggaatatctaattttattggttgcatgacctgttccttaaagtgggatgaaagctataatccacaggtggccctatgatttttgaaatataaataaatatttaaaatttggttaaaacaaatactatttatgagagccagtcgaaaaaaattccacaaataccatttatcagggcctgctcccatgaaaatggacctggtagtttttcttgtatatttgtctgtataaggacgatctggcagttgcggaggctagaccccacttttgtgcttggcaagtacatgagaccagtctgtggtttatttattctataaagaggctaaacagaagcagcctctggaagcagtaatttttattccttaagaattaaaagccatcactggaatttcctgaaaacaaacaaacaaacaaaaaaccttggcttttccagctgggggttgatcctggtctggctttttcttccagccagtgtgcttctgagtctctaccttcctctattttgtacttgatttcctatattcacagaatgcaattttaggagtagtcctaatcagaaaggtaaatttgctggaacaaagtcatagtctgagtttcaaatccaggtactggaaggaagtgttattagccattttgatgatcagttccatgtcatctttctgataatgtaaataattattcctttaaaaatcctaaatagagaagaaatcagaaccctttaaaatgtaaatcattgaagaagtacgcattgactttattttcaaattttgatgaattcatgaacttactcatagataataatatggctttagagacttggcatttttcttgctttactatggttttttttttaatcgtaagtttgctttgtcttattttttggttttatttttgtcctactgggttttttccttttggatttttcccccctttgttacgttacatattgctaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaaggggtatgtcattagctatttgttggctctgtctcacttcagttgctcaataaaacttaaattgttaatctctatgttgagtctagggaagttacaaaatgttcccatttaattatttttatgtaattactaacaattttgtaaatactaaatattaacaatgtaatagttattggcctagttcttaggtaaattgcatgagtttcaaaatacttttgaaatagttttaggataatttcactattttactcaggtaaattgtagtaatgaattgttatataggacaatttagaaactaacatactgtatttaataagctttttagttactgatatctgaaatagggacatttacttagtataaataattaataaataaagaaatataggctatctttagagtggtttaaagttattactgtgaggaaaatgagtttaacttagctttaaagaccgatgagccctgttgaaagcttgaaaaatattatatataatatgacttagtattgaaacttccttataatgaaatgttagaattgtgttttaaaaacgttttttcaatcataacatttctcctcacttactctatttcttttcatggtttacttctccccaccactgatatgagtacatattgccttcaggatatattctcaatacatttctccattcattgtcatccacatctgtgcctctaggattcttccaaatccctcctgttattgaccaagaacttccatgggctcgtttatcatacttgagcggacagtgatcatactatatttaatctgtagtttaaaaaatggtataaagatgttaccctacaatttcatctttttcctttcagcatctagtctggcttgaatgttgccaaattgtagacattgatttagatattctagtgctatttttattcacctttccttaaaaagaaaagctgttagttgctttaaatttctaagtttgtgccattgaaaaagaaagctctttaagaacagatgagcaaaaagaattgctgaactgaaacacagaacttttgaaaatattaagacatgcttggtagagtcttatgaagttgaatacaacttcagttcttagtttcagatttttctgaagatgataaaaaatgtcaatttcagcagtctattccagaatgttgtgttttctggagaaagggtctgatgccatgccaaggttttcaccttccattatgtgccacttctcctggtgtgtgtcattgacccacactgggtcagtattttgtgtttgtgttgctataggtgtaatgtatgtgtcttatttgttgattatgtctattgtttaaaacaatagagaaaaggagaccatcttttcaaggatattttatccgtgaaggagaagtacctgatgccgacaatatggacagttgaagaaaaagctcaggagacggacaaggtgttcaccttgcacccttggatctactcttgctttttccccctttccttttgtttctatccacagccataagatttcttttttcctgtgtgtcatactaaaatttttttgaaatgatttttgagcatttaaaaagttaaatcccctgtgtatagaagcataggattgttggatgagaaataccatattgcagaagcacttgaaaagtcaaaatttgaaatacagaaacatcaaccaatttaggtgataactgattcctaatttgatgtatgtggctgacagttgggaaactgatttcatgtgaaagtgcactgtttgtacaatacttatgcatgtcgtgttgttaaaataaccacttatgtgccttagatgatgagtttactaattacatatggaaaccttttgagttttcacttgtaagatttttaatgggaacaaagattttgatgcaccatagcagcccctcacctctctctctgctcctgcatgtgtgacatttctgacactggtgaggaagttcactttccattgcttttacatcctcattcttctctttctactgattttacttagccaggtggtcagtctgttatttgctgggactggagagcttggagtctagtggaggagacatggaaatagttaattagaaaagtttcttttttttctttcttcttttttttttttttgagatgcactcttgcacattcgcccgggctggagtgcaatggcatgatcttggctcactgcaacctccatctcctgggttcaagcaactttcctgtttagctgggattacaggtgcctgctaccaagtctggctaatttttttgtgtttttagttgagacggggtttcactatgttgaccagactggtcttgactcctgaccacgtgatttgcccttcttggtctcccaaagtgctaggattacaggcgtgagccaccacacccggctggtgattagaaaattttctaattggtacttggaaagtttcagacactaggaagtaaatgttaagaaggtgaaatacaatgttgtgttaggaggggattaggaagaccgttttgtcattgtggtcaggaggagatgacatttgagttgaaaccttaatgataaccaggtggacatgtgaaaatgtatccacgtgtaaggacgagccacaacacaggaactgaaagaccaaatgacaggggcttggtgagcaagggggagcacgaaggaaggaaaattcaaagaggttagaccctaggtcatgtcacgatcttaaaggccatgctaacagtttggaattgtacaataagaatgatgggaaagcattggagagtttgaaggtgagtagtggcagaatcccacctgtttctgacagaagtccccctggcactggatgaggaatagattataggggctgtgaatgagaacagagattattaataaggaaacagtgattcccttccacaaagtagattctgttaattggtagagagtattcatcagaacacgtagcagggttgggaaaggaggcaaaataagtagaaataaggagtttatggtctagttgagatgaaatattttcagaacattgcaaatgagaaagataatgtcatgaagctaaaccaagtgacatatttatatactttaaaggttagcctgaaaccaaagccaattagactccatgtgtataatgaggactttaatatcacatgctttgaaatattacgtatttttcataacctgtccttcagaagcaatcacatggtatcattcgatcaaatttaaagtgatgtccttggatttttgcagtaggaaactttgacattttagtggagatgtttaaaattattatcatttttctggatctcatgttttaggaatgtacagtgtaaaatatcttgtcatagaagtcacattaaagtgatgttaatgtgaaatttaaatctggaaaagcccccaagtggtttatctgtacttgaagttacttgtttttctgttcttttcctctccaatacatgcaggaaaatacatacttttttgacattcatatagattgttcttattacaatcatccattcatccgtttgcccaacaaacatttattgaccacctacattgtatcttttttgtttttctttaaataacatactactattagttgaaagtatgtgagcatttgtctacgggagtgttttgactttaccagagtaccttttcaatttctgtctttgttgtatcttcattttactgttaattctgcaggggttctcgtttatctttgaattgtaattcttattgaaagtaaaataaaaaaattatgcataagtatataatttgaccacttttccaaatttctataatatgggcttttatagctttttaaaaaagcaggaatagtttctttttaaaaaaaaaaaatacattgcattttcaaagtggctgtagtttgaacaattttgagagtagagcagaaaattggaaaccaagtcatttaatctttaatgggtaaataactctattgtaatcctcttaacgtgttgtatgaattatgatgacttaaatttgcatagactattctctcctgagtctaagagattatgtacattgagttgtaaggtacttttgaaggtatgtcattggataacgaaatgtgtggcacttctttaaattccccagtgatctctcactgggaagggcatcccacccacccccacttccccaagggacgatgtaatcatagagatggtaatgaagttaagtcagtccaaaagctttttcctctgctgaatattgcaagtgcctactcccctcaccctcctcacctcactttctgcgctcctcacccttcttagctcacagtatgaaggggccccttaggagcgtcattgatttttctttaagatttctgaatagtgactgggtgcggtggctcacgcctgtattcccagcactttgggaggccgaggaggatagatcacctgaagtcaggagttagagaccagcctggccaacatggcaaaaccccgtctctactaaaaatataaaaattagctgggcatggtgctgcacgcctataatcccagctactggggaggctgaggcaggaaaatcacttaaacctgggaggtagaggttgcagtgagccgagatcgcggcacactgcactccagcctgagtgacagagcgagactccgtctcaaaaaaaaaaaaaaacctgaatagtggggtttattaggaattattctcacacttctgacatgagggggtgcttcatgatgactcttgaatattgacatttcaagtttctaaggacagttctgctgtccctcaggcaggttaggagccattgtttaagagccagacacagcaaagttaaatttgctttaatggtttaatttagggagaaataattttcacgttgctcattgagctttcaactctgagtttgtcttcctattttgaattgtttttctttacctgtttctttttgcaaaaaaaggggacagggtaatttactctgtggcatatttagcacgcctgagggaatgaatgtgggctgctgtcagaatgtttgttgtacagagagttaaggtggtattgaggagggagattgtaggagttggagtggtgagggaaggccttacagaaaatgcagactatgaagtgggcctcagggaggttagaaaactggaaaggcccagaatgtgcagataagggcaaagaagggccttggaggcaggagagggaggactgcccaagctgtaacacaggaataagcatttcaagtgtaggggccactgaagaggccattccgtgcagagaaaggccaaggaactacctcaagaatatatgaaatggcgtttgggtgggtcgattgtgctcagttggtgatcagccaagcagttttcactggtttctggaggtcgcaactatcaaagattctcaagcagggtggaaaagctggcgctcacaaacctcttcataagcctgctccagaatctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtcaaagaaaaaaaaaatctgcctaaattcagagaataatttaaatcattaagttccagagtctgggctgttaagcagagggaaaccctcaaccagatatgctttgcagagttgacattttcaaaaccccaaatttcaggcatcctctgatggcatgttatttttaaaattctgtttatatggaaaaaatctgaagtgcctcccatgctccatgaaataattgcttttgaatgaccctaaggaattccctgaacttgggcagaacctatccagctaattgaggttaagatataacaataataataattcactgatctataataataatgaaatgtgtgtttcagaaatgttctggtcactggatatgtttattatatgtagtcatggttaaattttacctgcttatcaaaatagattgagagttttttcagtttaatatctagaaacctctgagttttcaataaaactggaaagatagctgtcttctgttagtaatgtgatttacatggtattaatttgggtcaatgaaaccatgcccttaccatgtgtttaagaataatagggcaggtccaagagagtttgtgagtagacgttgacagtgctgcagagacgtgtgtgtgtgatgttaggatcttcagctcatggttgtccaagtgtctgggagagatgaactcagccctgctgtctattagaggctccagtccagttagtaccttggcagcttcacaacaatatccagagggctcagtggtgtggtgcccttctccatccagaatggagtcactttcgtgaataaatagggctcctggctctagctgaattatttttaagttagatcataggcagtagtaccacctagaagtcaaaaagttggccatgcttgagttatatcattgtaaagcagactttttgtaagtgtgagaaaaatgtgaagctttaaaaacccctctgtacaaaaaggtttccaccctagttaataatatcataacatagtaatttgttcctaatgtattaagtcaacagatatttattgaacatttaggtgctatattactcaactggagtaaattactttactcccaagaagtagatgtctgaaggggataggagtgaacatgtcaaataataaacttgactgagtttagatttcaaagatgctagtagaggagctaaattgtaaaaggaaacacttggagtcaccattgacacccaccctattgtataatatagcctttgccaacctatgatacgaattggaaagttaataaccatttctggaatgaacattttcatgttaatagccttctgaggctaactataattttgccaattaaaactttttttttttttttaaagaaaaccagcaaaaaataaaagtgccatctccttggtgctgtgttcatttaagaatcagcgttccaggctagactttatagtctgattaaaaccaaaactgttactaggttttaaaagttaaatttttttctttaaaatgatgagtcagctttggtataattcaatttttgtaaactgttttaactacataggtagagcttataggtatatctataataaaagcattttacttctttgggaggatgctggctgtttttgtgtctttttgtaagctttttggcatttgtcttgattgtcctctatgtgaccttgagcagaggtttctgtagatgttgattcttgctgttttgtctttgcagtgtcagatgtttgtttcagtggttgttgaggtaaaactgtattgattttgtgtcctcggttgctttttgttctgcagacacgtgctcccgagtcagaagggccttgcactggagccagggatgctgttaaggttctcccctttttccatgttaacaccattgcctcacgtttctcattgccctcacgtttgccccgcttccctttcagtcagccatcataatcatctttgtttttctccatgacatgaatctgccatcggttaatttgggtttccgttgtttttatttattcatatatttttgttttccctcatccatctttttttgtacagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagaggtaaatgggagtcccaggtgggagccaaactctagagctgcttctcagatggggaactcctgcctttcttctcctgtcctcccagttcttcagcttttttcaacaagaatctgatttttctctctcatgggaggaagggggaagcactgctttgtggattttctgcccgcccagttcatgggttccagcttctctgcggccactggacacctgtagggtaaactttcctagaagcaccacatcaatttttccttcccttttcacatttaaatttttctttgcatgttttgggtgttttcaactgttttgtcttcagttgcactgcttcctcacactaaatgcctttttttccccttttggtttaattagaaaaatgtatatgtaatgttgaaaaaaaaaatggtcactgctgagtgtgtgtgcccctgatgtcatgattgggtttgacttcttggctcattcttcagcttcagagttttagaaatgacagcagtctctgattaccgtggttctctgaatgcagtatccagcagtgatgagaatgttatttcttgaatgccactgtgatttctgttttgggattgcaggggttgtatggttttgttaagagcctttcttttcttccaggcagccagaggctaggctatttgataggaggatatcctcgcttctcattctatcctgatgtcaattctggagtatttgccagatgattatatgttttgtggattatctatacattggacatgaatctttttcttttcaaagaagagaactttttggtcactaagtgcagtgtctctcatttgggagttaggctgagggagggtttatttccttgggaatatttcttgattttaatattaaatgcccacagtacagagatttattttgttctcttcgatgggatggaaaatgttgaagtgactttgtcttaaaataattaagtggattttaaccatgttacttttaaacttctgtttcactttagagaagatttttcaagagtctttgaacactttgaactattctgtatttaacatatcgttactcctctttaaataattatgcctgttgagaatgttctctcaaagaaagtactgcagtattttggtagtagtatagtctggtgttgcattaatattaagcatgcatactcggcagactaaaatgttaataagccgttgaatatttcctttaatgttttaaattgttcaaagcattggtgtaacattgatggagtaattttagatagagcattttaacttaggtaatacagaagaaacactgcaaattttagacaggtataactgaaaacagtaatacttgaagacatcctttctgaaaatggtgtgtctgttaacaataaggcagaaaaggtattgtgggcagaagaacaaatcttagcctacctagctggcatgccagttaaaggcagtgagccttcacacaaactatgtggtcctttaaattataataaaaatagagacaagtcacttcacatagttcattctattttcttttcaatttattattacttgcccaaagctaaggagggaggaggagagagagagagagagaggtgtgtgtgtgtgtgtgtgtgtgtgtgtgtcactatacactaggcttgacataaaagtagtttgggaccatcttaatttaaagagtaacataatttaggaagccatcatgtcaacttatttttcatatatgtgtatgtacacatacacacattcatatatatgtacgtatctatgtgcacatgtatgtatgtgtatatatgatatatttgaaggaaaatttttcttttatttcttttgtttgttttaggttgtttgcttttactcttttcttttgtgcatgagtgtgtgtttggatatgtttcttactattatttgtgaaggttccattaaacacttttactttattacctctagaatttatttttcccttccttttccacctcagccaccagtggtaaaaacagagatggtaacaatttctgatgcctcacaaaggacagaaatctccaccaaggaagtccccattgtccaaactgagaccaaaaccatcacatatgagtctccacaggtacaaaagctctagacttggactgttcgagctcttttttcccttagtgtatctatgttttcattctttcttctcttagtttacatgtttctggctttgatgtagctttttgtatctgcactttgtaagtgtacttcaacaacataatttgctatgttctcttagattgagacagagagctgcaattaaattggtaacccagtaattataggggaactgtacatatgattatttaggacagacagtatcaatcttgttcatatgattgaaagccatttctgagttgacatatctaagaatgtttgtgtacacttaggaaacaaattgtcttgcaaagtttatctgatataattcatcgattaataataatccgatctaattgtggatgtgatttaggcttctttccctctctaactccgtgaagattgacccaatcaactcattcttgcttgtaataacacacatacacacacacacacacacaaacacacacaggcacacacacctgtgcttctccttcgtgtggaattattttctaaagacctatgtagtcattcatatgtgaatggtgataccatgtgtctaaataattatcagatttgtgtgtttgattttaggttttcacacattggttctgtaaagatttggaataagcattaagatgtttaaccttaagaataacaaaaaaagataaagcattcatgatttcaaaatagaatataaaataaatattttctccacttagaagatgaaccttctgtggtagaattgtatcatggtggaggatgtcaggttattgacctctcagaatattttttaaaaggtttaatgcatgcatgtgtgaaacacatctgaaaattattttggatatggcatccttgtgtgtgccttgatcccacataagcacaaataggtttcttatgaacagcttggcgggggagcattagtgatgtgtctgtgctgtgataagttgccagaatgaagacatacaggtgcatgacccaagtttgaaagagatttcctcttacagtcagaaaggctctggaccgtccagttatttcctcgtgtcagtgtcaggaaacagagggcaaatatgtttcgtgatcttaacataaactgttaggctattaatttgcttcattgattccccttggaaactctagaatcttctgcatctttcaatatcaaagcaaacaagttaaaatctattttaacatatgtatgggatttatatatatgtaggagcacatgcgtatgtgcagtattgaaatatatgtgcccgtatatatgctcacaacatgcaaactattacaggaacaatgtagttgatgaaaacaatcgctagaggtaagcagataaccaaatcatgcagattcagtttgtcctggtcaggttctgttgcttggtaatttgataaaatgtttatctatttttacccacctgtgcttaaaaaacaacaaactcagcgcttctggtcactgtggaaacttctctgcctggctctctagtttcattttctagcttgtgcaaaagtccttcagacaaattctgtcataattcccttgtagctttcagtcccacctactatgtccattctcctctcttttctccactcacacagttgagtttgcttctccatgtgcacctagccttttgcctctactcggtttcaaataccagccgctctcctggatggtaattactactgcaaacacgcaaaccacatggattttaaaagatgcatattcgatggggcggggatcttctctgacaacataacagaagttaagcattactttgtatttttcccccaactatccaaagattgatggcggggctggtggtgattcgggcacgttactgaccgcacaaaccatcacatctgagtccgtgtcaacaacgacaaccacacacatcaccaaggtaaagcaatgcaggggatcatatggagaggatggtacattacagacagaatcttttctgaattgtttctctcttcctgtacacacttccaagtaagatacagacagtgccagcggaatcaaaatgccttggtttaaagtatccaagaaattaggctccattgacaaatgcattcaagccaaattgcaattttgtgaagtacaagggggtaaaaatatgttacgaatagctatatgtaagatagctacaaaaccataaataatttaataaaatttataatttataaaaacaaacttgtgcttctacttttattaaaccagccctcctgactaaagcgaatgaatgaaggccatcattcagaattttcagcaagttgttcaaataatgtagaatttccctcatttaagatcgctagtatactgatttggggcattcccctgttcctccctgcataattctctaaatgtttagcactgggtaaccagtcatccctggatcagcagcatcagcttcacccggggcattgttagaagtataaatagcgtggccccactccagtcctcctgaaaccttagaattgtcttaagaagcttccagtgattctgatgcatgctgaagtcatcagctttctaactccagccttattttccactatttccttcttctgttttttactttggataagtgtctaaaggtcttaaaggtgtcccttgtgcccttcccaacccatgtttcaacaacaatttaaaaaacagcaaaagtaatttgtaaatttaaaaatgccgcataaatgcaaggtactgttggtgctcattttaaagcatatccagttattaagcatagtgataagcctggtttgttatggtaaaatgctgtcacttgtgactgagagtgtacatttatcagagttgtaaatgttggatgtgcgctttcccaggaccgtgtggtatttgcttattgactgtttagaaggtcacagccagatgatctcctcagcctcatccagtgtgccccaggcactcgcagcttgtacggagcccataacgctgtgaggcagttcccccaggagctccctcctccagccccgctcgcagcctttgtctagccatgcgccatgtctacgtgtatgactacttacgcagggtgtcatcaaatcaaacattcaacaaaaatctcatccatcttccgtatctgaaaccaaagcaaatcctttttaaaattattgcactaaatgcaataaacaaaatcagcaaataaatttgtatgctcagaatccatcagtcaaaaccatcacatcatacagaagtcttctgtgatgggaaaaaaatatatatcacatcaaacagtttctcaaaccaaaaacagatacctaaattcttataatttcttgtaattctgcaagtaactgatttctccctactctcctttttaaaaattggccagctaggagtaaagaaactcgggaaactataacagaattcccttaaaggaactacttggattaaataatatctgtcctatcttaatcaagtgagattaagatgggacagatgccatcttgaatattgataaatgagttttaaggttgctctcagctgagggatacttgtggatgctataactttagtaataggattctctattgagcctaaaaataaagcacaaagtgtttctagaatatcagtcttttgctgcttgttgtgtgtggccttacaatgatccacaggtctaggtggactcccatctctgtttgctctgactgtgtaaacgtgcttcagtgattgctgttttttcttcttctcctttatgacctttagactgtaaaaggtggaatttctgaaacaagaattgagaaacgcattgtgatcacaggagatggagatattgatcatgaccaggtaaataagttaagttctagttttggaaatggccctgtttgttttctaagtttcacatttgtcatcatgtcgcatacctgtgtaaacctcttctccccaaacctcctggatgaagtccacctcctaagcaggacataaagacacagcctggatacaagctttcctacctctgaatcagaataaaacacagatttctctttatttcccactggctttacatgcacttttgggtcaacgtaatctggaggatttctggaaaacataagattcgtgtgggcctggtttaaaggcaagtgatcaaatatttaaaaatgaatggcagttcaatgcaccagtttccaaaaaatgaagaaagccactaagcttgacctatgcctacttttaggaacttttcaagtatatttatggcattagaaaagttgagctatttacttccaggtgttttctcctattgcgattattgggggaggggaggtaatacaaggtttcttacaaagtgaaaatttacattgattctgaaaattttttaaaagaatcatgcctccattctaatgttaaatttggcagcatgcatggctttgagcaggtgatgaatggaactgctggagactttgagagcagttttaattttagactgcagtcccaagtgatgctgacaatttttttaaaagtgattttaactcagctttaaaggagaccaagctgttttccttttataacaacttgaagaaaaggaaaagaaatattcaattgactatctcagctggggagtaggagctaacgatagttacacagctttggacacaatactgagctcaggaaagaaaattttagagaacaaaattcctcatttgagaaaggcagcctatatgtgatcagagataaatggatttttcatgcctaagaagaaaattactcccaatttttttgacctttgtaagtatgatttgacttacatattcgtaatgtacttttaaaattttcttaagagttattagaggttaaaaggttgccttgactctggattttgacataggacataggactggagattcctagagaacattagtacacttgtctgcttaccatgggaaaatgagtgacttatgtggaaacaagcctccagttttccagaggggatttattctactatccactggaacagtcttgagtttcgcctgagaaattggagtaaacctgcttctttctctctgggactcttctcaataagcactcattgaattcctagaatatgtgaggcacaagctcacattttttggcatggtggaaagtgcaaactagggtcttctcccagccattgtttcttccacccccctctccccattgaacctaggccctttacacactttaaaatgccacctttccagtactcaggttttacttatgtgtattgttttgccttttataacaaaagccaaaataattttgttataaaaggcaaaagaatattttggcctgttttaccccaaaattcaaatctagatagtactgcttctgaaaggcaaatattaaaaacacaatctgaaatacaagtgccaaaataacatatacacctgactcttaaaaaatcatgatgacccagcagccttaactgctgctgttgcaaggacagtaatctccttttttgtatatgatgtcatgtttcagccctttctaaaactgaggtcagatatccaaatgaagagaacagagattttgcctttttatgtttgtgagatagcataaactttttttttttttttggggagatggagtctccctctggtgcccagactggagtgcagtggcacaatctggactcactgcaacctctgcctcctgggttcaagtgattctcctgcctcagcctcctgagtagctgggattataggcacccgccaccacgcccggctagtttttgtgtttttagtagagatggggtttcactgtgttggccaggctggtctcgaactcctgacctcaggttatccacactcctcggcatcccaaagtgctgggattacagtcgtgagctaccacacctggccaacatttttgagtaaatgtgattgtggcttttggtctgcttgtcaccagaagctgttgggggttcactttctcctttaagcctgtaatgagatgacagagctactttaaattaaatgatgaaatcgctttgctgtcaaaatccgatgttgatcatagagtgaccttcataacattgacatctttttcagttccttgcctacgttaaaaggaatcttcaggctgggggcggtggctcacgcctgtaatctcagcactttgggaggccgaggtgggcagatcacgaggtcaggagatggagaccatcctggctaacacagcgaaaccctgtctctactaaaaatacaaaaaattagccgggtgtagtggcgggcacctgtagttgcagctacttgggaggctgaggcaggagaatggtgtgaacctgggaggcagagcttacagtgagcggagatggcgccactgcactccagcctgggcgacagagcaagattccatctcaaaattaaaaaaattaaaaataaaaaaggcatcttaaaatggaaggacactttcactgggccagacagaaaacaagaaatcttttttgtgttggcaaatcaaagaggcatgcttttacagaaacttgctttgcagattcttcaccctgtgctggtcatgatactttcagctccataccaaggagaggtaaaatacactgcagtgtctcttcagagtgtatttctttctaagaaataattgctcaatttggcagtaagagccgggcgcggtggctcaagcctgtaatcccagcactttgggaggccgaggcgggcagatcatgaggtcaggagatcgagaccatcctggctaacacgatgaaaccccgtctctactaaaaatagaaaaaaaattagccgggcgcagtggcaggcgcctgtagtcgcagctattcgggaggctgaggcaggagaatggtgtgaacccgggaggcggagcttgcagtgagccgagatcgcgccactgcactccagcctgggcgacagagcgagactccgtctcaaaaaaataaaaataaaaataaaaataaaatttggcagtaagatgtgatgttttctcataatccttattattgccataataaattaacattttacagtatttaattttgcatgctgatattatggaatgaaaggagttttaacaaactgattttgaatgtgtttcaagatgactgtagcagtttttgcttttcccaatctttctgtgaattagagtgtatttcatatgtgttgccttcccttgggcatcatctacattttctcttgaacagttgccctgctttattgtaggcagatctttgtagatcagatactcaaagtatttgatcatttgtctgtagctacgtttggctcccatcagagcttgtccttgtctttgacttttcccagtgtggactgcacaaaccaacatgtagtaaatggcttggatcattccaatctccttccctctgaagacacacacaaacacaatgtagaactgcacccctgtgcctcctctccctttcctattcccattccagtcaacacgttgaaaagcttctctgcccttccctggaaccagatacctgctcccactcctgctccacgctagccctccagccattcactctcccgccttgacaaacacttctgctactgcccagattggagtctggttccatgttttatttctctattgtcccaacacaggtcactcacaagagtttgttccctggtggaaatttaagcaccctcaaatgtcttccaagtttctgtgcaaaaaattttctgtatgaaaatgatgtcttttttttttttttggtagctttacctttttttaaacgaaacgaggcttagggtttctgtttagtatccttacagctgacagaaactatcatgcaaacaagaaatgcagttgtccccttaggcagctgacagcaaaagaaaaaattgcatggctttatttcaaatgcagtttccttatgagatatggtattctctgtcctagtaaaattttctctttgttttagcattctttcctagacttttttttttttttttgagacaaagtctcactctgttgcccaggctggagtgcagtggtgcagtcttggctcactgcagcctccacttcccggttcaggcaattctcctgcctcagccacctaagtagctgggattacaggcgtgcgccagccaagcctggtgtttttagtagagactgggtttcaccatgttggccaggctggtttcgaactcctgtcctcaagtgatcgcccgcgttggcgtcccaaagtgctgggattacaggcctgagccaccacgcctggcctttagaattctttcctagacttcaagggttctctgatgttttgttttctcacccatactttaaaaacaaaatgagtaataattaggaaagctattttcctcctctgaaaaataggatctttccattgtgccacaacactcttacagtttactttctgataaaacacagagaaactttgctttcttaccacgtggtccaaggaaggaccataaaccactggagtcagccctctgggtcctccctgctcctatcctgctgctcacaggctggatggccttgagaaagacccattaatctttgtgcctgcagttttgtcaactgtcaaatagggacctgtattttataacctgaagattagtcagtctctgttctttagctttactaattgtatgttgttgctactgctctttagttctgtgtcttagaggtttatagacatctttcctgcagtcttttagttcagcaaacattttagttcaaacaattactgagagcctaagaagataaagatgagcaaggcctggtcctctgccttgcagtttcaggcaattgggtgacagctagtatcacctgaatgtctagatcaggcactgtgctggctgctttacagcattactttagttcacacagaaaaccttaaaatgatcgttacaactctgcattagtctcaggttacaggtaagaatgctaagctccaaagaactgttttctccaaatctcacagtgagtataataagcctgggattcaaagccaacatgtttcctctacgtgtcattatttgaaagtggactgaagaattgggagatttaggaaatgagaagcagtctgtaaaatgacagtgaacccatttcaaatcttcctgctttctcaaatacagaagtgagtgcctcttggcttgaggttgggtccgaggtgatcagtgtgtgtgtgttttgccattgtgaggtggaggctgttccccagctcacagccgttctctgtcctgaccctggcaggcactggctcaggcgatcagggaagccagagagcagcaccctgacatgtcggtcacaagagtggtggtacacaaagaaacagagttggctgaggaaggggaagattaagtaaggtaagagagccctcattgtctgtggcctttctagtgactgctctgtactcctgaacttgtgaaaggatgtgaaatgaaagttcatatcagtgtcttcttcctatagtacatttgactttctagactgttatcatccccaggtgcatctgctcgggtgtatataatctctgtgaactgatggtcatgtggtgtcaataactctgatttattgaggggctgctaatgattgacattcatatattgctttactgtttatcaagcacattactgtaagttacattaattaatattcacattgaccctttctggaagatgctattaaccttctttggatgagagatttttattgtaggagagataagagggagatgagctgattccacctatctctactaaaaacacaaaaatgagatgggcatgttggtgcacgcctgtaatcccatacttgggagcctgaggcaggagaatcatttcaacctgggaggcggaggttgcagtgagccaacattgcgccactgaactctatcctgggcaacagaagtgagactccatctcaaaaaaaaaaaaaaaaaaaaaaaagatacatctgagaatgaaccagaaaggaaaagatttctttgactgtgtaaaaatggaaataaatacttcagttaagccaatagaaacaaaagcaaaggattaataaatgattaagtttaatgtgcttggcagagaaaggaatagtatcctgagtatattaagaactctactgtgtcattaagaaaatttaaacacttttgtagaaaaatgggcagagaattaaatgagtaaactatgtgcaaactaaaagatcaataaacaaaaaatgtgcagcctcactattacttaaatcaatgcatactaaaaactcagtggacaagttttcacctataaatttggcaaaacttatgtttttaatagtgttgggaaggctgcaggaaatatatactgctgtataaattagtaatattttatggaggacaatttgacacaaatatatctaaaaaatatccacattaaacatgtctaccattaaactacttataagaatttatcttaatcagaaatatatacaaatattcacctacaagggtatttgtcacattttaatatttatatttgtataaatttatatttgctagtattagtaacaggcaaaagatttacacaccctgaagagaaaccagagtattatatttgctagtattagccaaaaaaaaaattgaaataatctaaatggtcaagagtaggggattagttaacacattatgctgtttccatgtgataactaaatcttgatgaagtgggtaaatgtttataattatctattagggctttaagaagcaggtcttatcacacaataacacatactaagattactttctgttgttaaaataatctgtatgttgaacagtcaatagataggtaacccacaggaatggctgggtcacaggttacacattttcattttctaccttgcgtggcacagccacctgctgttgcatccactaggaggcaaggattcctaccattttacagctgcctctctgactttttaatttttgctagtttggtaaatatgtgtaactgtgattataattctcactttcttcattaatatattttcatatggttattagccattcttgttttctcttctatgaaaatacagatggccaaaaacttcaaaaccttaaatgcttgttcacctctcttgcctgcttttgctttcattctttctttcattgttaattgattcttgatagattctacatactgatcctttgtcaattttatatgttgcaaatatcttcaggcttgtggtttgtctttcattattaaaatagttgaatagggttaatattgttgaatttatcaagcttttcctttatgacttatgttttttccatacccctaggtgataaagatattttttatgtagaaatttaacattgtttttcatatattcttaatccatctgaaatcattttttctaaatgatgagaaagtttcctacataagtagccagcattccagcactgtattgaagagcccttctttcccccatctcatctgcagcatcctatatcaagtttcttatgtgtgggggtgtttctgacactatttctattggtccatgcgtctatccctgctccagtgccagaattactataactttataatgggtcttgatacatggtatgcatgtctctatccccctgcaccccctccccccaccaccgatagtgttctttttcttcattcttggctcttcctgttacatacaaattttagaatcagattgctgtgttctaagattaaatcctgcagtacttcagttggcattgtatctactctgtagttcaatatggggagaattacatctttttaatattgccttcttttccttgaacataagatgtctctatttgtatatatcttctttaatgtctttcattaaaattatatagttttttaatcaaatgaggtcttacaaatcttttctagcttttgctagcatagagagatacagttgacttttctatatttatcttatatctagcaacctgactcttcatatctgagattctattttaaacacagggtatataatgggcccataagcagaaatcattaacaattttagtaaaaataaaacatccagtggcctgagtaaatgtactgtgctgtatgtggatattgatctttttatctttgagatgtatttccctaatggttttatttattttttatttttttgtgacggagtctcgctctgtcgcccaggctggagtgcagtggcgcaatctcggttcacttcaacctccgcctcccaggttcaagcaattctgcctgcctcagcctcccaagtagcttgaattacaggcgcccaccatcacgcccagctaatttttgtattttttagtagagacagggtttcgccatgttggccaggctggtcttaaactcctgttctcaagtgatctgcctgcctcggcttcccaaagtgctgagtttacaggcgtgagccactgtgcctggccccctaatggttttatttatttatttatttgagacaaagtatccctctgtctcccaggctggagtgcagtggtgtgatctcaacccactgcaacctctgcctcctcggttcaagcaattcttctccttcatcctcccgagtagctgggactacaggcgctcaccaccacgcctggctcctaatggttttaaatagggaaggctaaaagcattcttacttaggagtcagaaggctgaaggctatgttttcatcttgccagatatccaactatattgacattaggcaagtcagtgaatggtatgatctacctttcctaactcataggacttattctaaggatagaataagataatgaatgagaaaagtgagtgttatacaaacataaggtaatagcactggattttttttctctaaattttatgaatcagttgcttcttaatcaggaatactagcaaaaaattggtgacactctaagcgttaccagtagctccaccttcacttgtggcattttaataagtttttaaatgaattcattgtatcacttattcctagcaccttatgttcatttttacaatggacacacacagacacacacacaacttttgaagtttgcccatctcagaggctaacttttatgagaagccttgttaaacagatttaggaagttaaagtataaacttacatataaggtgaacaaactagataaatttggaaagattcattcatgcattcaaaaagtatttttttttttttttttgagacggagtctcgctctgtcgcccaggtgggactgcggactgcagtggcgcaatctcggctcactgcaagctccgcttcccgggttcacgccattctcctgcctcagcctcctgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctcaaaaagtatttaatgagtgcctaaatgtgctagggtagggctgggtattgaggattccgtgatagacaaagcaaacatggtccccctccttggcagagaggatgtgctccaggaaggtaggtgtgaatattaacaaatgaacaaaatgtaaatgtgatcagccctctgaaggaaataaaatgctatgagagaacaaaataggagacttgaactatcataaatttaaccaatttcctttagaaaccagtttacttgagaaacgaagtttgagtttaaaatctgaaggatgactaggaatgacctcagtgtctcaaagtcattttggcatctccaccccccactggctgcagctcactcttaaaaaatttcctttgctggtgactgtcagatctgggaagagtgtgttttcactgcttcagctactgtctggctgccctgccagaatcccacagaggcagcaggtgggctgaggcaaagagcaggatcaggacaatatcggaatgtcaaaaaagaaggggaactgtctgcaatgtatctgctccgtctccctttttcaggcacataaagctctcctcctgacctgatcttgccctttggagtagctctgagcttttgatcaagtgttgaaagtagggggaggggagagcaaacagaaagatggtaaaagaacaacctgcagaggacgaacctcccaagtccacctttctcagtggatggcagccagctgtgaggcagagaggagctaaatgcaaaccccgttaaaaagaaaacacacttcagatgaggacttcactaaatctttgtaactttttaatgtcctttcaaggactactccctcctgccggcttagcccaaatgcatatttatgagccctcacatggatgaaaaatattgctgaccttatcaccactgcagtggtattcccaaacggtcccgatcaggaggaagaagggttccaggcttggtggtgtgatctgtgtggtctcagaaagaatgagccacaggagagggagctctcccaacccagacttcacaggagcctctctgactcttagagtaataattgatgtcaggtaaaaaagtgaatgaagcctcctgttcatccaaaatcagtgagcacctgaaggatgaaacgacagaggagtggctgctcatcctttcactcatccattcatttatttgttcattgcataaatatgtatggaatgcccactgggtatcgtctgctgttttcccatggaaatatcaaataaaataaggtctgctcttcagacaataaatcagtggtagcagaagaatttcaagttttgtgataatattctgaacctcgtgtaatgggaacaagaaggagagacctctgaatcagaatagagcatcagagatgtttcacttaagcttcgtgctgggtaggagttagctctgtgaagaaggagtaaagggggccattccaggcaggattggaagcattgaacctgatgctccaagaacagtgcaaaatcagatgtagctggattgtgggatacttgtaggagagcgatggagatgcaggaggaaggaggcagaggcccaatgttaaggagtcttctaagccaagctgaggaggctaaactatcctgaaagtgatggggttgctcctcctgtgtttgagagatggtaaggatgtaacttaccttctttgtgacttgttgacggtcagcatgaggctgtggaagttagtgcattgggaagatgggagcagaggagaatcacacatcatatttaggtttttggcttgggcagggagttgatgttggcacctataatttgaatcgtgcaatacatgagttttgtcttttgcatgtcatggccacgttactatggctggtcttctctgcttggctaccttaaagcaaaggtgtatttttggttctgcggtactgccggagagaccaactgtcatgggaattctggaggaaacttagaaatgaatctataaggccccatcttataacatgacatgattaattggaagttttctggatcatctgcatgttaagagggagcataggatagcagatttgctgggttcatatctacttcttagttgtttgaccttggctggtctcatccctttgtcccagagctgtcatctgtaaactggggatgataatagaagcagaagggcttgtttccaaggcaggttgttaagaactttttataacttacaaggtcggccatgaaccctttttgctcttaagagtccaataaaaatgagaattttctaccccagagataatgagtttgagatgcatgtgaaatgcagaaatggcacatttgggagcacaagagctttgagagtgcaacaggcttctgagcaggagagagatttgtgagtcccctgaatgaattgtgtactgatgaagcctgtgttttgagctgtgttatccagggctagctcagagctgaggtctgggaaacagaggccataaagaaggaggagccaggaggcagaaaggaaacagggaaaaggcggaggtgacacaagctgcaaggcaagataacttcaagaaggagagagtaaccaagtattaaatatggcagaaaaaccaaatgagcatgtttttggaaattgatgaacagaagtcagcctggaggctttgtcagagctgtttcagtgtggtagtagggagagagccctgtaacaggttgaaaacacatgaaaacatattaagttgaaaacccagtgacaggaccttttgctcttccatgagctctgcctgccttcatctgagaagatgggagaacattaggtgtcatggagccactggagctagtgctgtgattattaaaagcagggtcagttcaccattcactggaacctcttagacatcccacccgttaacctgcagtgaatacctctaaattagtcgtgttgctttttccactgttgtgggtacacgaatgccaatttctaaacaaaacaatcttgtgtttgtttcaaagtcagggtgatgtgcagggtttcaaaacatgaactcataagccaaacaggaaattaacattagctgcctagctgacttgatgagagaaaagaaccctgttggctgaactgagctctagctaatcatgagccactcatttacatgtgggccctgatgagtgtcacccctgaccttcaaagagaacaaacctattgacttccagatgactatttcagttctgcaggcatatcaggtgtgttgcatttttattttattctgtttgcctagttgtgttagtctcatacctaaaattagcatcttattactgcttcattttcaatatagattaatcacacctcagatgaggactgacttctgcatagaaataaaaagctagttttggtttagtgagttttaggcatagccagttttcactctgaaatgctgtggaatgttctcatttaacattgctaaatctaccaggtgttatcaatgagtcagttacaatctatttgaactccccccacacaagaggtgctgggtaccactgctctaatgcgtacattaagaccaggcagtagtcactcattccccaaggcttgctcttggacataaccattactgactattattttttcaaatgaaactatctttattgtttttttctggtaataaaagaggggttataactttttaaaagggagagatagtaggaaatgtcagtgacccataagtcccatgctcccagagatagagaatttctttccagtgtgtatgtgtgtacttataaatatacacacatgtagacactcacatacacacaccccccctttccatataggctgatattgtgattcttgctttttcctccacttaatagtactttatagttattggtccttgtcgttacctcatcatttttcagcagctgttgaatggatgagtgatggtttacttaaataacccctattaatgggcatttaaattacccctcagttttcacaattattacacagcttcaaagattatacttgtttgtacatttttgtatgttgatctcattgtttctccagggcaaatatgtttaaaagtggagttggtatgccacgaaggttgttttttgtctttgtttttttgagacagagtttccctcttgtcgcgcagactggagtgcagtggcacgatcttggttcactgtaacttccgcctcccaggttcaagcgtttctcctacctcagcctcccgagtagctggaattacaggcgtgtgctaccatgcccagctaatttttgtatttttagtagagacggggtttccctatgttggccaggctggtctcgaactcctgactgacctcaggtgatccacccgccttggcttcccaaagtgctgggattacaggcataagccaccactgcttgcccaccaagggtttttgacatattaccaaattgtcctccttaatggttctgcaaacatagaccgccactagcagtttgtgagcatatgtttccccacagccttggcaacaactaaacattattaaacattaaaaaaaagctttgctagtctgatcaggaaagagcatttgtttctcccttgtttaaactgtgaggaaagaaccttctttgtgttttttcaatgctagtgaagttggaatacatgcatacatatgctacacacagggacagacacacacatataatttgcatttcttttggttgccagtttgtgtcctttgtccattttcctattcaggtgtctatttttttctcttatagagattagttgaatggacgcatgatggtttacttaatccctactaatgggcatttaaattatccctcagttttcacggttatcacacagcctagtaacttgaaaagatgagtaactaatcttttcagattaaagttattaacctcttagtcacaaatgctacattttccctccaatttaaaaaattggcaccaaaagtggggagaggggcaagacagaactgaccgcttagagacaagcaggccatatccacagttttgttttttgttttggcctaaagggtatatcttagaatttgaatcaattattagtgcttaaacattagaagatagtcagcaattttagaaaaatcagaagctctgatgacattgagcctgctctccctgtggttactatgctggagcttagtaggtgtggccagcatcaggctgggaggagctctctaggtcaccacagtgctactgcctgtcatatcctgtctttatgttgaggcccttggggcccagtctccttatgcatatatgttacccatctggcctctgaccgtgttggggtggtggttatgactttgttaccctgtcctaggctgtgtttgagagtctggaaatgtaaagaatatttaatgttaaactgcctgtagagcatcttcgtgtctctcctctaaccttctttataaggaaataggatcctagacattaacgtaactgtcataggtcacctgtgctaagtatagattgatttatctcaaggcttttctgttagataccccagataccaattgtttaaacatgtaaattttgtgggtggcatcagaggggaattttactatggcaactaattaacaagtttgtgtatgtgtgtgtttttgtaaagatactcctgtccttacgaggattacagtccaaggacatattgatgctttcttgcatcaaaatagttgagttagcattagagcacatggaagtctggacctgttctgtccagtatggtagccaatacccacttgtggctattgagcacttgaaatgtggctagttcaaattgagatatgttgtaagtataagatatttactggatttcagacatgagaaaaaagtaaattatttctaatttttaaattaattacttattgaaataataatttggatatattgggtttaataactacattaaaattacatatacatgttcctttttattttttgaaatgtggcttctagaaaatttacatatgtggctcacattcattgcttgcagtatatttctcttggacagtgttgatctgtggagggtaggagggatgaagtgagaggacaaccttaaactaatatggcacgatgcagtttagattctgtgtgtgtgtgtgtgtgtgtgtgtgtgtgtgtgagagagagagagagacagagagagacagagactgttagggggcagggaatagtgttttaagctatctttatttaactttgaggaaaagtgatttttttcccatgttccctcagataaaaagtgagaaagttgggtctagaaatttcttttgattcccactaaccttccttttttctaaaagatgaaagctttgttagtttgtatttttaagctcttatttgatgctacagagaaatgttttctcattactacccatcttatgaacctaagtgacaaaagctcagctctaatagagtatactgagtggagcctgaccatagttcatttgttatttaaaagaagctttaagattttgtagaacgcttttatatcaaattcccagaagatttgacctagcagagtgaaccagaagaccttaacagctttagggccggcactactacttttagaaacttgtgttacggcttcagtgatttgaggaaaccagttttttaaagaagtaagagtcctcatgggatatcatagatatagttaatcaacaaaagagaacagaaaaatgaacctgatgtttttctacttaaacaagaaaattggcagatgagagtaatggtaaacatgggaattagtgcttcttcctaaagatataatgcaattctgttgttttttttccctgccgtttcctcaagctcttattcttcagtcttacgttacaaattagtccctgatactttcacttctggattcattaatctatattatgagcctgttatgttcaagggactattatagttgtgtgtgagaggggaaggcataggaacatgcataaaaataatgttcagggcacaaaaatagtatatttgaagagaagcctagataaagggctgtggaagttgacaggagaaatgcttctgattggccaaacaagacaaagctctccagaaaggttgcaggaaagctcctctgtgcaaagcaccaagggcaatctggatagttggagattggggagggaagaaagagcacatgggaaaacaatgggaaggatgtcgggaaaagcaaacctccatcgtggttatgtatagagttctcagcacagctggaaacatttgttgaaggcaaattgcagatggtcttacatgccatgtcctttagtaatatgaatttatcagtagtgtgtatgattgactgaaaagcttctagattagatgaagtaccctgtaaagaaatcaagatactggttcagacagttagtaatggggatactgaactggacatctctaagagtaagattgaatttaacttggaagcaaagccaggagtaaaatatcataggaacatctataaaagttaaatccgatatttttttgcttttcagtcagatgaagctcagtatctttattactatttgaagtaaagttatattagcatgtaggcctttgagagtaatacagttcattcagaggacacagggctcaggaaggtcaacccagtcccaaaaggcctgaagatgggacttgggccttaaaggacccacagaagagcctcctaagaaggtggggtctccaaacagcatgaacatgttccagcaaaccaggaaaagcaaaagcattttgctgaattatttgtagaacagatactgtgcttcatttgactgcagagaaaaacactggatttaatttctccctgtactcagcagatacacaaatatctgtgacagaagaaaacggcagtagtttagtgatagcagattggacataagcagttctcaaactgaatggtctcaggaccactttatacacctaaaaattattgaaggcccaaagagattttgttcatgtgaattgtatctattgaaatttatcataagtcaaaactgagaagttttataaatatttattaagttaaaaatcatcacatagtgaaagaagtctgtctagaaagactatatatgttgtatgatcaaactgtatgacatcctggaaaaggtaaaatgatggagacagtaaaagggtcattcgctgccactgatctcctcaagagtcttaatatcgggaagctatcaagctcatggtggccaaaacaccattttccaaattctaatgttcacctaaaagcttgcattttatcattggcaacaagtactgtcaattgtttctcttgaggcgacaggctcaacttcattttcaataaaaggtttacctagtatccaaattgaataacatcccttgtctgtcagtgattctctcaagtaagaaaggtggttgatgaaaaagcagctgcttcaactcacagttcagacattcccatagatgcttttcctctagacattgttgtacttctgtatgcagcgggaatggcgtgtgcatacttcccatttcatcacacagaatattaaaaagatgcactcaggcttgagatgtaggaaaattaatatttcttctgtgtcctcaaggacttccttaagtgaaactgtcttctctattttactgcaagtgcacactggtaaagaataaggtgccaggccaggcctggtggctcacgcctgtaatccgaacacgttgggaggttgaggtgagaggattgcttgaggcctggagttcgagaccagactgggcagtatagcaagagcttgtgtccacaaaaaactttttaaaaattagctgggtgtgatggtatgtgcctgtagtcctagctacttgggaggctgaggcaggaggatcccttgagtccaggagttcaaggctgcagtgagctatgattgcaccactgcaccccagcctgggtgacagagcaagaccctgcctctaaaaaaaaaagaataaggttacctcaaatatagtttgattcctctgcttcgacttatgtaggctgagctgccagtaggtttactcaccattatttgtttacaccattggtgaaaatgccaacacactgaaaaggacataatgtcttagtatgataatgaaaacagttttgactctatggtccccttaaagagactcagcagtcctcaggggctgcaggctacacttcgtgtatattttaatggtaatacagacattttaagaattgacttttttctgggtttaaccaaatggaaatttagcatgcttgcatttttggctctgggatttttattttatttatttatttgtttatttgagacagtctcgttctggcagccaggctggagtgcagtggcatgatctcagctcactgcaacttctgcctcgtgggttcaagcgattctcctgcctcagccccccagtagctgggattacaggcgtgtgccaccatgcccagctaatttttatgtctttagtagagattgggttttgccatgttggccaggctggtcccaaactcctgatctcaggtgatctgcccttctcgacctcccaaagtgctgggattacaggagtgaaccaccgtgcccagctgatttttataatttaaacaatggaaattctgtttagaaattaaaatcaaatatgcaaattgaggataaaagaagaataaaatgaaaagttcagcatttgaaataactgtcaaatccataaagtatcatatttaaaatttaattttacacctgagtgcacagagttcatttttgcttaggaaatgcagtgtcttaagacagtcttgctctgtggccaggctggagtacagtggcacgatcccagcttgcgcaaccttcgactcccagcttcaagtgattctcctgcctcagcctcctgagtagctgggactacaggcgcccaccaccatgcccagctaatttttttttgtatttttagtagagacgggatttcaccatgttggccacatggtttcaccatgtgaaacccctgacctcgtgatctgcctgcctcagcctcccaaaatgctgggattacaggcgtcagccaccatgcccagccttaagtaaatatttcattcccgttttcagaatatttgattatgttattgctctgtggtaattgaatgttcattaatctgaagaaatgttgttttcttgtattatttgcattgttgtattatctgggggaaaaccacatttttgcatttttattgagacttctctctagatgagtgctgtaccacttaaaggcagcattgctagtattttctgtcaaatgctttttgaaatcagtttactgagtcaatttctggagtagagcactcaagattgagatcaatacatgagccctttgtctctagaaactcaaagattgtgcttttcgggcaagatcatagaacttgtatgtatggacttttttcaccactgctcattgggtgcactgagagggtaaataactctctgatccctctgtgagtgcttaagacaaggcatgcaaccaacatatatccttgaagaacttgaacatagaattactcctgtgattagatgaaattgagccacattgatctattctcacattggccaaaagagggggacatagactaaggaatgtgactatagtagttagaatgtttactgacattgtataggccagggtggaacagtgacacttggaaacagaacagtggtatgaatgcttttatttttgttgacttcaccacaattctaatacataaagtataatccatatgcttaacagctatgatcttacccaaactcaggatgaacctgtgatagtgtaaaagtgaaagcaggttgaattaatgtctataattaatgcctgccaatttgtattgacaaagatgcccagacttctatgaatatgagtagaattcaagcttagagaaagaaaagaatgttcttgaaacttttacagcttttacatgaagagccattgcctagttttcagtttggttggaatatgtaataaatcatttagtcccaaattctagcctgtaaaaaattgtcagatattaagtttatttctcacagacacctgccagaggacagaaaagtacagtatttctgatgcttatgtagcagtgacattggtgattctgtctttatcttttctcttttctagctcaaaagctaactgtttagtacttaggaacgtatttctacatgtgtttaagtgcaagaaacagtcaaaaaagataagtggatatgtaaataaagtcttcgtacaataagttacttcttgttcatccacgccaataaggaactgggatgttttgacacaatatctaattaactcagagttaaacttgatttactgatttttaaagaatgagaaaataaataagttttaacattaaaatggcaataaaatgattctgaaagctgtttggaatcctaagagcacatgaaggttatcatttataatattcattaccagaaaaaaagtttattaatggaaataaattacattttgagtttatttgggtaactatgtctttttctctatatttagctcagtaaatgttgaagttttttgagatcaagatcccttcaattccaacatatgcttagtttcctgtaataactttgaaacaagtttaattttagcttttctttacaaatttatgactcattacaaagtgaaatttttatttttgatgaaaacagatgcaaagcaataaagtgacatagggcctagagaaaatggagactagaatcctaaacattgttctctctgtaggttttcaggccctgatagcatcaggggtttgtttttttaataacataaactaggcaaaatggcagctgtgttcaacaaatgatgcatatttactaaacaaagcaaatggaaataccagctctgaaggaacaagaacaggttccatgactgaaggtgtcatataactgccaaatccaatttgattggtaattgtatccatttcccttcatcatcccccacatttcttttcataattactaacctaaaaaaagactttctattttctccattgatttttttttcccccagcctagaatcaaacagaagtactaatgagtaatgaaataacctaaggcagacaacagggtagaaaacaatgaagttgattaatcaatctgtcctgaataatcaagaggctttaatattatctgtgataaatctaaatggtaggaacttttttcattaaagcaagacttaattttacctaaccaaaagagtgtacattctaattgactttgggagcagtgtctcttggaaaagacgttaattaccactctgcactgtcctttgtgattacctatcatttgccaaaacttccaaccaagttcaaatataaaatgaaacaattgccaccttaaaacccttttctctttcagggccattgcaccatcatgggttttttaaaaagtcttctccacttacctttgattgtggacttctgcaagactctgtggctttcatttattcctatgctcacatgagacttagttctatctgttggtttcacttatcccttgttctgatgcccaaatctatatccctaggtctaatgcttcacccaggctgtaagccttcattctctcctttttttgaggtcccagactccaaaccttatcatcctgtcttatacttacttcttaaccaccacactctgattattctccttagtggtgcctctcaaatttctctcccacctgatttctgtggtgaccactcaagtctgggtcctggccatctggcaggaatgcctgacatttgtcatcttcctcatccagctggactcctgcactggtctcctgactgttgttcctgcctctactccttgccggcttcagcttattcatcacactgaagccacagcagtgttttcaaaacgtaaatcacaccatgacaaacccttcctcaaaaccaaagaagaaacgatcccaacctcctttcctgggcttatcatgccctgcatgactggccaaccccaagttctttgaccagtcttctatctctctgtggctcttgcactctgccctggaccattgtagtagattgccaactggtcttttcgtccaaatgttttttcttaattcatttttttttttttttggtcaattagatcaagctggtacttctcagtctattaaagaatagacctaatattttgtacctttatttactactcactataccaatgctcaactttagtaatgtccctttcttcaccgtcctattccttccattcgtttctgcctcctcccccaacatacatcttactgtcataatactgtgtacttcttcacctccatgcctctttcctcattgtgtttttccacctgaagcaccatttccattcgttttagcacaaagaaaatagactttgactttccctttccctgagtatagctttaaaacctaccttggtttctgtctttaaattcttacatatgaattgtctctgttttatgctaataaattcttttgcagtgaactcttatttgccagttgcttctagcgtacttgtcaattctccaggtattttaaggccctcgagagtggaatagtgtctcatgcttgtcttctggtaaacatactatttaatgtaagactaggcagacagtaactgttgattacttgattgaaaacttgatgaatgttacttaacatttttttcaagcctgtgtttttggaatatttaagccttctgttttttttttttttttctcttctagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaacttgtcacttctctttttctaaagggttaaaaaaacaaacttgagtgatatttttcatcagaagtcttagtattttgtgaaaagtagcatttcaaaatctgttttcagctcttctgtaatttgatgatgctgccaacatcactatttgaaacggtgaaagcgacgttgaaagtttgtaaatctaatgttgagagtgccagattccttctgcctggttacataatccattccagcttttacgaattctccgagggatatttttgcttgttttctttgtgcatttttcattttgttttcaggaaatattttagctgtaccatctgaatcttgctcctctgcttcatgtccttctttactttgtgtccactggccctctgtatatcaggcaaactaggccactgaggggctgcatcccagtctgattgggatgctttcttgtgaaacttttgttggggcacaccaggttatggtgttattatagagcaaataaccaacagggtacatttcttgtaaagtgttatatagaatttttttctctagtcatttaaagtaagtacattaaatacaatttgcataactgtcgtctttgagatctgtttccactaaattatctctcgccttgtgaaaggcctttctcactttctctataattattacaaaaacaacaactccctggagaatccgattcagcaagccaagccttagaaatattgtggaaccaaatgtgattttgcaaatgtatgcctcatcagaaagtttgtataacactcacattgaaatcataggttgcgcttccctgggtgttttgaagaccatatttgcagtgacaggaagaaagtttgtcttcacaggtcccatggactaagaaaggtggtgtgcggggattagggctcggttttatttagctgagacagcaagaacagggtttagggtcctgggggcattgagagaatctatgggaattaatacccacagagccacttgaaacaatgtttatacttattcccacctgtagctacaggagcaaggctgtcttttaaaaaaatattttgtattataaagtatttctctggctgttataatctcatctggtaaattgggctaaatgatagaataaataggaaagtagatcaaacaaggttttggaaattggatttgaaaaatttgaaaagtggaaagaatatttttaaatccccaatctgtttgatggtaattatacattggatggtatttttgaatacatgttttctgctgtcttctgcttgtcactcacatgttagactgtatgtcattgaatacattgtgataaattcagaggcctcttctgactggcacaccaattacaaagtcagaaagtaagaatcttgtgagcatgctttgaaaattctaacaactttttgataaatagaaatcagaaaatttatttccaaaatgtgcttaatgtcatgaattctgagagttatcagagttctgaattttgatggttatcagagttgtgaactctgatttctgatattcagtcttgccaaagaacttgagatttcaccaaaaagctgttcttattgtctaggagtgtttacctcttctgaattttccaatcgctaaattatgtctggaaaattctggaggctgttacctggccagattatttttaaaaaacttttgcaaataacatttcagaaaacataatatgggctttttcttgcccaaattgtttttcagctaggtttaggatgtgcagcagtcatggacctgcagtttcccaacaccaaattgccaaattaccaacatgattatcaagagagatgaaaagatagtatttacagctttgagttcattctgttaaatttttagctggtcacagtgggtcacacctgtaatcccagcattttgggaggtagaggcaggagcatagcttgaggccaggaattcaagaatagcatggtcaacctactgagaccctgtatctaccaaaaacaaaaaacaaaacaaaaaaacccaagt

SEQ ID NO: 13231 - DNA, 13438 bp, Human
acccatgggcatctgccttcttgaccttggcatgggcatcaagaaatcactgggttcatccatcaggaatgtcactgaaactccagagtcctggctggtgggggcagggaggaggtgcgggggcggtggggggggcagaggtaggccctgagcacttttcacaagggtccctccaggcagttttcatcagagctgctactgaggtccctcaaagtcccctgccccccaccccaagccagctctcctttcccagccctttttctccttgtttaggaaaaaaaaaaggaagaaaggacagagagagagagaaaaaaaaaaaccaacccaacaacaaagtctgtcccactccagtgaggtaattgaaaacaaacttcttccccaccccccccacccccccacctcagtgctcgcggtacagagaagggaagagctgccctgggacccagcactggccatgatcaggatgcctgcccaggccacaggttggaggcgctggggctggactggcagagtgccctcccattccaggggcaccaggaaggagtgggagacaaatctctgatgccactccagggagaggcatcaccttccaggtctggcccaccactggcctctcccactttgaaacaataaataaacaacaacaaaagcaacttattacccagtgatttaattggtggtgtggctatagggcacccaagccttggggaccacatgactctcccccaggaaaatcatgaagcagggcagtccccagccctgggttagagctgcctcctctgagcgtgttctccccggcagcccttggagagggaggaggggaccccctctgggagggtccaggcatacccccaggtatcctgcccagcaaatcccaacccaggcctgcgggaaggagggggagccctcaccgctaagccacccccacctcaccaccggaaaaaccaacaacccgaaaccccaaaggaaggagaatgccagggtcttcatggggaaacatttcacaaatggggacgctcgggcggtccatcgccttgaatcggagcattcccgctgagtcacccaagaagcctgtggtgttgaaactggtccgttgcctcgtgctgattaatgaattacaaatcccccacccatgtacattctccctggtcactggaggaagaatgaagaaccttgtgaacttgagggaaaaagtcccgccaagtggcctcttctcgcctctgggccgggcagtgggcctgcagtgccctcttcctcccccgcagggggcattgtgagctggttagtcacctgccccagccccagcgcctcgcttagctctagcttttggaaatgggacaagcggcgggacaataggcagggggggcggtcagcccagacaaagggcagcaggaaaaacaccatcacttgctcccaggccagctcgctggcatttgggagaatgtgtcattgcatttactcaagggggaggaggagggaaggttagagatgaggaggcagaggtagggtgggagcagggacctcgcacaggcagaggtaggttggatcagggaccccgcatcgggcagggggcagggggcagggggcggtgtccccaggccaacgcctggggagaagcccacccgaagccggcgctgtcccccggctcctgggagtcctcagacggactgatggcctccccgccccctcccccaggaggcccagggtggtaccgccacagcctcgcctcacctcaccccccctcggtgctgtgggagggagagggagccccagaagccctcccttccctcctcccccctcctacccccaccccggggagggccgctacaatttgtggttacagctttacacgtcagaaaaaaaaaaaaaaagtttgcagaatgtcccacaccgaaaaaaaaaaaaaatccgaaaccgagcgaaaaaaacctgcgagtgggcctggcggatgggattattaaagcttcgccggagccgcggctcgccctcccactccgccagcctccgggagaggagccgcacccggccggcccggccccagccccatggacctccgagcaggtaggagccaggcggccgaggccccgacccccgccccgccaagcagccacgagatccggttcccgtcctgccctgacccccgggagccccgcgccggggccgggccagggagctgggctcgggccgggggaggcacggctgggcgccctcgagaggggccgggcggggacgcggcattcctggagtccgcacggcggggccaggaggtggccgggagcggcggggagcccggacgatcgcagacctggggaggcggcaacctggagccccagcgaggcgggccgtaggagccgcagccccagagccccgcgcaccagtcggggccagagagtccgaggcggggagcgaggctgcgggtgggaggaggggctgggagaggaagagggagggaggccgggggagcccgaggccgggcggcgggaggcgaggggaggccgacacctcgggccgcgccgctctccctccccggcccgccgggaggggtaggagggcgggcgggaggaagggcgggcggcggagaggagggcggagggcagcgccgagcctggctgggccgggccggacgggccgagccgcgccgcgggactcgcggcttcctagttacgcgccgcgcggccggaaccctccatggtgcccacggccggggagccggcggcaggtaggggcggcgggcggcggccgcgagatcccccgggccaccgtggcctgggagtgattattgtttggcggggggctggcgcagccgggccggacccggcaggaaaaagtctgtcactggccacggagcggcgggagcagccgctcagcccgggcaggaggggagttgacgcgcgggaaagggcagcgccgggcagagcccggagcccggtgccccggaccccgcccccgcccccgcccccgcccccgccgcggggaaggagcgaccgggcgggagcgggagggggcggggccgggggcgccgaggccacacagggggaaggcgcagcgccgggaggggtcccagagcgagaggtcaccgccagcagggagggccagctggcaaccgccgccgtgcagcttcccggccgagcccctcgaaggaaaccttcgaaagagtccccggggctcgccagaggtcccctcatgcttgctctccccacccgccttcctttccacaactccgtgctgggcttctggagccctccccacagaccctcccaatcccagaggacccctgttcccccagctcccagcctggccctccccccggggtgtgaggggctaccaggagaggaggggagacgggcgggtggaggctaagccttggagagaggctaggggtggggggcactgggcacgctgctctactgggtcctccttctctgaccctaacccagggacacctctgtgctttcactgaccccgactgacctccgccacagctcgggagcacacgttgcccctcacaccggacaggatgcgagtacatattcccctaacagaccagacgcgctcctggccagctcagacaccctcgctgccctggagccacacgctccaccggggaggaagcagagatggcaattgtcacccggcagccccagaagtgacactgctgatgggtgcaatggctccctgtccccttcattcacagacccacactcttgtccgtcacacttctgcacaccacccctgcacgccacccctgcacaccagccactggctcactgacacttcacattcctccccacgtcccacctcttgtgcacacctggctcctgcactctcctccccccccacgcccctcttgataacaacaccctttccaattcacccaccactgccctggactcctccttcactgctcctcctgcctctggctctcagtgggctgctgggctcccccctggctccccgctggcctccctgagcacacccatggccctcttgtggcacaatcaggaaccctctcactccagccaaagcccaactcctgtctcgcttgcttggttactgacttcataaggcagtggggctggcccaccctcagcttcttcccctgggcctcagtgacctctgtcatttaggctggaggagaagggcacaaagggggatgctggagaggagaggagagatgaagccccgtgtgtttcctctaggaggaattgagcttgcataatgtgacctccttgtgcaagcccacagtcaccagacgaattggtggcaaagctaggtctcccaattcccaggcccatgtgtccccactcaccaagctacttctcagtggcctggggtaaaaggaaccaaggaaaaggcagaagggagataagtaagagaggggaaagcagcagcccagagggtggaaggaagatgggtttctgtgggcctttgcctgggaaggtaggtcaggacacgcccctggggcagtttcctaccgtcacaatgcctggacctcacccactccatccctagcccactcctcacccactctgcccgcctaacccactccatccctcaattcccctcaacagacccctccaaccgcagccagcgctggtcctggtctggcctttcctcctggctcccatattcagcccagcctgaggccaccatgccccacctctggagctctgcagtgcctccctggctgcaacatttagggcttacagttcttagcgtagctcttatagtcccaggtgcagagactcccattgacttgtcctaccaccctaagcaccctggcacatctgcatggctgaactctcaccctcactgggaaaggtcagcctgggggtgtccaggccagggactgaggggcagctggctaaagtggctaaagacatgtgctcacgggtgcgcctgcctgtgcagctgtctgggtggccagtcacttccttgggctaagagagagagagtgtgtgtgtgtgtgtgtgttcatgaggagagccttggttcctagggcccagggatctggatggaattaggggctggccgggggtgggggccaggatagggggtggggggctgttgcaggaaacgtgagctgtactcgttagctcctcacgtgctcagccggatttataaacacacagagaagacgggatgtaaacaatcagtgggcagcagccagaggcagagctggggcgggggccgggctgggggccaggactggtggggagggggagagggggacctaggacacagccccagtggccggggtccacctgcacaacatgagcctgagggaggatggatgagggctccaggaagcccaccacgcactctcctcaggaggcaggcgagctgtgctgggttcccaagctcacgactaaaccgcaggtgttcaccccacgctgctttccctcctgctgcctgagacacgggcatggctttgcccagagtggaagctgtcatagcaggggcagagccctgtccttctaccccccctttcttttctcctaacctcttctccctctggattcctgagaacccttccctctttctggttctgtgggccgtcggatccttctgttctcccctgccccccacccgcagcctgcaacgacacagttacctcagaactgaaatattcctggaaacaccggcctcgtctggttaatttcatgagccgtttttttctgcccagatgacttagttcttgtctatccaaaggcttctccccctgctgtccctgtgtagggagctgatctcccctagggatgtcccacagggctcagaatgggagagggtaagttctgagctgggttcctgactgtacctcttggccatgacaaaggcagagcctagaactccggccagcatgtgggtaaagaaggaagcctagctcccagctccggcttcagttgggacccttggtctcgccactaactttgagtgaagccagactcgatgctgaaagcgacctcaaggctgggagggccgctgcccaattcagcaggtctccaatctccaaaactaatgctactctgtacccataggatcctagaggtgactgccagatccctaggcttggagttgtgttgagatgtgaggaacagggaggagaaaggaactgagtcaggcaagagctggggatagaaaggaagagtgaggaaagcagcgtccaggaggaagccacaagctcagaggggacaggaaagggtgagctggtctccccagggagcagttgagtgcctgaccctactctctgtcctaaaacacacgcgtgtacacacactcacacttgcctcaaaccaagaccctgtgacttgtggtaccccaccgccacgctcccttagtaaagccggccagtcacacatctgaaagagtccagactgaccaggtgggccactgccgaagtcctcactgacccctgtcctccataagagatgttttatacaaatggagtcttgcatccttcctagttattagccctctccaaaactgccccagcactgtgattagacctaacctagtcttcattctttcttgaatccaaatcccatcctaaccatgggcaaagcgttatacctatctaagttatttctgcctatcaaagcaacctatgtcattatagaaaaatctgagagtataaaatatgaactataggggtggtgggaagagaaggtggcagcaaaaaaaaaaaaaaaaaaaaggaaaaaaaaagaactataggaaagaaaccactcatgacctcacacctattcaagctgaaaacccaaactagccctgctcttcataacatgacaagcagcgccccatctgatacctaaaccgaccaagtcacagccctccaactcaccctctgcctgcccagacctcaccacatccttgctggactcaaacctcaaccgcactaaatcaaccaaatcccaagtctaaactaatctgaaacttttaaagtaacccagtccttaaacctaacctagcccaatgccaattatatctaccctagccaaaccctaactgcctttgccagtccaaagtgtccactgaatcctcaccttggtcctcacttaaaatcccagaaaagcatatttccccactgcccacatccctccttacagcacccaaccctggcctctggactcctggtatcctgggatgtccaaactctgcagtgccatcagccaacaagcccgactcgtcaaatgcacctctctcccttcctgtccccacccttgcaggctgatggaaaggcctcattgaagtccaacttttccccacctaacaccaagaacggggtgaacctccacactgccaccgttccctgagagtgagcactaaatctccttcaatctaaccccaccctacacttcccacactcaggaatcacatcctagaatatacccaaaactaagccccataaggcagcccgaccctagtggtctaaccctataccttgcttcctatgggtgagtctgttcttggcggccgcctctctcctgcttcctcccttagggctgactgtgctcagcctgccagctctgacatgtgctgtctcccaccctctgactcccctcaagctgcagtgggactgaagactggcaggaagctagggtacaactggaacacaggcaggtcgacctgcagtccctaggcctggccccgtccctccatgtacacacatatacatgttggcacacacacagtggcacacatgccaaagactctctcagctgacacacagatccattctcaagtatctactgatagacactcatgcgtgccaagtcctcatcctcaaacatacacatgcctctctttctctcccgtcttgccaggagtgtttcccctcctccatcccctctgcctcccatctggtgtcccaccctcaccccccacccagcccaaggtggggacagacacctgaggggctgccagctgcttccccgtgtgggcccgggccgcgctcatgcttctcgtccatcctgcccacaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatgtgagtatccagcgtaggaatctgggagttggggaggagtgaggagttggggaaagacagtcctaaccgtggagggttctggtaaatgatggggtgaggaggggctctttggctcccaccagtccccctgtctggtctatctcctgcccttccctcttaggtggcccccccacttccccatccctggccccaggactaggcatgtgggcaggcctcgcacccgccttggcccattgccccactggctgccagcccagccgcccgcctccccctgggggccggggaagtctcctctgtttacaccgtgttgtggtgtctcttgcgcgggcggggttgggtggggacagaggggccccacctcccatgcctgcgttccagctcgcctctgcccccagacctggggccctgctgctctggacccaggggcctcccttccgtctgcctctcccatcctagctgggcctcctaggggggtcatgggggaaggggactgtagggaacccaggcagtagtggcagggggtttagggtgtggatggaggttatgctgtaaggatttgggggtggtccagaggtgttcagagagcccaggagagaaggaaggagggttggaggagccgaggaccatggggaaccggccccctcttcccgtgttcctcttccacatcccagaccctactctggagccagggaaagaaaagggaggagggtggcgggggagctggctccagccccaggatacaccgaggaaattagtttgtctctgtgcttgtcagcgtgtgaacctccccctgggcccttgcctatcccaggcctctccccttgcttctcccttctttcccagttatacatctccctcatccctttccctgggccccagccgctcccccgagggttggaaagggctctgccctcttccctataccatgctgtcttccatagccttcctcctgtcctactcatgagactgcctccatttcttccttctgcaaccctgctcctatcagctgaacccttctttcggagtgttagtgagtacccgtctctccccagcccctcagctggtgggcctgggtgtgtcagcggcaaatggggctctggttccaatgggccactctcatctctctcttgttccttgtgcagaaaacctttgcttcactccactgccctctctagttcccgaccctttttctctcctggctttccctgccaaatttctccaaggagtggtctacaccctctgcctccacttcctctccacccactcacttcttaaccccctgcaatctggcttccaggccccagcaatggttctctccaaggtcgtcaggcacctccttgccaagcccgacagtgttttgaaggctcattctccttgctgtctgttttgcagccacactgctgagcgctgctgccttctcgaactcctcttccttggtctctgcactctcctgggccaccttctacctctccagctcctccaggctcctcttcctctctgtcctgcccccacagcgggcactctcccaaggtttgcccacccagccaatcagcacgtccttcctgagcgtcttgtgcgtctcctcctcctcctttttctacgcctctccattggagagctcaccaccgccactgcttcaactgtcacctgcatacaaatgatatccttattggaaaaactcagggaggccatgaacaaagaagcctagcatggagacagggccagtgtcaggggacacaaaaaatagaaactttgggagcaggtatctccttggtggtgagccagcggctctgccctcctccttccccatcaccctctccttttcacagctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaaggtctaccgagctggggaggaggtacagtaggccctgtcctgtcctgtttctacaggaagtcatgctcgagggagtgtgaagtggttcaggttggtgcagaggcgctcatggcctcctgcttcttgcctaccacttggccagtgcccacccagcccctcaggtggcacatctggagggcaggggttgaggggccaccaccacacatgcctttctggggtgaagccctttggctgccccactctccttggatgggtgttgctcccttatccccaaatcactctatacatccaattcaggaaacaaacatggtggcaattctacacaaaaagagatgagattaacagtgcagggttggggtctgcattggaggtgccctataaaccagaagagaaaatactgaaagcacaggggcagggacagaccagaccagacccaggagtctccaaagcacagagtggcaaacaaaacccgagctgagcatcaggaccttgcctcgaattgtcttccagtattacggtgcctcttctctgccccctttcccagggtatctgtgggttgccaggctggggagggcaaccatagccacaccacaggatttcctgaaagtttacaatgcagtagcattttggggtgtagggtggcagctccccaaggccctgccccccagccccacccactcatgactctaagtgtgttgtattaatatttatttatttggagatgttatttattagatgatatttattgcagaatttctattcttgtattaacaaataaaatgcttgccccagaacttagtctctttgcccagcctcacccctcctggtgctcatcagactcttgccacccctggctcccactccctgcttgcctctggtggagctgcacagagctctgggaagaggccctcttcctccccgcactggggcgatgggcgcacctcagacttacccactgctgctgccaccaccaaccccttgatccctcagtcctcccacacagcttctgtccaccccaggtttccctcaccccacctttgctaagtcttcctcacctttctgggattcggttttctttctttttttttttttttgagacagagtctcgccctgtcgcccaggctggagtgcagtgacgcgatctcggctcactgcaagccccgcctccagggttcacgccattctcctgcctcagcctcctgagtagctgggactacaggcgtctgccaccacgcccagctaattttttgtatttttagtagagacagggtttcaccgtgttagccaggatggtctcgatctcctgacctcatggtccgcccgcctcggcctcccaaagtgctgggattataggtgtgagccactgtgcccggccttggtttttctttgagagagtcttactctgttatccaggctggagtgcagtggcgtgatcttggctcactgcaatctctgcttcctgggttcaaatgattctcatgcttcagcctctcgagtagctgggattacaggggtgcaccaccatgcctggctttttttgtatttttagtagagacggggtttcaccatgttggccaggctggtctcaaacccctgacctcaggtgatccacctacctcagcctcccaaagtgctgggattacaggcgtgagccacctcgcctggccagcctcaccttcctggattgcattaatggtctcacaggtctgtcttcccaccttgaatttctatttctgccctctggcccagcctccttatgatgagcaaagctattcatctgtgcttctggtgctctaccctgagcagtcagcccctgggcttcactccccagcttccccaggactcctgcctgtctctgtccactggggcttcaggagcagtgaccctcacttcaacacccttcctctcttcaggagggaaacagactgtgaacaagtcacaatcctcagctgtaaatgctactcctctctctccaatgtaagatagcatattcaggaaaagagaaaaattcaaattgtgagagaatgggatagatgctattcaagggatgccctaagctcaaatctcagactcacaaattttgagtgaccagtttccccatcagtaaagtggggataattaaatacccatctaagactgctggaaaggataacaggaacaacaaagggcagatgcttggctgtagcagcagcagctgtagtcattacagattacttaggctctagcagcatgtcatgacactttagttaggaaccactgggtaagtcaatgaatgaatagctcccaggtaatacatggatattttatggaccttgagagcttgtttggaagttctagcatgggagcgaggctactcatatacccttgacggaagactgatcctcctctatcagggatggtcgtcctcaacagagcacacagcttcgggagggatgcacgaggagctgtgagggaggacagggacacccgcctagacagccagatcagccgaatcaaccctggtgatcaatggggtgacagatgtcacagccagatcatcctcacatcctacatggatattttataagggcctcctggagataatgccttaagtgaagaaagtaagaaatgatggcaatgtcaatcagttgacaaatattttcaagatctaattacctgcctgtggtgtagaaaagccaaaagaagcctaaaacctaatttggctcctgcccttatggagcttctaatctacttgggaagaaaagatcaatgtacctgaaataataagggccacaggcatatctgtgcgatgca

SEQ ID NO: 13232 - DNA, 11939 bp, Human
  misc_feature (1)...(11939): n = A,T,C or G
aggcaggagaccactgagagctgttacagtcatccaggtgagaggatggtggcctaggccttggagatggaagaggagggcaaagttgccacctgttaagttgccacctgtttgggaagcagagtggtcaggacttaactgaaagactgtgtaggggtgagggcgagcatgaggtcaaggatgactccagcatactgagccggatgcccagggacaggggcactatttccatggatcccccgggaaggggaagggaagagtaacctcctcccccaaggctccacggaaggggcaagggctggtgacgaggggagcagaagggaaggagagggagaaacaaagtgtatgcatgtatccaaatgtgtacaattattatgtatcaattcaactcatttgaaagtgggtctggagagcaagggtggcagagataaatatatcttctgcactaccacaggacctgaggggcaaggcacgggcaggccctgcaggaatacagggatgccctgggcccttccaagaactaccagagccttggtactgtggggagagtaggggtcagtgagtttctccaggactcccttacattttacacacgtggacccggaagcccaggggaaggggaataccttccagctgatgcatccccacctggcacacagtctggtttttttttttgagatggagtctcactctgttgccaggctagagtgcagtggcgcgatctcggctcactgcaacctccgcctccgggttcaagcaattctcctgcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggtcaggagttcgagaccagcctggccaacatggtgaaacccgtctctactaaaagtacaaaaattagccaggcgttgtggcaggcgcctgtaatcccagctacttgggaggctgaagcaggagaatcgcttgaacctgggaggcgtgatcgtgccactgtactccagcctgggcgacagagcgaggctctatctcaaaacaaacaaacaaaaaaaccccccacacacacacaaaaaacaaaaaacaggccggtgcagtagctcactccactttgagaggccaaggcggaaagacagcttgaaccccacagttgagaccggcctgggcaacatggcaagactccgtctctacccaaaaaaaaaaaaaaaaaaaaaaggccgggcgtggtgggtgtgcctgtggtcccagatactcaggagactgagatgggaggatcccttgagcccaggagttccaggcggcagtgagccgtgttcgcgccactgcactccagcctgggtgacagagcaagaatatgtctcaaaaaacaaacaaacaaaaaaaggcacataaccacgatctaccctcgtaaaacgtttccagagcgtcccagcggtgcccctcatcatctggcggcccctacgcctctctgagactcacagacctactcccctctccagggggcggagcccacaccgctgagcatttactcttgttcttccctctgccaggggcaccgttctacccctttctgcctggagaaactgccgtttttccttaaaggatcctcgaagccggaaggagcagccacctcccactcccggctgctgcaagcaagctgctttgacttctttctagagttggggattgctgctggagtccgagtctcaggcccagagtgggtgcgatggtcttgcttgcaccctgtatcccccggcagacgcccgggaactctactaagtgggtgaccccagagagctcgcccccacactccgactccgagtccagcactcggtccactgcacagggacctcgcgccccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagcctgtgagcgtttttctcacgtgacggaggcgcctgcacgtggaccaatggggaggcgggggcgggggcggggccggcaggggcggtgcgcgggaagggaccccggacccggaggtcgcggagagctgggcagtgttggccgctggcggagcgctggggcagcatgaagtgcctggtcacgggcggcaacgtgaagggtgagtgcaggtcggcctggcagcggcggtgcagcagccgcggagccgccagcctaacccccttccgctcttctccccgcagtgctcggcaaggccgtccactccctgtcccgcatcggggacgagctctacctggaacccttggaggacggggtgaggggctagggtgtggggggcgggtgggactccagccgggagcgggtaacccggactagagtctcgcccccactaggcgggatgaccgctggcagatttgtcggcaaagtttcagtttcttagtctggcggctgtcatcttcccaggccggtgtgtgaattgaggaaagctgtcctgcgagctcccagggggtgacgtgcacttagagaaactcggggaaggcctgggtgtgcgacccctcctctgcggcagcagcgccggggccgactctgaaggcttccatggggaaaggagggtttttcagcaggtggtggcggagcgggaggacgatagggcaagtgtgtgagcagaagcagccagagggctgggtctgtggctgccccctgaccacgtccctctccctgctcttcgtggcccagctctccctccggacggtgaactcctcccgctctgcctatgcctgctttctctttgccccgctcttcttccagcaataccaggcagccacccctggtcaggacctgctgcgctgtaagatcctgatgaaggtgaggcccttccctcagcagtggcactactccaccccaggaatctccaccagctgtgcctctgccctggggtactcagtagatgctaagtggggagagagacacgtgcaagcccaatccatgcaaaacacagggagggccatggtaaaagcatcacagcggggacctgagagggtggtgacgctcaagttcgtcaagaaaggtaagcacgtcttttggccgggcgcggtggctcacgcctgtaatcccagcactttgggaggccgaggcaggcggatcacgaggtcaggagttcgagaccagcctggccaacatggcgaaaccccgtctctactaaaaatacaaaaattagctgggcgtggtggcacgcgcctgtaatcccagctactcgggaggctgaggcaggagaattgcttgaatccgggaggtggaggttgcagtgagctgagatcgcaccactgcactccagcctgggtgacagagcgagactccatctcaaaaaaaaaaaaaaaaaaggtaagcaggtctttcaaggcattccaagcataaggaagagcatgaatgaggcctagaaggatgccagtgcccgaggtgacgtgggagcccttttcccagagttacatgctgggcccatgatgggtgtgggcctgcatgggacaggagagcttgttgcagagatgtgatgctaggctgaggtgtcttatcccatgcagtctttcctgtctgtcttccgctcactggcgatgctggagaagacggtggaaaaatgctgcatctccctgaatggccggagcagccgcctggtggtccagctgcattgcaagttcggtgagtgggcagccggccagccaaggggtgcctcagcagggaggtcggcgaggcccactgagaccctatcgcccatccaggggtgcggaagactcacaacctgtccttccaggactgtgagtccctgcaggccgtcttcgacccagcctcgtgcccccacatgctccgcgccccagcacggtgagcacacccctgccctcagctcagccccgggtctctctcttccttctttggggccccaaggggttgattttagaaggtacctctttcattttccctacagagtttctgtgaacctcaaagacatcccatggcccgctatgtgctcaggtccttacctggctctttaaaggcagacggtggcatggaggaggggcaggcgcctccttgctccattctccttactgttaggagcctgcattctccatcccaaaggtctgacttgactttctggctgctcaaacccattccaactcctcctctagggagcacatttctggcctgccaccaaatctcttgtctggcttgagtaaccttgaaggtctgcccataacctgtggctcagaggctcagaccccttctccggcctgggcatccttccagaggtgttccccattcaacggcagcctcttttcctgactgcccaggatcgaggagtccccaaggccagggcaggaggctggagggaggctgaataatcagctatggggtggagctgttctgggcagtccgagcactgggggctgtctggggccagggaaatggggactccagttgaagcaaacgtccctggcgaggaccagctcagagaggagtgggctctccccctgctccatgctggtcactgcttgcattcaagtggcccaaggtcctgctcatttctcagggtgactgaagatccctttgggtcctgacatctgtttccccaggttcttttgagccagcactgctcagagctcttttgggtagtgagagacgggggccaattccttggtctgcatttagggtggtgtcttttttttttttttttgagacagagtttcgctcttgttgcccaggcaatggcacgatctcggctcaccacaacctccgcctcccgataaaagtgattctcctgcctcagcctcccgagtagctgggattacaggcatgcgccaccatgcccggctaattttttgtatttttagtagagacagggtttctccatgttggtcaggctggtcttgaactcccgacctcaggtgatctgcccgtctcagcctcccaaagtactgggattacaggcgtcagccaccacactcagtctctttttttaaaaatgagcaattgtttctctcgttttgttttgagatagagtctcgctctgtcacccaggctggagtgcagtggtgcaatcttggctcactgcaatctctgcctcccgggttcaagcgattctcctgcctcagcctcccgagtagctgggattacaggcatgcaccaccacgcccggctaatttatatatgtttagtagagacgaggtttcaccatgttggccaagctggtctcgaactcctgaactcaagtgatccactgcttcggcctcccaaagtgctgggattacaggcatgagccactgtttttttttaaatccttgcgcaggggccttgctcatcttttgcatgcttcagttttagtgtatgtgctgccgaagcaagcactctgtctcatgaataatttcaaatatatgtaaaagcagacgcagctcccgtccccacttgacttgaaacaatttccagatgtgatttcatctgtatgtcaatgggtatccttagaggataaggatttcagggctctttctgaaggccgggtttgtagggtggcctgagtgccacgtcctgcctctgggccctctccctggtctgcatggtcaggtgccgcctgccaggtttgagcaaccactgcaaccagtcccctccctgccaccttctctgggcctcatccacggtgcgctaggcctgcgcacatccgtgcgtgtgcatgtgtcacccccacctcaggtcctccgagagcaaagccctgggcagggccaggcatttcgggtaatgctccaccctgttcacagggttctgggggaggctgttctgcccttctctcctgcactggctgaagtgacgctgggcattggccgtggccgcagggtcatcctgcgcagctaccacgaggaggaggcaggtgagggggctggacgtggcctgggacagcagagtggcaggtgggagaggggcggggcccaggttactcctgttcttccccaacagacagcactgccaaagccatggtgactgagatgtgccttggagaggaggatttccagcagctgcaggcccaggaaggggtggccatcactttctgcctcaaggaattccgggtgaggttcctcccaggcgctcgccgtcctgtcctccctgcccagctcagcccagcccggggcctcacctgctacctctttcctcccaggggctcctgagctttgcagagtcagcaaacttgaatcttagcattcattttgatgctccaggcaggtagttcccagccttgggacagggaagggctctgggatggcaggagctgaatgggatgacctagcttgggccccctcccctgcccaggcccgccatcttcaccatcaaggactctttgctggacggccactttgtcttggccacactctcagacaccgactcgcactcccaggacctgggctccccagagcgtcaccagccagtgcctcagctccaggctcacaggtgagggcacctccccccaactcctcctctctccatgtctgtgcactccagcctgagactgcaactcctagcttctgcacctccccgcaatgtgttctctcccgccccttctctttctatcaggccccagcccctaaccctatagtgctcacagctgccagccctgcagactcagccttctcggttagctgtactcagagacccctcccacccagggaagcatccccaaggccctgccagcttccttctctggctgaggccgcccctctgagcctcctcccaggccaaggagggaaagggctgctgggaggcaggagctgcctgggctgggggaagcaggtggctggaagggcaggtgggctggggaggatggcccagtgcactttcagcacaggaagttggggctggcccccagcccagcctgtccctgggctcctgtgctttccagctcctgtcccctgggaaggtgggggcttgggctccatgtggcccagttcataagacttgctgctcctccctcctagctgagctaaggtagcccccgggatgcctccctcaggcccctacctgaattctgatcaaagagattcctggcccaccccctccaggaagtcaccacttaacccctgcatcctctcctctccagccaaatcaggaagtcataaaaccaagagatctccagtggtcgggggccccagagctcccttcgagccctccaaggtggggccctgcctctgctcccccagtcccctccctgatactccgattctgcctacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaaggtagggactggaggtggaggcaggggtgggaggtagggaagggagcagcctccagaactcacttgttctctttccagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaatacaccaaggctccatgttccccgtgacaggtgggcctgaggggtcggggtgacccccccccagcatggcagcatgatttctgtacaatcaatccatcatctggggcacagggtggtgtgcgggggctatttcttggctttggcggaattgcggggtggggtgatgggtcggcctccagggttcaggccactgaactgcccgtacttccccttgttcttgtcggcgggcttgaggatctaaaagagacagtgttggtcaggctcatggggctgagccacagggcctagcggctcctttcttccccacactcacctggaaagagcacatgagggtctcgtccacactcatcatggcgccagcattgtcaaactcgccacagtagttgggagctgagaaaagtgtcaccagctgccgcttggcaaagaactcgtagccgtcttctaccacctgggcgaggatgggagcagtcagtcccgagcgcaggcacggccctccccttcccctgccgcaggccggagccaccagcccacctggtgtgctcggcagatgaggtccaagtcgtgcttgtggaggaacttggccaccacctcggctccaaaggtaaaagagacgccacggtcgttctcgccccagccctgcacgtccttgtcagggtcagaccacagcaggtcacacagcaggccctggtcaggcacatctgtgggccgcatgatccgccgaatctgctccatagactgcaggtccggggacaggcctggggggccgggggaaggtcacttcctcaaacaaggacatcctccctccaggaagccttggccaatgaaccccacctttcccaccaccctcctggtcccgccactggtctcctgggcgcctagacaggcagaagtcatccccttcccctcagctttttcaagttcccaaacaggcacaaaggcatccctgccctcaggagcacagagctcccgggagaaaggagacaagcccactccatgtaggacacacatcaaggaagtgagtgcagcccagcacagtggggtatgggggacacttcctggaaggagtgacttcccagatgagacctaaggagagctgccgggtgctgagggatgcggccagtgctcctcctccccagccatcccctccctcacctccgtggcagcagaagatcttttcgtccactatggccgcgatgggcaggcagttgaagcagtcagtgaaggttttccacagtttgatgttgtagcgtctcttgcctgcccagggggaggtggctgtgaggtgcctgcctaccccaccctcagccagggtccctgggctattcagccgtggctgggaggagagagtcaggcaccgatgcaaaccaccccccacccctgccacctgtcagccttccaggagcaattctagttactttttattttaattaaagaagacaggatctggccaggcgcagtggctaagacctgtaatcccagcactttgggaggccgaggcgggcggatcacctgaggtcagaagttcgagaccagcctgaccaacatggagaaacctcgtctctactaaaatacaaaaaaatcagccaggcgtggtggcgcatgcctgtaatcccagctacttgggaggctgaggcaggagaatcgcttgaacccaggagacggaggttgtggtgagccgagatcacaccattgcactctagcctgggcaacaagagtgaaactccgtctcaaaaaagtaaagaaacagggtcttgctctgtcacccaggctggagtgcagtggcaagatcatagctcactgtaacttggagcttctgggtccaagggatcttcccgcctcggcctcctgccagaagtaattctaaagcacccgagtccactggaaactaagttccaatctggaccagcctcagggttggcactcctcgcatgcccccacccatgagccgggccaagtccaggtctggtttatctcagcttctggacagcagagcccatctgcaaacatcctaagtgcttagtagcaaatgtagggggagtgtcaccaggcagggccctgggggaaagcactagaatccgggcagcccttcagtcagcaaccattccccagaccccatgccaggaggggcagggcaggcacgagaacggacctgggccccgccttcgtggagcgcacagtctatcaagtgtctgtcagatatcaggccaatgtgaaggtcccactgaatggcaaagagtgcggttcaggacccgggcagccccagacgctcagaccactcacactcatcgtagaaaccatagatgcggttgatgctggcacactcgtggttcccacggagcaggaagaagttctcggggtacttgatcttataggccagcagcaggcagatggtctccaaggactgcttgcccctgtccacatagtcccccagaaagaggtagttgctctcgggagggaaaccgccatactcaaatagtcgcagaaggtcgtagtactggccgtgtatgtcacctgtgacccagggaaccgggtaagctagatgcaaggtctagacctgaacccagggccaggactgcgctcaagggaggagggctccaggaactctgtggggtccagtgccacttttaggaaggcaaggggacctgggccgggggctcaccgcagatcttgaggggtgcctccagctccagaagaatgggctggctcagaaaaatctcccgggatttcaggcacagaccgcggatctcgttctctgtcagctgtacattcttgccaggccgcgagccctgcactggggcgcaatggggtgtcaggaccctggaccctgacaggaggagggtgggcgacacgggtggccccatggatacctccgggggcgcctaggcctcctcggcccctccttgcccacaggcagctgttgctgctgagcctcccgggaccgcggcctcaagcctcccaggggaagcccccagctaccctcagcgcctcgggaggcgactgtcgtgcgcagggggctgccaccaaaaacctcacagcgcaggaccccttcctggaccgggcttcccgggtttctccctcgccccaagagcccaggcaacccgtgcgcccccagcccgggagagggggggagctgctccgcgcgtcggagctggccccggacctctcaggcgcgtccgcgggggggcagctgcggccacggaacctcgctgcccgtccccgcccagtctaa

SEQ ID NO: 13233 - DNA, 12055 bp, Human
gtatactcagtggcgttaagtatatgcacactgttatgcaaccaatttccagaacagtttcgtctttcaaaacagaaattctacactcatcaaagaacaagtctccatttcccacccccctgcccccagcccttggcaatcaccattctgctgtcttttttttttttttttgagatggagtcttgctctgtcgcccaggctggagtgcagtggcgcgatcttggttcaatgcaacttctgcctcctgggttcaagcgattctcctgccttagcctcccgagtagctgggattacaggcacgtgccaccatacccagctaatttttgtatttttcgtagagatggggtttctccatgttggccaggctggtctcaaactcctgacctcaggtgatctgcctgccttggcctccaaaagtgctgggattacaggtgtgagccaccgcgcccggccctgctttctgtctttgtgaatctgactactctaggtaccttacataagtagaataatacagtattttcctgtatgtgactggtgactgttatttcacttagcatattgatgctttttttttttttttgagatggggtctcactctatcacccaggctggagtgcagtggtgcgatcttggctcactacaacctccatctcctgggctcaagcaatcctccagcctcagcctgctgagtagctgggaccacaggcgtgcaccaccacaccacctaattttttgtatttttggtgaagatggtattttgccatgttgtccaggctggtcttgaacttgtgagctcaaggagatccaggagatccacttgccttggcctcccaaagtgctggtattagaggcataagccaccacacctgccccatactgatgcatttttacatgacattagtgaattcaattagcctagtattttatttagaatgtttcatatcagctgggcgctgtggctcacgcctgtaatcccagcactttgggaggccgaggtgggcggatcacgaggtccggagattgagaccatcctggctaacacggtgaaaccctgtctctactaaaaatacaaaaaattagccgggcatggtggcgggcgcctgtagtcccagctgctcgggaggctgaggcaggagaatggcgtgaacccgggaggcagagcttgcagtgagctgaaattgtgccactgcactccagcgtgggtgacagagcgagactccgtctcaaaaaaagaaaaacaaaagttgttttagccccaaagtacctcatttctcttttcttttaatttaattttttttttttgttttgttttgagacagcatctcgctctgtcggctagcctggagtgcagtggcacgaacacggcccactgcagcctcgaactcctgggctcaagcgatcctctcgcctcggcctcccaaagtggtggggttacagggccaccgcgcccggcgctaaagtacctcatttctatcattcatcgattattccctaatattaattgggcacaactatgactcatttccgaccccgcaatgggctctcttggtctccttctccacctttctttccctcttcctctttttattttttgaaagaggaagatccaggatgcaagagtcccgacaatcatactagatatgcgaaagagaaaaagccggaagaaaatacacaaaaatcataacactttgagggtgtggcttacgggtgttttttttttttttcattttcctaactctgcagtgctgttatattccatccacaacttcaaacaaagtgccacacggccgcagtcccaatcaattcaatgacaattgttagggacgtcctcgtcccgcccggcccgcggaccccggcccttcctccttgacaggctggggtccagccccgagacattcctaggctccgcccccgagcagacgcgcgcgctcagccccagcgcagagaaccaatcaccatccgtttccacgctcagtcccttttggcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggttcgtgtctaccctacccttctccccctctgcggcgtggtgcgcatgcgaggcgggaggaggccttaggcgagaggttgcgcatgcccagagggcagcgtccactgcccctaccgctcacatgcagaactcgacgctgattgggctgaatttaagtagggggtgaattcgggcctgtctgccccgccccctggctcggccttgtagcagcattggtgggggaggccgtcagtcatcacaagcgggttggggttgggggttgatctcagtgcttgggcagaccccacgctggaggaaacccagggccgggagtggtcctcgggtatctgggtttcaaggctcatgatcctttgtagatggaagggccttctgaaaacacttagaccaactgccgctgtttagagtggaaaaccaagaccctgggacgtgcaaagccggagaacgggcccagaggtcaggtctcccagacagggactctttagcagccttcctgctgcactaggggcttgttgggacagatgagggctgggaagtaaagaacctcccacttttctcctttttgccaggcccccacatccagcccctctgcccgcttctcccccaacctacaactccaggcttccctgcttctcctgtagttgcctcctcccggagtgcttttcccagctgccacttgtttgcagagtagggaacctcccaggggcagcccctgtgcccagcagagcagtcaggcaggacatgcacattgagcaaatgagcacatgccccctggccagcaccgtgccgaatcgggcagctaagcatcctagcccagtgcagtataagtgccctgagagcagaggggagctgcatggctggagtgatccgctgtatgaaaagatatcttctctaagaagagacaggatgtgtggtgtgggttcatgcccccatgtgctggggggttggtggcgttggaagaaggggctggcaagggggatcctggatggaacagacatcagaaggagagatgtgaacaatggcaccccaagatcagaaacaggtggtgttaaataaccaatcgccagcactgattgagtgctcactattcgaacattgtgctacatgcttcacacgtttatttcctacaatgtgagataggtactgttgttgattccgttttaccgatgtggaaactgacttcagagatgcagcatggtgcggcagttaagagcgtgggctcctctaaccatatcctgtcgagagttcaatctccaaacctcttttctctgcacccacccccagtgttatctctaaaaactctccctgcccggattactcccagatgcagctctccagtcattaactgtctcttaaacctgatatatagctccctactcaccatatccacctggaagcctggttggcaactcacacttaacctgctccacctgaggcttctccgtgtcaggtgaaccaacaaccttcccgttgttcagggcaaaaaccttagcatctctgtggtcctcccagtctcacatccaacatcacatcctcaatatccagccaggatctgagttctcaccacttctgccatcactgcttgggtccaggccatcctcatctccagcctgggttactgcagcgacctctaactctcctgcctcttttgtccctctgtggtctgttctcgtctcagcagccgagcccatgccagattcaattccttttttgctcggagccactcagtggcttccatcacagagtgaaaaacagaggcctcaccatagcctacaggccctgtgaggtccacccctactgacctgggtgagctcccctgctgaccctgtggtgtaccccaccccctccttcactctgctctgccacactggcattgctgctcttgaacacatcatgcatttgaaacgggaagttcccttgtctccctcgcagggcgtgcgatgggggagtggctcgcttcttcagtgccccgctgctcagacctctgggggagcatacagatgggcaggctgtgggctccgacctcatggcagtgtctaggggtgaatatttacagctccgtgtgttctagggtgctcttttagtttgtctatgggaggcttgtgttaaccagctcaattagacccccttccttatcacaaggacagagggctttctgtagtctggggttttcttgccttgatgtactggagtactggagaattagatcacttgtgggcttggagaatgattgcaaatttttttttattttttattttattttttttttctgagatggagtttcactcttgttgcccaggctggagtgcaatggcacaatctctgcctcccaggttcaagcaattctcctgcctcagcctcccaagtagctgagattacatgtgcctgacaccaggcccggctaatttttaaaaatgtttttagtagagatgggcttttaccatgttggccaagctggtttcaaacgccttttttttttttttttttgagacggagtcttgctctattgcccaagctggagtgcagtggcatgatctcggttcactgcaacctccaccttctgggttcaagtgattctcctgcctcagcctcccaagtagctgggattacaggcacccgccatcatggccagctaatttttgtatttttagtagagacggggttttgccacattggccaggctggtcttgaactcctgacctcaggtgatccacccgccttggagatggtcttcccctggggttgggccacttggtggccccacctctcctctgactgccccagccaaactccgcctcttcctgccagttgatgacctgccagcgtgcaggtgcctgtcagtgtgatcttctgcttcttgctcccctgacatcctctcaatgaccaggagctcgtcttctgctgatgggctcctctgacatctggctgcctgtgggtctaccccctaggggtgttgggtttttataggcacaggataggggtgtggcaggccagggtggtcttgggaaatgcaacatttgggcaggaaatgcctgttctcacctaggtctgtgggggtggaaccctacccagggaccacgccctcctctacccagcacttcccttctccccttccaaattatttaacaggaccatgctcctcccttcccagcacttccatatcacattgtcccactgcaaggcttttttacacatgctgttcttttggcctagaaagttcctatcccagggtccacttggcttgctttcttccttactccccaaccccccactctgtttaatccagccccaaccctcttgccctgctgtttcccaagcacgtggcttcacctgccatgacatattgttttgtttgatgcccatctcctccctctagaagcgccatgtgagctccaggggggcagggacttttttgtgttttgcttgctgccatgttctggtgtctagcacagagcttgggcacatagtaggtgcttagtaaatatctgttgaggaatgactggagtcagactgcttggactcttgttcccactcagccacccactagccgtgtggcttgggcctattcctcccctccttgtggctttgttttctcaccagcgtgggaggatgaagccaggtgtaaggtcaggtggtgtccccggggaagccccgtcccttatgccgtctgcaggccggggactggacttctccttgggggtcagggtgagggtttgtgcctttgcctgacctcgcatgtggcccacaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaaggtgtctgtcctgtacctgtctgcggtggctgtccagccaagccctattcctattccctatccccagggctcctcctccctccaccctctgctagactgccacccgctttctttttttttttgagatggagtcttgctctgtcgcccaggctggagtgcagtggtacgatctcagctcactgcaccctccacctcctgggttcaagcgattcttctgcctcagcctcccgagtagctgggattacaaacacccgccatgatgcctggctaatttttgtatttttagtagagacagggtttcaccatgttggccaggctggtcttgaacacctgacctcaggtgatccacccgccttggcctcccaaagtgctgggattataggcgtgtgccaccgcgcccggcccacccactctttccagaccaccacaccagcctgctgatggcgtcctggcctccattccgccttcccctattagccagactgaggccaggggactcgttctcaaatgcaaacgacctgtacatccctttgtttcaaacctctatgactcctggtcactgtaaggatagagcacagggggtcctcacttcatgttgctgatacattcttggaaactgtgactaagagaaaaaacatacatcaggttttttctcagccaccgtcatttctctcagcaaaattttgttagaacattgatgagaagaaaaattggtttcgttatgtattgtttcgcctacagtcacagtttccaagaacctacttaggacgttaagtgaggacttaaaccgtataagctatagctgctcacatagctttttgggggctggcccctgccgtctcaccctcttactcaacctccctgcttttcctttccattccccttcttagccaagatcttccctcttccttcaaagcttattcctgggtcaccacctctaggaagccctccctgactgctagtggttggctcaactcccacgtttgggtcctccaaccctcatgccctgcatggccaggatctgctcttctgccttgtcctaggctattgcagagcagggatctggcctgtttacttctagctttgggatgcccagcgcgagccagtccagagccaagactcaggaaatgcccgctgatggcagcccggcagtcagcccctgtccagacaacagggcagtgggaggagtggggaggacccgggtaggaggaatctggttatctggttcccaccagcctagcagctttgccaagcaagagattagaggctaggtcccctatgcctgtctccctgtggggtttttttttttttgactaagtctcactctgttgcccaggctggagtgcagtggcgtgatcttggctcactgcaaccaccatctcctgggttcaactgattctctgccttagctgcctgagtagctgggattacaggcacctgccatcgtgcccggctaatttttgtattttagcagagacgcggtttcaccatgttggtcaggctggtcttgaactcctgacctcaggtgatccgcctgccttggcctcccgaagtgctaggattacaggcgtgagccaccacatcccgcctccctgagggttttgaagtggctggcctgggcccagctctgaggtaggccctcagtggggtgtgggtggggcagaaggaggagctgctgggaacagaatgtggggggccccagttctttgcataatccagcaaagggccttatcctctggagggagaggaggtaagaattctactgggcctgtaaggaccagggagacaggggttgatggtaggcatgtgtctgtggtgggggtgaggagggggttaggtgctctgtttggtggccagagaatgtggcagaagctggggcttcaccaggagagagggctgagcgactggaggagtcctgaattaaaagcctcctgtgcttaaacggagtagggtcccagttgtcactctctgggccttggtgtttgttctcagatggtggtggggaagggggctgggccttgtggacccggtgaccagccagcccacggtgacagagcccccggcgcccttgccttcccgcagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtgaggggccaccgcgcctggtctcaccaggcccccactgcccagcctcagggcggcgctggcctgtccacccaggggtggtgggatccgcaggtggactgctgggggagcggacagagacaagaaaacctgtgcaggacccttggcagtaccctgggtctcctttcctcctccttcacatctcaaatgtcacctcctccaggaaaccggccctgcccacccggtctcctcattctctgtctcgcagcagctcatttcctttatagcctctgccgcaccttgaagtcccttggaattcatggatttccttgtccatttagggaacctgccatgcagcatgatctcttcgagggcagggcttttcaccgtcttgttcactgttctattcttagcacttggcacagtgctgggcacacaggagatgtgacatcgatgtttgtttgatgctttttgagtgacaagtagctctgctgctggtgtgtgatgtctgggggcccagccagcccagatgtgggtcaggtctgctgctgacggacgcagctgtggtgtccccgagccccgctgtgatatgccccatgccctgcaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggtactgcctggaggctgagggggaggatggatggaggggggtgtggagccagggggcccaggtctacagcttctccccgctccctgcccccatactcccaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacggtgagcaccgggccctgggctgccgggggctgcgagtggtcagagagtggcctttctcctgtcactgctggggtcaagacctagcctttcacaacccccattctgagctcccacgggggcctgactaaatgcctctactcggcagggctgtgggccccattgtgccaatgaagcatgaatggtgtattgggggtggggtggcatcctcaggtcagggagggctctctctcccctgtgggcccatggtgccaggagacatgagggcaggcagctggccaggatcccccctcatgcccttgcatgcccactgcccactggcctcccctgcagacaacgtcaaggcctacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctctctgagtctgctgagctgctccactgggagagccgggtcatcacctggcattcctggtacttgggtggctgttgggaggcaaagaatcagggttcaaatcctagcccctccacccaccagctctgaggctctggtgtccctgttagagaaattacgatgagctctttcaccaaggaagtgtctctcgctggccagggctggggcgccccaggagcccacagtcttaagggggagatgaagtgggtacaagctaggtagctgggcacctgagggaggtagtctcctggtgctgccctcccactccagcctcggatcccatggtctcctggcctcggtgtctgggggcagggtttccatgagaagctacgctggggctgaggtgagccgggttgggctggggtgggctgactgtccagaaagaggagagggccgagcgcttcgtgagaccttttgaggcccaggcccccatcctgacctgcctgtgacatggatggccctgggcgtgggtttcgtgcgaccttttgaggcccaggcccccatcctgaccctgcctgtgagctggatggccctgggtgtgtgttggcctctctgtgcacatcagtgtcccctgttgaactggaaactgggctggctgccctgtgatgccaggcatggggtgagtgggtggggtgcaggtggcgtttattttcatggatttatacacactggaaaagcctctgcgcccatgcccacgccctcctccctccccccggcgctgggtcccctcatatgaaagggaagtaacaccgaggagcacacggagatatagggtgtggggctgggggggccagcgctggggccaaaagtctgggtccccagcctcccacacgcagcccctcgggccccttgggtgtgtcaataaataacccaggtccaggctggtgtgggcctcactcctcgctgtccagcttcaggctgatgctccgtgctttgccccgtgccagggtggtgggtggtgttcccgggccctcacgctccgcctggctggggcccctcgagcgaagcagctggctctgtttgcgcaggaagtccacgggggcagccacaccatagctgctcttgcccaaggcagctctcgggggtcccgaggaggcatgcgagtgcgagcccgcttccagctggcccaggtgggccacatagccgtctgacaggaactgtgggcagaggtaggcagcgatgagggggtgctggccaagggcccacacgctgccctccacggtcctccagaggcacctgaggcaggctgggggactggtggcaggcttggcacagcctgagctgaagccttctcaatagataggaccccaggctgggagccagggcaccttggctgtgctcctagctctgcccttctctgggcctcagtctcctcatctggaaaatggggtcttagaggaaaaataacagcagccaatgtttagccagcacttgctttgtgcccagccctgtgcctgttgatgtgatcttcataagctgacatgggcagtgccatgatcatttccatttacagatgggaagctgaggctcagaaaggtcacagtggaaagccatggccgagtggaaccagcgcctagggtcttgagcactttccagtgtgggctgtcccctctggcttgcctggcagctggcagctcaagctgctcatggcccttgtcctcggaggatcccaggttccctggaggccggttaggccttctcacatcttccccagagtccgtggttcccaaggcctgggactgagggccctgccccctggtggggtcctgttcctggccttcacttgggcctcacctggcactgcgcctgtagcttccgcacggcacggcccacgatgtaggtctggctcggggacagccccagcgccgcgtatacagccacatctttgggagacccataaccggccacgatgttcagttctacctgtggcgggagatgccaatcagccgccccaggggtggagc

SEQ ID NO: 13234 - DNA, 25431 bp, Human
  misc_feature (1)...(25431): n = A,T,C or G
ctcaaagggcccgccctttccccaagacagagccaggctccttagcctggcattcaaggcccccactctggcgctaacgctgtccctcgcccagcccatctacccgggctcctctcctctttctgtggaggactccctgccctccccagggcctctcactccagaactagcggagtcccctcaccctcaccgggcggcggactccgcccttactcctgggcttacttgtacctggccaggatgccccgcccaagcaccgcctctagcgcggctggtcccgccccaaggacgcccctttgctccaggccccgccccggggtcccgcctccaccactcgggccaggacctggggcccagccccgccccgcgccccgcccacctggagcccgtagtcgcgcgccgcctcccacacgaacttcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactggggtcagcacgccgccggccgctgtcagcgcgaaatccacgcctgcgccgggcgggaggcgcgagctcagctacggcagccaccgccctccagcccctggccctcggctcccggccccggccccggccgccctcactcacccaggaagtccgtgtgcgcccggcgcccgccgcgctgctcggcactcaggccggcctccagagccagcacggcggccagcgcggcctcggccgccgccttgacgcgctgccgcacagccgccacctgcgcctcctcgcccaggccgcactgggccagcgccacctccagcgtcctcggcagggagttgtggtgccgtagagggcggtccccgcggcccacgccgcacaccacctgggcagggggagactcagggggaggcccacacactccctgccccccacgcacacccccaccgccttgtgccaaaattcagaccagacccctcactggacattcaagaagccccgtcctccaacgtgtcttaaattgcacacgagctctccctgccactccccatctggtccccagacctctccagggattctacctacccaggcttccaggcccagctggggtccccctccaggatggctcctgcagccctgggggcctgggccaccctggtgtgccccaccctagcatctccctggggcgcacctttccctaccccactggagctccctgagggcagggtcgaatctctccctctcagtgtagcctagagcggggtactcaggagggtccgtaagccttcctgactctccagcttagaggcccctcctgaaggcgtccaggcactagaggtttatcaggaggccctgggtcagcctctacgtgggcaagagctctctgggaagacaattcagccccctgggccctggtactacccagcgtggggctgagcacaggggcaggggctcttggtgtgggagggattctggaagggttgcaggagagggaagacggtcagacccagtagtttccccagaggcaactacgacccccctaaggattttgtcctctctgcccagagacggctcaggggcccttggcaaaccactactgggactgggctggcatgtggcaggcagggtcacagcctgggcctgggccacgctcaccttgctcagcagtggcctatcaccctgtgtccgacacaccacagcacagattcgcacggccaggccggggccgggtgaaggaccatctgggggaagacggggaggtctaaggccagcacagagtggccagaaggccacaccaaactcccatccctggtcagcccaggtggctctcacctgagcagggcagctgggcaggtgggtacacagcctccaccaggacactctcctcctcctccagcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccaggtactgcagggtggggcacttccgccacaggagccggtgagtaaactgaggcaaaagggcaggggattgccccagagatggggcagggcagcggcagggctaagaggtagggacacctttccagccagacttggtaaccgtgcctgggtcccatcctgctggcatctgtacagacctcagggtgggcgagagtctgttacctgcaggatatcacccagggcctcggagcgcagaaaagcctccacttcctctttcaccagcgtctcctggccctctttgccactcagctccaccagccgtagccctaggctggcatcccctccccgcagcagccccggcggcttgtaggtgaaagccagggttgctggcacagccacaccaccctgctgggccagcaactgccttgtcagcagccggtcctccagcagccgggccagctcagccgaagctcctgtggggcaggtcaggtcacgggcgagttctgctgcctctcggccccggccaggccccaggcccaggcctgccaaaaagtaggtggcacggcgcggggggacaaagtcatccaggaatgtcaggcccccagggtggaagctcacagccttggagactagcagggctgcctcacccggctgcccgggtgctggcaccttcatcagccaagcaggggacaggcaaaggagcatgtttcctgtgggcagagaaggcaagtggctggccagggaaggcttgatgccctatgcccgggcccccgggtagcggagtggaagcagctgatcccagaacccatccccattcagcatggcagctgctccggtggaatgcaggcagttgccagggttggcgggtattttgggatgtggctgggccagggcagggctgccctttctgtagaaggggatggggaaacttgagcatacactcacccgggctctggaccccaccctccagcagcacaggcagaaaggtgctgggggagcccagaacgcacaaggtcacctccgccccaggacagcctcgggaaagagaacatggcccagctcaccaggggcgcccttgctgtctctctgcccaccttccaccacctccacacccacggccccaccctgagcccccagagttttcccaggaatcggatgagacaggggacaggcagggaatggaggtgcccgccagtcctgccccgtgaagctggtttcccctttctgcagctgttccagaggtgctgtgggctaggtgactggagacctgagttctagcccgagctctgactttctgtgtaaccttggaggagtcagtgttcctccaagcctcagtttccaagtttgtacaatgggaccaagtctgtgattctcaggtattctgcctgtgaaccctctgtccacacaaagtctgatatatgtaacaggcgtggaggggcagaaggggaggagtctggggggtctcagctgctgagctgcctccaccacagctcccaagacctttctctagaagcttcggtgccacacaacgtggtttcccaatcccagggctgggtctttttggggagggggtgagggcagggagcccaatccttgacctcactggtgccagatgcccttgcaaacaatgtccgcctaccctaggccaactggctgtgccttccctgccttcagatggaaccagagcctaggggaaggggccgaccttgacagggatgagcaagcagactgggctgagggcccctccctgcccccagaggtgcctccctccagggagcccttgggcacctgtgcggggcacctggccgcggtcctgagtctccggaaggccagcttgctgcagacagctctgcaggaggctgtagtagtagacagtccaagcccgggcctcggccccctcgggggatcccttgcagtccaggcccacgtcctggcgccaggagccagggaagcagcctgtgggcggcaggccagagccccctccccaggggccctcttcctccaggtccttggagcccagtgggcaatcccactcgggacccgatggatccagggagagctgagagggcagaagtggtaggtcttgggcagggtgggccagtgggcacattaagtcacccaagggtgtaagccccccactctcccagcctgggctatgttcagggctgacaccgtcccggggactaggagaggaaaggcttgtgttgggggcgaaggcttgttaatgggaacgcaaccgtgggagtgctttgtaaactgttctgtgtggtgcccctggggggagggcaggaagcaatgtcttgccagccagcccctcccgcccctgccatgctgggctccgccttagcttgcttcacagcagcagagttttctgcttgttttgttcatggaggcaaccccagcacctaaagcgtgcctggcacacagccacttctcagtaagtgtttgttgactgaagagtagatgaatgaacgaacccagccatcactctgaggtggcttatttctgtctcatgacccggcatggagtgtgctgacacctaaatgtgattccactgtcatccccacgtaggtcttgaagccctactgtgtgcccagccctgggctaaacattaggaggctagacagtatcccccctgcagatattttgagtcacggaaatgctttctttggatgaaacctaacgtccctcccctctctgaggctggcgcccccccaatatggggctgctgggaggcttcgtgtgaatggaattcttgttctttgcagtccccaggcctggacaggcctggcagctgagtctgtcctccaggggacaggctcggccaccttgagcaagtcgtgaggtctctttggaccttgttgcctggtgcctgccctctcccatcccctgggggctgatgaggctgggacgaagagaatctcttggttgttgggagatggtgtgctgtggcccagacggcagaggactgggcctcatgcctgggctcgaatcccagtttgccagggccagagcctctgtgccgtctcctagaaggtgagctccctgaggggccatggaatgaatgaatgtcacagggcactaagagtgcccacctcccaggatgcagccgcagggtgggggtgggggagctggtcgtgggtctaagctgtctgcagggggcaactcccaggcttaggtcctaggtgctgcctgctgtcctctgggcccactctctgcccagggacttgggccttgtgggggagggaccacagaagactcaccatctcgtgggtggagtggctgagagactgatggcagagacagagggacagagagacgaaggagtcagggcagccaagtccctgcctggccttccagcccctagactttgggagtggagaggtggccgacacctgtccctgcagagagaggccaaggcagccccacccccaccccgaaggtagggagggatttctgctgcccagaccgagtggctcctgccccagtgcggctcacaggtccttcctgccctggggtccgggcttggctctgcccctccagcgcgggggggagttgggggcaccgggtcccgggggtggggggcgtagcgtcgagggtcccgccgcggggagcgggcgcccggggtcctcgtccccgcgactcctgccccggccgcccccctccctggctctccctcggggcggggccggagctggggtacctggcggcggcagcggctcggcgggcgtggcgggcggattcggaccgggcgggatgcagcggcggcggcggtggcagtggcacagcgcccggcccaagcggcgccgctttatatagaaacgcctggggcatgcccagtgcccagcgggggcggcgcggggcggacggaccgacagggaccgatagggacccgccggggacgcgcccccccccccccccgcccgtcagccacgaaaacgtcccagacctgggggcgtgtggcgggacacggacccagcaggaggagggcacggagcaggcagggagagacgggggtcttcagagacacagaggaagtcccgacagagggccaggtacagatggacagggactgtcgtcgagggtcacagacgtagggctgccatgaagaaagagggaggcccaccatggagaagagatggaaaggaggggcggggagagccggagcaggcagagactggtactagggcccgcccttaggggtggggtgcccgggagagcagcctggagcacacagccctgagccctacctttggatggaggccggaggtcccagccctgcagctttctgtcccagctgccagcgctttgccctattgcacgttctcccagagaggccctcctgggccagggtctccacacatctgtgcagccccctcctcacttctggacccagtggacttgcacacaggggccaggatgtctataagatccagcctctcctggtgcggtggctgcctataatcccagcactttgggagcctgaggcaggagaattgcttgaacccaggagtttgtgaccagcctgggcaacatagcaagaccctgtctctacaaaaaaaaaaaatttaaactagctggttgaggtggtgtgggcctgtaatcccagctacttgggaggctgaggtgggaagatcacatgagccccgggggtcgagactgcagtgagtcctggttgtgccactgcactccagcctgggcaatacagtgagagcctatctctctcgctcgctccgctttttttttttttttttttttttttgagacagagtttcagtgtgtcggcccaggctggagtgcagtggtgtgatctcagctcactgcaacctctacctcccaggttcaagtgattctcctgcctcagcctcctgagtggctgggattacaggcacacgccaccacgcctggctaatttttgtgtgtttagtagagacagggtttcgccgtgttggccaggcttgtcttgaactcctgacctcaggtgctcctcctgcttcggcctcccaatgtcctgagaatacaggtgtaagccactgtacccagccgagaccctatctctctctcttttttttttttttttttttgaccctatcccttttttttttttttttttttttaagacagagtcttactctgtcaccaggctggagtgcagtggcacaatcttggctcactgcaacctccgcctccccgggtccagtgattctcctgcctcagcctcccaagtagctgggactacaggtgcgagccaccatgcccagctacttttgttttgttttgttttgttttgtttttgagatggagtttcgctcttgttgcccaggctggagtagctgggattataggcatgcgccaccatgacagctaattttgtatttttagtagagacagggtttctccatgttggtcaggctagtctcgaactcccgacctcaggtgatctgcccgcctcagcctcccaaagtattaggattacaggcatgagctaccgcgcccagcccacccagctaatttttgtatttttagtggagacggggtttcatgatgttggccaggatggtcgcaatctcctgacctcatgatctggtcaccttggcctcccaaagtgctaggattacaggtgtgagccactgcacctggcccccctatctctttaaaaaaaaaaaaaaagaaagaaaaaagaagagaaaagaaaggaaaagaaatctgctctgcttatcaacacccacccaggtcaacttcacacccggagttgaagctataatctccccaagacatacatactcacacccaagtgtacccacccaaccacagaagcataccccaggagacctgggtctcagccacaattcacccacagaagcacaaccagagattcaccccctctcctggagtgtgtcccaccagtgggtttcaatcctagctctggctgtgggacctgggcccctcccctttgtgatctgaagctcactctccccagcctagaatggggctggtttccctctcctaggcagggcagcctatggctctaactcctccctctcacagtccccagtcagcccttctccctgcctgtctcgcaactggacacatattgagccctggctgtccttgagagcctcctggcctgggggagaatactgaggggcccacacatgtcagggacagagatgacagctgttggaccctttctgcaactatatacagggcagtctgtgcagacccatccctgtctaccactggagagggtcggcagagaggggaaatggcttctccaggatgcccagtccagcccacattccccacacaacttccaggcccacgtgcagccctccctacagctggtccaggctccaggaatgaggaaccagccccattctaggctggggagagtgagcttcagatcactaaggggaggggcccaggtcccacaaccaccccaggagacccaatcgcttgccacctgggtggcctgagcgcccatggggtcccactgtggggcctgggcgtgatccaaagagcatgagctttgacatttaacatttaacaagctctgcagccctggggactcagttttctcatcttcaaatggggatacagtgcacactcagcccaggcttaacacttcacatgcaagggagcaattatgagactgagagaggtcgtgtgacttgcccaaggtcacacagctggtgagaggcagagccgggatcttctgccagaatgcgtgcatgcatgcacagagtgctgcggctgtgccctctcctaggccaccctgtctggtccctggctgctctggcttttgccttgtggatacagggaggaaaatcagagttgggcagctgcagcccaagctcaggatcctgggacttggggcaggcaggtgggcgggtggttctgctctgcccctgccaggaaagcctggacatcacctgaggctaggtaggggtggggtgaggagaggcagtgctttggctgctgtcccgctggactgaacagtcatcatcatcatcatcatgagctggtagagccctcttgaggctggggtgggggctattataatcccattatccgcaggagaatactgaggctcagaggagaagaaagggcctttcccatgcaggtgagtccaagtctgacccctctgggagcctggaacagtgtgggaattcagggaacctcaagtgggtggcagggcaagatggagaccgtgggtcctccccgccgatccatggcaggcacccatttgtcctgctccactcctttgcatgcccccactcgtgtccactctgaggcaggctgacagacatcccaggggccctcccagcttcagtccccacacactgagtcctctcagatgcatcacttcccttctctgagcccccttccaggcagatctgtagggactttctaggttcactgagcatgtttgtgtaggttgctcactgcacaaaggcacctgggagagagatcacaccccactctgctacaccgtgcactctggtgaggctgcatgttgcctggaggagagacgtctttccctagctggcaaaaaggtgctgtgggggccggtgcagccctgcggaggagagcctgtgagaacgcatgtgtgcgagggttcacacccggagggcactgggcctcttctgtccagcctgtgagttagggctcccatgcaggtgactgataaggaaacctacagaagagctgcccagaaaacagtctcctgagtaggaaaggcaatgactgagccccagctggagggacgctgctggagaccaccggctcctagggtctgtgtccagggtgagccactgccaccgcgcccccgcaggctcatgacagaccctcggcccagggctgaggctgctgcaccttgctcctctattctcccaggcaaagagctgaactgtggagggcggggagctcccaagtggatttcagggacaagtgccccctgaccccggccaccctgcccgctacagtgcctgagattccaccaagacactcctcgtctaaggataaggcatagtctacacagcacagagccttgcctctgcattccagccggctctgcctttcactgtgggcctgggtgaggtccttgtcctcactaagcctgtgtctctaacagggatatcaggggccacctgcagagagagggcctaggggcggggggtctgggaaagggttttgtaaactacaggtaaggaggctattattaagttgcaggcaccccagcggggtaaggaggagtgggcagaggaggctctggagcgcgctctaaatcacgggagtctggctattgcctcattcacacactgaggggctggtgcaggattgggggtagagcggggaaggagcaggagaaagcactcccagggggctgcccaggggggagctgccagtggttggggcagggctaaaccttgggtctgctatggatagatagtaaggctttctgcaagttcctgctcctcctgagcctcagtttcccccggagaaacgacagataaggaagggtctgggccgccatgattccctcttccaggggttaggctccttgggagtaggacaagtctgcccaggacccaggacctggcacttgccacatagacgcagcctgtggccctgtcgcaagaacattccaaacccagagtctgacaggtgactccactgacaccccacccaatggccacccctggagcctgggcctgcagatgcctcccatccatatggagtcctgccgtgttccccatcgaagggagggcacttgggaatggacactgcgggacacacgcctgtgtcggaaccagccctgttgccctggcgatggctcaggtcctgggcacccacgggggctattagtgagtgtgggagggggtttccatggtggcggtcccgagggggcagacgcagggcccagggaggggtgagggctggcgggacctttctcctttgtccgaggcacactaggcctttgttcttgcctggatccctttgacagatgtgactagaaccatgggtgcggggaggacttgggttagagtcccccatcccagcgagtactgaaccaccctggagggaggggaaggagggcagaagagggggtagagcccctggactcgccatccactggggcgccctcctcctgcaggtgcaaaagccactcctgtccccagaggctgggcagggcaactttcaattggctcttattactgtaaacaccttccccagcggccagtgggcagcctcggtgtgtccccagggcaggaccaggagagggcggggctgggaagggcagatgagggaggaggggaaggggctgcctgtctggggttgggaggagggcatttgatccagcgccatccaaggcatctgttcaagaagattttattcctggtgccctctggggtcccttgactcagccaaccccttccctgactcctttggtgctggctttggtacttgtgagggcctgggcaccaggacggttccatgggtcctcacgtgccccactctgtgaccctcctccatgctagtgcctgacccagtatgtaccacggaggacctcctccttccccactgcctggtccttgccaggaaggaagccaagtccccgagtcccaagagtaaagtgcggtgcctatttgccgggctggcatcagccatcaggcaattgagactgggggacactaagtccatggtcctctcagaagcgggtgtccaggaaggaggtggagcctcgttggggcctggggggcccctcgatgggggggccccgggcccgagtcaggagcccatggaaagtcttgccgcgggtctggggtttccgccgcggtggtctgggctcctccgggggctgcaccacaatccgaggcacctcaggcttggcgcctcgtcgcactcctgccagctgctgggcctcaaagatggcttgggccccggcgaggcggacctgtggccggggcgggggtcccggcgcggaatcgggcagctgggccagctgggccttgatctcccgctgcaggtcccgctctgacagcaccacgctgtgcacctgtggggagcagttggtgctgcgtttgcccggcctcaaggcaggaacaggaaactgtgaggtccccagcccaggaagtggctgaggactgaggggctgacagcctcactggggagccacagaaagccactggaggcctcaggtttttgtgttctctgaagctcaggggacaggaactaagtccccattctcgctttggcttcctgctctgggactcagtttcccccgtgcagcaggggctgggcaagtccaaggagaggtgggggtacccacctgtgacatgaaggcctcctcctgcagctgcgcgggggggatggctcgaagggctcccagtgtctccaggaggccagggcaggcccctcgctgctctgcagtgcccagcgccaggcgcaccagtgtcagccccacacggaacagtactctggcacctgcaggccgggggcttattcactgggaggccggccctgcccctccacagttctgcacccaaacctgccctcagccatatgcctcccactctcctgcagctctgccctccccggttcaggaacaatgacagagggtggagttgcatttcgggtaacacaggccgctgtactggccaagttagcctcaagagccacagatgctttggggaagagttactatcttgtgaatttggttactgtcgcctcccatccccacccccgccaaaatgaaggtcttgatcacttgatgctcagatgccatccatatctggagccagcaagcacccagcaggtgcctgtgggctccggggaggagcacctcctaccctccctgagccagtcaggcctccatgtgctatgatcacccagctcctaccccaggcagcatccgggtgacaggtgatgtgccaccaggcacagggccatcaccttcagcacacctggtcccatgactcgaggctccaaaagggaaccctggagctggtgagctagctccctgtccacaccccaaggctccagtcccctccaagccaccagcttcctgccaggagcccagggctactgatgccttcacaccaagccctccctgggcctcagcttgctcatctccatgatgaaaggtcaggtggagccctttaagggcctttccaacttggatctgtgaccctctgattctagaaagatcctaggcagaactgctcttccctaagccaggagcatagcactcagtgcacactccccacagtgtgagtttgggctagtcctggagcctcaaaattccttcctggcagcctctgatctgagaagagccaccaggggaccagcgaggttgagtgatgatggtaggaacaatcactattcatactatcgtccttctgataaagggagcctgtgtagtgtttgcccccaggtgggcaggtcaggccctgcccagctctgcccagccctgctctcgaggtctaaggctggttggaaggtgaccgcatggatagcgacttggacacctgtggccagaactctaagtcagccagtggtcctccgctgtgcggagggcaggaagccggctgagcacacgacaggcattcagtatgcacagtatgcatatgctgactgatttctaccacgttttaaggtgcaacctccagacctcacatatagaacagaatgcaggtgggttaccgatggcagtatcaaggcagagtcccaaagacacagggagtccagcttggctctgctccgactcccctcctgttcttggcctggcccccagcctccacctctctggcttcatggctccaagccctccctgcttcgtagactgtagcctggcccctggggacagtggcctctctggccccaggcctccacagccacccctgtgagtcctcctcctgcacagagcagccagaaggagcttaaatgcagccatcgcccctgcactcccctgacactccctgtcacatcccttgttttattttcttcatgacacttctgacaatctataaatatcttgtgaatttggttactgtcgccacccatccccacccccgccagaattgaaggtctcgatcacttgattcccagctgcagatccacgtctggagccagtgagcacccagcaggtgcctgcgggctctggggaggaacgcctcctactgtccctgagaagctcaggcctccatgtgctgtgatcaccctgctcctgccccatctgcctcctctggaagcctccctggcccagctctgcaccaggcggtgcctgggtgatgggtgatgggtgatgtagcgccaggcaccaggccatcaccttcggtacacccagtcctgtgatttgaggctcaaaaagggaaccctggagctggtgagctacctccccacccacaccccaaggctcctgccccagccactggctgccccactcaccctcactgaggaaggcatcccagacacgcagcactgtggggaagggcagggagcgggcgaagaggcacaggaaccactcgggcaggtacagcaggggtccgacgcccacctgctgcaggtgcttgtgcacgtgcggaagcagccgccgcagcagggccatgaacacctcggcgtccagccgcacagcctcctgtggccacgtccatcagcaggccagcaccgccacccccagagcccaggctcaacctccctcagtccccagacccccacccactcaccgggcccctgcccctccttcctccagcccccatgtcagcctctcaccatgtggggcccgtagtacccagggaggtagacctcacagatctgcaccaggcaccagaaggcctcctggggaaggggcagggcacaggcctgtaagtgctcaccaaggaagggaccgtggaggagaaggcaggacaggggaaaggagtgaaggggagggcctgggcaccacaggggcctgcactcagggccactcctaacctgcgcagttcctggaagcccttcccaaaagccccctcctctgcccaagacagggtctgctgaggggtttagggtgttggaaatcacagggctcatggtgttagatttgaaggtcacagggttggggttcactggccaagggttgggagtgtcccaaagttcaagtcctgggtttctgggtctttggggttggggtcgcagtccccaagttcagaatcaggagtcgtggggtcaaggtgataacatccagattcctagatgactggggtcaaggctggggtcaagggtcccaggttcctggagtcaaggtcattaggcttgaaggtcactgaggctggcagtcatgaggacctgggtcactaggacagggtccaggaatcaaggattgcaggtttctgaggccacagttcctggggatggggttccctgggcctaggtcactagggttcccagagcagggtcaaggtcactcacctctgggggcaggtgcatgagcagcacagcagccacgggcccctgggcctggcagtagccctgctccggtcgatacagggtgtaggccttgagcacctgcaggagcccctgctgcctgtgccggaagaccccataaggggccagtcctgcaggcacccccttctccaccctctgggggcctctgcccaggcctcagcctccctgggccttcctgggtcccctgagatgcaagactgtagagctgggctagggaaagtgggctggagcacctggggcttgtggggctgggggtccctgggcatcaccggcctcgtacccgtggccctgaggcgacacaaacatctcgtgcagagggaattgacggtgcaggtccctgccaatggtctccatccactgtgggtctccaggggcctctgccagctcctgtgggtagccaggaaggtgggtgtgagggttcagtgtggtgaggggctctgggtaggggaattggggcccctgcccactccctcacctgataggtgccagggctgttcttctggcacacatgggccccacacaacaggggccagcatcgggcgcgcagggcagacgggatgcctttccggcactgcatctttacctgtgggtgaggccaagggctccactaggcagcctccatagctcctgctggcaggccccaggcacagctcatcagcaggcaggggcccactttgggtggcagggagcaaaggccggaggtgctgggacacagggtgggtacattttgccaagatgtgggctgaggcagagaggaatgagccatggaagccaagtggggcccctgcccccctcaccttcttgtaccgccgggacatggttttctcccagtgcgaggtcatctccacccacttcatctcccgttggcggatgaggtctgcaggtgggtggcccggcctgggggtgcatggcacaggtatccagacgctgggcagctgttacccaaggcccacactgccaccctccaggctacccaggtgaacccagctcctggccctagggatctctgggagccctgtggggtgacctgtgacccaggagctgccaatgcttgtcacggggacaggaaaggatgtggctccgacgtgggcagaagcaggagactgaaggggtgagtgggtgtgtattgggggagggactggttggctgtcacccaggacagggacacagacaattcataggggaagctggctggagagagccctggactggaagcccagagtcctgagtttgagtctgggtctgtgtctgatctgtgtgacctggggcaagtttctgtctatatctggacttgtgtttctgtctgtagcttggggaaagggggaaggaggaggtatgggttctgtgatttggatctgggattcctgagccagaggttcaaaggggaaggatgttctgccccagtagtgggtgcaaaccctcggaggctgggggtaagagacgtacagaggcctccccggacccttcccaccttagggttccacctggcacctgcagaggggtgctactggctgagtccccctcccaatccctaccaccagaccctcccggcctccctccagaattcagccctcagccccctgtcctctgtcccagcattccgccagccctcaccctgcccccttaccctggctctgctgagctgcccccaatgaatccatagcggtcggcctggcgatatgggccaggcccgctgagctctgagtcggaccccaaggagctggagtcatcctgcagctcgggaggctgcaccaggtcctcccccagggcctgggccatggtgcccggggccttcgatgccacaggcagagaaagtggggagaaccagtgtgaggggccactcccggccagcctggggcctggctgcggggtcagaggggggaggtttcagggtatctcaccaagccccctatgtctcctcttttatgggggcaggggctaggccctgccctgacagaaaagccaggcctctgtccggagacccagccccaagccctgcccctgtccccaccagcccagctcacctcccgcagcacctcacctcctcctctcacttcctcctcctcctcacacagctttggcaaccgctgggggcccctcccaagggtggggggtgtcaccccttcctctctgaggctcttcctgcctgccccagtgcccctgagctgtgggctcctcccaccttccccatggccccagtgactgcaggcttgagttcctgtgctggtgtggagggcccaggactgttagacgcaggggccgggccacctccagttcttttgtttgtttcttttgagacagagtctcgctctgttgcccaggctggagtgcagtggcgcggtctcagctcactgcaacctccacctcccggattcaagtgattctcctgcctcagccccccaagtagcagggactacagacaagcaccaccatgcccggctaatttttgtatttttagtagagacagggtttttgccacattggtcaaactcttgacctcaggtgatccatccacctcagcctcccaaagtgctgggattgcaggcatgagccactgcgcctggacttcatgtttgtttcttgagacagggtcttgctctgtcacccaggctggagtgtaatggcacgatctgggctcactgcaacctccacctcctggtctcaagagatcctcctgcgtcagcctccacagtagctgggactgcaggcgcgcaccaccatgcccagctaatttttgtattttttgttgagacagggtttcgctgtgttgcccaggctggacgcaagagaccatcccgccttagcctcccaaagtgctggaattacaggcctgagccaccacggcaggcccacttccagttctgaggttactggcatgtaaagcaccaactcagggttccaacaagaattaaggttcatttatcgtctgctcttcttttttttttttttttttttgagacagtctcgcactgtcgcctgggctccacttcccaggttcaagcgattctcctgcctcagcctcccaagtagctgggattacaggaggctcccatcatgcccagctaactttttgtatttttagagagatggggtttcaccatgttggctttggtgtgtctctatcttctgtcttttttttatttgtccgtcttggtttcttccttttttgtgatcacctgtgtttttttttttcttttactgttttttttttctgtctcttttctttttttttctctttctggttttgttcttcaattttgttctgggttgtctctttttttgtttgttatgctttttttggttcttttttatttgtcttggttttttttttatctgtttttcgtctttgttcttctctgtccttttttcgttttttttttttgggtctatcttctactctcttttccttttctctttgtttatatttattattttttttttcacttttctttcttcttgtcttttattttcttcaagttgtattctttgtccttgtgtttattttctactttttcttatgttcttcggtattctttctttatcctctcctttgggtcttcctttggtctattttttatcattttttgaataatttttctttcttatgcttttttttttctattttcgccttcttttcctctgctgtttttatttattctttatctcttttttctctccttctatcatctttccttcctcccttgcatatcgttctgtatgtgttacactgtatatctgtctagaatttcttaggtctccttctccttctagatcttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccccggccataagatccaaaggggggcgaaaagagggcggggaaaggggagggggaggccccgggaagctaggagaggaggccgcaggccaggggggaaatggggcgggcggaaggagagccaggccggaaagaggctaccggagggcgggaagcaggggcgggccaggagcagatgggatggaggcggcggggccgccatgtccaacagcgagaagctcaacctggactcaatcatcgggcgcttgctggaagcttggtcggggcgagggaggcccgagtccgccggaccatggccccgtgcccggcccggaaagtggcgcggggcgggcccccggggccagcttagactgggcggggacgggcagcgaggttccgtggccgcagctgcccccccgcggacgcgcctgagaggtccggggccagctccgacgcgcggagcagctccccccctctcccgggctgggggcgcacgggttgcctgggctcttggggcgagggagaaacccgggaagcccggtccaggaaggggtcctgcgctgtgaggtttttggtggcagccccctgcgcacgacagtcgcctcccgaggcgctgagggtagctgggggcttcccctgggaggcttgaggccgcggtcccgggaggctcagcagcaacagctgcctgtgggcaaggaggggccgaggaggcctaggcgcccccggaggtatccatggggccacccgtgtcgcccaccctcctcctgtcagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgagcccccggcccaggtccccttgccttcctaaaagtggcactggaccccacagagttcctggagccctcctcccttgagcgcagtcctggccctgggttcaggtctagaccttgcatctagcttacccggttccctgggtcacaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgtgagtggtctgagcgtctggggctgcccgggtcctgaaccgcactctttgccattcagtgggaccttcacattggcctgatatctgacagacacttgatagactgtgcgctccacgaaggcggggcccaggtccgttctcgtgcctgccctgcccctcctggcatggggtctggggaatggttgctgactgaagggctgcccggattctagtgctttcccccagggccctgcctggtgacactccccctacatttgctactaagcacttaggatgtttgcagatgggctctgctgtccagaagctgagataaaccagacctggacttggcccggctcatgggtgggggcatgcgaggagtgccaaccctgaggctggtccagattggaacttagtttccagtggactcgggtgctttagaattacttctggcaggaggccgaggcgggaagatcccttggacccagaagctccaagttacagtgagctatgatcttgccactgcactccagcctgggtgacagagcaagaccctgtttctttacttttttgagacggagtttcactcttgttgcccaggctagagtgcaatggtgtgatctcggctcaccacaacctccgtctcctgggttcaagcgattctcctgcctcagcctcccaagtagctgggattacaggcatgcgccaccacgcctggctgatttttttgtattttagtagagacgaggtttctccatgttggtcaggctggtctcgaacttctgacctcaggtgatccgcccgcctcggcctcccaaagtgctgggattacaggtcttagccactgcgcctggccagatcctgtcttctttaattaaaataaaaagtaactagaattgctcctggaaggctgacaggtggcaggggtggggggtggtttgcatcggtgcctgactctctcctcccagccacggctgaatagcccagggaccctggctgagggtggggtaggcaggcacctcacagccacctccccctgggcaggcaagagacgctacaacatcaaactgtggaaaaccttcactgactgcttcaactgcctgcccatcgcggccatagtggacgaaaagatcttctgctgccacggaggtgagggaggggatggctggggaggaggagcactggccgcatccctcagcacccggcagctctccttaggtctcatctgggaagtcactccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaaagctgaggggaaggggatgacttctgcctgtctaggcgcccaggagaccagtggcgggaccaggagggtggtgggaaaggtggggttcattggccaaggcttcctggagggaggatgtccttgtttgaggaagtgaccttcccccggccccccaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactgctcccatcctcgcccaggtggtagaagacggctacgagttctttgccaagcggcagctggtgacacttttctcagctcccaactactgtggcgagtttgacaatgctggcgccatgatgagtgtggacgagaccctcatgtgctctttccaggtgagtgtggggaagaaaggagccgctaggccctgtggctcagccccatgagcctgaccaacactgtctcttttagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgccatggcctccgtctcacatctaagacactgcctggcagctcttctgcacagagccgcttgggagtctcggcaccgggccccagccagggcaaccctagccacacactcgggtccaaggctcttagaattccaagtcagcgccaaagagtatcaggaaagcaaggaaaacttgtcagctccacgggggtcccagatgcatgcccaggacttcaggaaggaacaggtcatgattggcagagaagctggatcaccaggggccagcagcacctactatgacattttccttaggaaggtgagcctgagggagacaggtttccagccttggccagctggagtatagcctgaggctcaatgagaaataagaggtaggaacgtcagtagttcagggccaagtctggaaagtcctgattggctgggggttgtggggagataacggcccaggcccgaccgctgtgggacagctttacagtgacagccagctggggcctgcgagaggcagtgaaacagctcagctccagcaagcccacctttctgatccccagggctgagagacccagttctgccactggctggggcttcgtctagtccaaggcctctgggtacaggcttcaggttcttggttcagccttcaccctcactgtcttccgccagcacagggctggggccctggggggagcgtacaggggccaggatggagccgaagaacagtgagcggaactggaaagagaacaagtgagttctggaggctgctcccttccctacctcccacccctgcctccacctccagtccctaccttcttgggtgggggagtcccaggcactgtactgggctcagcctcatcttcctcctcggagtggggaccggggctcttggggggctgggggccaggtgaaagggaaatggagggcagcacccgcgagccctcattgcctatagtggtttccatggcgatcatgtaagagtcaatgtcgtcattggcaaagtcgtccgggtggggtgtgctgtaggcagaatcggagtatcagggaggggactgggggagcagaggcagggccccaccttggagggctcgaagggagctctggggcccccgaccactggagatctcttggttttatgacttcctgatttggctggagaggagaggatgcaggggttaagtggtgacttcctggagggggtgggccaggaatctctttgatcagaattcaggtaggggcctgagggaggcatcccgggggctaccttagctcagctaggagggaggagcagcaagtcttatgaactgggccacatggagcccaagcccccaccttcccaggggacaggagctggaaagcacaggagcccagggacaggctgggctgggggccagccccaacttcctgtgctgaaagtgcactgggccatcctccccagcccacctgcccttccagccacctgcttcccccagcccaggcagctcctgcctcccagcagccctttccctccttggcctgggaggaggctcagaggggcggcctcagccagagaaggaagctggcagggccttggggatgcttccctgggtgggaggggtctctgagtacagctaaccgagaaggctgagtctgcagggctggcagctgtgagcactatagggttaggggctggggcctgatagaaagagaaggggcgggagagaacacattgcggggaggtgcagaagctaggagttgcagtctcaggctggagtgcacagacatggagagaggaggagttggggggaggtgccctcacctgtgagcctggagctgaggcactggctggtgacgctctggggagcccaggtcctgggagtgcgagtcggtgtctgagagtgtggccaagacaaagtggccgtccagcaaagagtccttgatggtgaagatggcgggcctgggcaggggagggggcccaagctaggtcatcccattcagctcctgccatcccagagcccttccctgtcccaaggctgggaa

SEQ ID NO: 13235 - DNA, 16434 bp, Human
ttggttatttcctttcttctgcttggtttgggtttggattgttctcgttcctctgttccttgaggtgtgatcttagattgtctgtgctctttcagactttttgatgtaggcatttagggctatgaactttcctcttagcacagccttagctgtatcccagaggttttgataggttgtgtcactgttgtcattcagtttgaagaattttttaatttccatcttgattttgtttttgacccaatgctcattcaagagcaggttatttaatttccagttatttgcatggttttgaaggttctttttggagttgatttccagttttattccatcgtggtctaagaacatgcctgatataatttcatttttctcttgttgcccaggctggagtgcaatggtgtgctctcggctcactgcaacctctgcttcctaggttccagcaattctcctgcctcagcctcccgagtagctgggattacaggcacatgccaccacgcctggctaattttttgtatttttagtagagacagggtttcaccatgttggccaggctgttctggaactcctaacctcaagtgatccaccagcttcggcctcccaaagtgctgggattacaggcatgagccaccgcacccgacctattttacattttaacaattgctactgaggttgagcatattttaatttatttacgtctattcaggcttcttgtcagttcagtttaacaaaacaaaacaaaacagcttattgagatagcattcacatcccatacaactcacccatttacagtgtacaattcagtggtttggaggcagtgggcctccccagtggccataacccatctgctgctcttagatgggccttagcattctgccctgtattcccttccccatcccgaggtcccttcctggtgtcacattggcatttacatctttagctaccgaagattccagggccagggcttggtctcaggctgtggcctccgctgggctgtctccagtcacaaccaagggttatctcagatgtccctcctgcccacagggctgcacactctgccaagagactctctacagccctcagcagggcgtgtccttggtctcaggctcgggggaaggtggggtggggacagagtcaggccatccatgaaggacagtggcaggacctgagctcattctgctccctggaacctagaaggtgctcagcaaatacttgtggaaacattagcgggcaacattgaggggcactgattttgtgccaggagctgtgatctgccttttccattctcacgtctccctctgtgaccctctcaagaaccatggcaattaggtgttattgttacttccgaaaggctcagagacgttaagtaacctacccacggttgcacagtaaataaataaaccaatgaacaatgcgccatcctagagctacaggtgccgtcgcccatcaagggtctctctgcaaagatctgagccccttcctctgccctgagtatgccagctgggcacactgagagtggaaatagagccacagttgctcatcttgacctgtgaagcctgaagagtgaggacaggagaggagggagatgaagatttagcatagagaccctaggaggggccatggggggcatgggaccactgtggctggggcctgggaggacttcctggcgaaggcagcatttgccaccaggatcctgctgatattttcatcctgtgaccttcccctggggttcttttttcctgatcaggtaactccctgctagcccattccaggaaacacagagcaaagcctcagacagccttgacttgtctaacctgttcccaagccggctgtgcagtgtggtccctgggggcagggccctggaagaacagggcagacaccgagcagctataggtcctggcagtgagacaagggtaggcatgggaattgggaggtgcagccctgccccacgcctgttgggtaacactgagcatcaccccattgattaccccattgccaggcgtgggcacgggagttggtttgggagctgccaggctcctgggaggatcgcagtcagcagagcagggctgaggcctgggggtaggagcagagcctgcgcatctggaggcagcatgtccaagaaagggagtggaggtgcagcgaaggacccaggggcagagcccacgctggggtatgtggggccacaggggtgaggggcgggcagagggagctcagggtaaaggacactggtgggaaccaggggcatggagggaaggggatgtgtgcccgtggcccgtgggtcagggggcaagcccaccaaggggcctatggctgcaggggccatgggtacggggcttgctcaggagagggaggtgggtgctggtgtcttctgagcctcactttgccctttggcaggctcctgggaagcagccacagaaatgaagcctgttccccaggagccccagggatggggacagaccccgtcctccctttgaggagctcccaggttagaggagaaggcagctctgtggacagacaaggattcggtcgggggcaccagggctgtgatcaggaggtgccggagaatcggggattggaagcagagagattcttggcagttgaagcaaaagtcggatctttggtttcagatgttaaaagcaacatgcattgcttgtttctggttctagaaatactacattcgcatttagaaagtctggaagctgcaggaagatgttgagaagacagtgaaaggcacgaggcacacattggcacatggtgtcacaaggctggtgtgaggagaggggctggggggcctccctcctcgcactgaggctgtgaggagggcaaatcaagtcgtctctgggagcctcggtttccctgtccttccaactgggtaataataatagctgtgaggctcagatgagatgtgcatgccagctacctggccccagatgccagctctgacttctttctgggccctgcaccaggcatggccactgccaagggaatgagtcccctctccatatgacaggtcccatcaggcctccaccttcctgtgtgtcttatttctcagcatctgcccccacagtgcttttgcacacgttggtccctctgtccagatcacctgccctccaagaggccctcccctacggcttccccgcagcagtcagagccaggggtgggtctctggccacctctggaagaagccctggcccaccgatcatgtttgtaatgatattgtttccggtgtcattgttccgtgtgtagactgtgagctccatgggggctggccaagtctggggtggtcacctatggacccaggtccagtcaggaactgcctggtgagcagccaggggtccccagtgtaaacccagaaaatctgagatgggtctcagttaatttataaagtttattttgcctgtaatcccagcactttgggaggccgaggcgggcggatcacgatgtcaggagatcgagaccatcctggctagcacggtgaaaccccgtctctactaaaaacacaaaaaataagctgggtgtggtggcgggcacctgtagtcccagctactcgggaggctgaggcaggagaatgacgtgaacccgggaggcggagtttgcagtgagctgagatcgcgccactgcactccagcctgggcaacagagtgagactccgtctcaaaaaaaaaaaaaaagaaaagaaaagaaaagaaaagaaagaaagaaagttcattttgtggccaggcgtggtgactcatgcctgtaatcccagcactttaggaggctgaggcaggtgcatcacttgaggacaggagtttgaaaccagcctggccaacatggtgaaatcctgtccctactaaaaattataaaaattagctgggcatgggggcgcatgcctataataccagctactcgggaggctgaggcaggagaatcatttgaacctgggaggcagaggttgcagtgagccgagatcatgccagttgcactccagcctgggtgacagaatgagactccatcttaaaaaaaaaaaaaagttaattttgccaaggttgaggacgtgcacctgtgacacagcctggggatgtcctgacagcatgtgcccaaggtggtcgggacacagcttggtttacacactttagggagacaggagacagcaatcaatatatgtaagaaggccaggcacggtggctcacgcctgtaatcctagcactttgggaggccaaggcagggatcacctgaggtcgggagtttgagaccagcctgaccaacatggtgaaacccgtctctactacaaatataaaattagccgggcatggtggcaggcacctataatcccagctattcagctattcgggaggctgaggcaggagaatcgcttgaatccgggagatggagattgcagtgagctgagatcccaccactgcactctggcctgggcaacaagagagaaagtctgtctcaaaaaaaaaaaaaaaatacatatatatatacacacacacacacacacacacacacacacacaaaatacatacatacatatatatatatatatatatatatatatatatatatatatatatatatgaagtacatcggttccatccagaaaggcagggacagcttgaagcagggggtgggggtgagggttggggcagcttccaggtcacaggtaggtgagagactgcattcttttgagtttctgatgagcctttccaaaggaggcaatcagaatgtgcatctatctcggtgggcagaggggtggctgtgaataaaatgagaggcaggggcccgcacggtggctcatgcctgtaatcccagcactttgggaggccaaggtgggcggatcacctgcggtcaggagttcaagaccagcctcaacatggagaaaccccatctctactaaaaatacaaaattatttgggcgtggtggtgcatgcctgtaatcccagctactcgggaggttgaggcagaagaattacttgaacctgggaggcagaggttgcggtgagctgagatcgcagcattgcactccagcctgggcaacaagagcgaaactccgttccaaaaaaaaaaaaaaaagggggaggcaggttggccctgatcagtttccagcttgaattttccttttagcttactgattttgggggtccaagatattttcctttcacaccagtcagccctgccccagcaagcgcccggacccctgccctgcagcaggtgggcgagacaagaaagcaccttgcatgagaggcagggcttgggtccagctccagcccccatctgtttcctcatccgtcaggcagatgctgctggctccgtgattatttcaccgagcaccagatgtgcacatgtgaggacaggcgacgactgcccagaaagggcaggggttcctctgccccacctgcctcacctgggaaagctgtgaccacgctgaggccaggttcctgggatgaacatcaggacacctgtgtgccatagctcatcccagactcctccaatccgggtcttgattcaggccggaggcggtcatccctccaaaggcaccagggagccatggaagaggttagagctgagctgatgtggccaggagctgcttgagcgccgggtggaggctgctgatgctcgcatgccaggcaaagctttgggtcagggccctggaacctgggacctggaagcgctccaggccaataccgcccgctaccagagaagggcccaggccccacccaggttctagcccaagggcttgagcaaagacagtagatgaatatttgcagagccctgtatgctgcgtcctcctccaggccctcatgcaggggggccgcacactgagtgtgggggtcctgtgccaggaatgtgatcacgctgcccaggggagggaggcggcatctgcaggtgtggccaggaaggtgcccagcatggcttcctgtctcctcacattcttcagctgggacctgagccgggcaggggctgctctcctcatcttgtcattcacaagacacggacttctgccattggttcagctggctctgtccatgggcgagcactgtccctgcatcacatatgacaagaatgcctggtgcggtgcaagtgcagatggggccactggcctccaggacactcactggggatgccaaggccctgctcaccacccacccccactgccctcagcaatgcgggtctgaggcagcagcccatgcacggccctgtgacctgcagctgagggctgagattactcaagtccacacgcagacacacacacgacacacatggacacagacacccatacacacacagacacacatggacacacacacccatacgcatacagacacccatacacacacagacacacgtggacacacacacccatacacacacagacacccatacacacacagacacacgtggacacacacacccatacacacacagacacccatacacacacagacacacgtggacacagacacccatacacacacagacacccatacacacacacagacacccatacacacacagacacccatacacacacagacacatgtggacacacacacccatacacatagagacacccatacacacacagacacccatacacacacagacacacgtggacacacacacccatacacatacagacacccatacacacacagacacacgtggacacacacacccatacgcagacacccatacacacacagacacacgtggacacacacacccatacgcagacacccatacacacacagacacacgtggacacacacacccatacacacacagacacccatacacacacagacacacgtggacacacacacccatacacacacagacacccatacacacacagacacacgtggacacagacacccatacacacacagacacccatacgcacacagacacccatacacacacagacacccatacacatacagacacacccatacacacatagacacacatggacacacacacccatacacatataacacccatacacagatacacatggacacagcacccatacacacacagacacacagacacacagacacccatagacacacaggcactgatacatacacagacacccatacacacgcagacacacagacatccatacacaaacacccatacacacacagacatccatacacacacagacacacatggacacacacacccatacacatacagcacccatacacagacacacatggacacagcacccatacacacacagacacacagacacccatagacacacagacactgatacatacacagacacccatacagacacagacacacagacatccatacacaaacacccatacacacacacagacatccatacacacacagacacacacacacagacacccatacacagaaaggcacacaaagacacagacacacacatagccatacacatgaagatgcacagaacacaaagacacacagacacacaaagaaacacagacacccacacaaagacacacagacacacaaagacacacggacacacgaagacacacagacacccatacacgcagagacacagacatccatacacacaaagagacacagacacccatatacacatacacacacagacacccatacacacaaagagacacagacacccatacacacatacacacacccatacacacagactcccatacacatacagacacacagcacccatacacacacagacacccatacacacaaagacacacagcacccatacatacacagacacacacagacacccatacacacaaagacacacagcacccatacatacacagacacacacagacacccatacacacaaagacacacagcacccatacatacacagacacacacagacacccatacacacaaagacacacagtacccatacatacacagacacacacagacacccatacacacacaaagacagacagccatacacacacacacacatagacacacaaagacacaaagctatacaaagacacacagacacaaagaaacacacagacacacggatacacaaagacacacacagacacacggatacacaaagacacaggatttgcgcaccatccttgagcccctgggctgggatgctcggaatcccgttgctaggtgcctggcaatcctcttgagtgtccccctgagccccttcccccacccccagggtcctgatccttcctcctctccagaccccactggggttcccttgggccctcaggctaaagcccagaggggttcatgccctggggcagtctcagctctgccaacctacccccacctgcacctgtgcccacccataccagccccggagctctctcctctgcttctgcttccttctacgaccagcagagtgccaccccctccccagagcaggtgccaaaccctcctcagggctagggcatgcctatggcttcagtttccccatctgcgacctcaaagctctgtgatctctgaagcaaagaaccctccgagtccctcgtttagtcccagaagggagggaggcccaggggagagctctgttccatctgagtggtctgggtgtaggggtggcaaggtgccagcgtgggtgggtgtgtgtctgcgcaaggaggggaggtgcagggaagagctgggatggtgggcagcagggtcacccgaggtgtgtgtgttgggcttccagggtgggcgtccaggagggggatcccctccctggagtgggggaggtcaagcccagggccctccctcatgggcacacctgggaggcaggtgagttgggggtggtgcaggcagccccagccccgtggggtcattcgagtgggtctgtgtgtgtatgaggtggggtgtctgtgagcccccatgggtgcaggtggggcaagggtgtgcagaccctggggtggctggagggtgcccgtgaaggaggggcagccctggccacccagttcaagccaccccatccggcaggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataaggtgggccatggagagtgggcccgggcaggggctggagcagcgtccctgtcctctttcaggagggcccgtgccccctagtgactggctatgtccctagttttattcctgtttgtttaacagaccccctccctggcatgtggagtgtggcaggcacctgaccttcactcctgaacactcacaagccaccctgtgatgcaggctccatggctgtccccatgttgcagatgaggaaactgaggcactcaggggttaacatcgcttgcccaaggccacacagccaggaagtcacagatcagaattgcagccatgcgcagttcccaggggacggcagtgcctcccataggagctgtatttatatgtccagtggtggtggtgcctgcgtgtgccctcctcaaattctagacccctcctggcccaggtctgggcctgaccactctgaattccacctccaccacagccagctttcgaggcagacatatctgagctcatcctttgccagaacgaggttgactacgctctcaagaaccttcaggcctggatgaaggatgaaccacggtccacgaacctggtgagccctgctggcaggcggcaggagggcagggcagggcaccgggtagctctggcccaggcccccttctgcccctgaggccccgggcgagtcactgattttctcgtctctcctgggattccatcgcacagggagctgaggccccaagtgtgcagtgggtgggctttggggtggcccttggcagggcctcactgtctaccctgtgcctcagttcatgaagctggactcggtcttcatctggaaggaaccctttggcctggtcctcatcatcgcaccctggaactacccactgaacctgaccctggtgctcctggtgggcgccctcgccgcaggtgaggagggcgttccgaaccccatgctctccccacccagtagcccctcccaaagaggcccctggaatcttgctctgaggtaccctgggcctcacatgccctctgagcccagcccctggttgggcatggggaccctgggctcccccaacgacgtccccatctgcccctgcagggaattgcgtggtgctgaagccgtcagaaatcagccagggcacagagaaggtcctggctgaggtgctgccccagtacctggaccaggtgagggtggccctgccccagcagtgcctgacgtccccatatatcacccctgtgggctgaggaggcccggctggcccccgagcccgccccgagcctctcattccaccttgcagagctgctttgccgtggtgctgggcggaccccaggagacagggcagctgctagagcacaagttggactacatcttcttcacaggtgagggggccaggccagggtcccagagtaggtggaggggatcatcaggagagagggtgggagggttgtggagggaggaggctggggccagcagtgggggcacgtggggagctggagctggcacagagtccgtctgcctgcataggccacgccctgggcacattgcagcaattggatccaggagtggccaggctggaggcaggtcccagtgggtgagccagaccggccaggagaagggtgaggcgggccaggactttctatgaagaaagcgggcaagagtcaggtgcctggagtgtgtggtcaaggccagttgaggatggggtctcctcaccatgtccctaggaagcccgccgactccaacacctctccagggaggagcaggctctgggctgggccatcctgcctggtccaggtcactgactggccactctggtttccttccacgcccagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccgcatcatcaaccagaaacagttccagcggctgcgggcattgctgggctgcggccgcgtggccattgggggccagagcaacgagagcgatcgctacatcggtgagtcctgctgccctaccgcagcccacctgggccaagaccctttctcaatggagggcccacggctgggccacgagtctggactcgcacctgaaacccggccccactatcagagcccggccttgagccatggctctggtgccacgattccgtctctgtgcttctgagcctgtggccccatgaggccatactctggtccctcagccctggattcactgagctcagattccagggctccagggcccagcgtgctaaggtgaattcccatcccaccaccggctgtcctgaaaggccgtaacctctgattctccgagcccatgatccccaggttctaaactctgacggccccatcctgagcccccagtctcctgggccgtatgactcagcagctcatgggacactgcagctccaacattctgggacgctgctgcctcatgaactccaaggttctaagatcccatcacccctgactgtgagaccaaggtcgggggattctctgcgccccacaggccctgagcaggctggggaagccctagggtcccttctggggggctgtggggaaactttcttccctaaacactccaaagcctgaagcgctgggaagtcagaccttgggatcctggcctggagccctggcccatgcccctgtccccacctctaccctacccctgggggcagtcctgactgtggccccagggctgagccgtctctggtgcccgcagcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggtgggggtgcggccgggttgggggcaatggaggggctgaaaggggcacagactggcacctttcctttcacagcccttcccagcaaggctttagagcagcagatgcctcaagggtgactatatctaggccacctggtaccactgcatccggcgcaaggatgcctggcagagaggacagggtccaaacccaccagacacttagcgggtccatcctctgtcctggccagagcagcctgcacttggactgtgcaaaggttctgcacaggcaagcagaggcccggaatggaggtcagggacagagcagagcaggggcctgatagagcccagcgggtcgcggtggggcccgcataccacactgcagcatcctaacctcaccgtcgcgactcaaggctgccggctccccatgatcctgcagggcttcctggtctttgcgccatggtggtaatcacccccatggcaccccgaccgtcactgagagggtgctgtccccagaagatgcttagagcggagattattgcccgttagagggtggaggggcaggtgaggatgaggctcacctccgctgtggaatgtgcggggctcaagccctcttctcatgactagagcccaacacccaccttctcactccctggcaggttgtgaaccagatgctggagcggaccagcagcggcagctttggaggcaatgagggcttcacctacatatctctgctgtccgtgccattcgggggagtcggtgggtccctgcccatttccactcctagggaagcttggctttggtaccccagacccaggaagtcccttcactcactgttcaaccttgatccacatcctgggcctctcaaggcctcagtttccctatctgtaaaatggctctgtgagtggcctggctctctctgagctccctgccagctgtgtgccctggccggggcagtgggctgctgctggggctccatgggctgcctggtctcaggcccttgttctctgtgcccacacaggccacagtgggatgggccggtaccacggcaagttcaccttcgacaccttctcccaccaccgcacctgcctgctcgccccctccggcctggagaaattaaaggagatccgctacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggctcccccagcctcaggttgctggagctgtcacatgactgcatcctgcctgccagggctgcaaagcaaggtcttgcttctatctgggggacgctgctcgagagaggccgagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccacctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggagagcctatctttctgaggttgacacttatcttgcagaatggggttcccacccatctttgatcatgaaggaaatctcagatttagaactatgttgcccaggctgctcttgaactcctggggtcaagcagtctacctcggcctcccagaatgctgggattacaggcgtgagccaccattcccagcccacatttcttaaaaatggtatttcagtccaaaccttagtaatacaatcgatgtttctaattgtgtcctgcttacagggaccagggtttgtttttcgtttttgttttttgtttttttattttttgaggtggcatctccctctgtagcccaggctgaagtacagaggcacaatctcggctcactgcaacctctgcctcccgggttcaagtgattctcctgcctcagtctccctagtagctgggattacaggtgcccgccaccatgcccagctaatttgttctattttagtagagatgaggtttcaccatgttggccaggctggtcttgaaattctgacttcaggtgatcctcccaccttggcctctgaaagtgctgggattacaggcgtgagccactgtgcccagccctgagagcagggtttttgtttgtttgtttttgtttgtttgttttactatatataaataagaatgttcatgaatagtttctgaattttgtaggaatcaagtagggagaaaaagtgaataagttccacctttgttcacaaaggacccttgatcgagttattgcaaatgtcgatcaaaagagtcaaactctgtacaatatttaagagacttattctgagccaaagatgaatgaccacggcccgtgacacagcccttaggagatcctgagaacatgtacccaagactgtcaggtcacagcttggatttatacattttagggagacgtgacgcatcaatcaatacgtgcaagatatatgttggtttggtccagaaagatgggacaactcaaagcaggggcttccaggctataggtacatttaaaattttcctggttgacaattggttgagtttatctgaagacctgggatcaacacaaaggaaatgttcatgttaagataaaggattgtggagaccaagttttattgtgcagaggaagctctcagatagtaggctgtaaaatctttctttttcttttttttttttttttttttgagatggggtcttgctgtgttgcccaggctggagtgcagtggagtgatctcagctcactgcaacctctccctcctgcgttcaagtgattctcctgcctcagcctcctgagcagctgggattacaggcgtgcaccaccacgcctggcaaatttttgtatttttgtagagacagggtttcatcacgttggccagtctggtcttgaactcctgacctcaagtgatccacatgcctcggccacccaaagagctgggattacaggtgtgagccactgcactggcctgaagtgtttcttatctaacataaaagggtgcctggttcttagttgattatctcctggatctggaaagaagttagaaaaaagggaaaatgggattctctacagaatgtagattttttccacaggagacaactttgcagggcagtttcaagatatggcaagcaaatatatttggggttaaaatattttgatttcttctcttatttgttatgtgaggttatgccagagtcaggtcagaaagcagaccacgctatagggttaaaattaaagcctctctgatgagactttatggtttgtagggtgtgactccccaggccccttagggaggaatttgagcaaaataagaacaaaaaaaatcagagtttagtcctcacaaactataggcaggttatgacagaaaatttccttgaatctgcaaaacaaaatgaggtgatagtctcacatttaagtcataaaaacattattcatatcaattacttaatttcatgtaattatttttgttttgctcaatctttttatttatttatttttaagacagagtc

SEQ ID NO: 13236 - DNA, 6759 bp, Human
gcctgtaatcccaacactttaggaggccgaggtgggaggatcacttgagctcaggaattcaagaccagcctgggcaacatagggagatcccatctctacaaaaaaaaaaaaaaagtagccgtgtgtggtggtgtgcacctatagtcccagctacttgtaaggctgatatgggaggatcacttgaggccaggaggtcgaggctgcagtgagctatgacagagctcccgctgcactccagcctgggaaacagagtgagaccctgcctcaaaaaaaaaaaaaaaaaaaaaaaggagttctaatttttccatctccttaccaacactttttattttctggtttcttttcttttctaatagccatcttaatgggtataaaatggtatcttatttagctaagattttttttaattggaggggtgaagggtgacaaagcatttggccaagacttgtgccgggattgcagatcaaaagacaagatgcttagaaaagagtgcagagaccagagaaaaagacggtaggatgggtttctggaggcaggctctgggcgggttgtcaaggtcagggatgggtaattggtgctgaatggggggctcttcttggctcagctctccttcagcagcaccgggaggcagggtcccacagagctggggaagacccctgccccctcccccgccccacacacatatcatctagaacaggtgctgtttgtgaagggccccctgtgcaccagcccctgtgcatggtcactaatcctcacatcggccttgtgaggcaggtattaagagccccttctgacagatgtggaaactgaggctccaggaggtgaaacaatttgcttgaggccacatagacacaagatggcccaaacattctctggggagcaagacaggccctgacactaccgtcaaggagcttgctggcaaaataaactttaagtgagcatttacctcacagagtgatgctgagtgggggatcctgtgagaacacagccctggcagtcagggagggcttcctggaggaagaggcatataggtgcagcctgaaggataagagctggctgggtgatgcgtggggcccacacttccgtcctctctccacagccttcctatctgctggcctcggcatacttgcaccctcagagacctaccccctacctacaaccagctctggctgggagccccggctggggtcaccattcccatcaggcccttgcaccagctctactggggcccaagctgtggccgagcccactgggcagggccccaagaacccacgtgtgtccagagtgacagttcagctggagatgaagcctctgtgggaggaattcaaccagctgggcactgagatgatcgtcaccaaggcaggcaggtgtgagcagcgggggcggggtgaggcaggggccagggttggagccgcatccggctgctgagcacctccctcccgcaggaggatgttcccccccttccaggtgaagatcctgggcatggactccctggccgactacgccctgctcatggacttcatccccctggacgacaagagatacaggtgcggggaccggcctggggcaaaggctcaggtctcaggtgctgagaccaggaattagacccttcctgcaccccaaggtgaggcaggggcctgtccaaacaatgccagggaggtccagcctaagggcaggacgacagacacgcaacaacagcctgagggcaggaggcagcccaactcagggtacccagcagacttccatgggtagtgggctagccttgggcaggcagagaggtctagcccagggcagcaggggttatcctgtcatccaccagccaggtgcagccacagggaactcaggtctcaacaggattctcttgagccttgggttccttagcaaggtgcccaccaggtggggtgagcagtgttggagtcggcagcagccccttcaccccgcctgtattgttcaggcgtgactctggttggggaagccctcaccacctcgctgtgctccccaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacgtgaggccggggccacggtggggacggaagggcctggggtcagggctggtagggactttggtgtccaatggccttggtgcccagcacctctgcctgctgctgatggtcaaggcagggcggggagccggggtggcgagctcacctggctgggggtggcacagcaggaagggctgtccaggcaggtggaaaagggggtgggggcgggggaatgttccagcatacgttgtcccccgcaaggagagggaggacaaggtatggaacgcccagcctaggccgggcccgctttatgtgtggacacagcatcattaacacttggtcaaacagccaacgatccctgccctcacagaggtcacttcctggggcaaaggcagggtccagaagacactgtccccagcgtctcagatagggacaaatgccaaagaggaagcagaggtacggaaggggggcggagaaagggtgctgctgctctcagggggcgcagggagctgaagacctgaaggaggtggaggatgcagcggcccatgcccgtcagaggggacagtaggtgcaaaggccctgaggccagagaatcctgggccggcagaattgcaagacgcatccatggggccggagtggagccaggaggggaagccaaggaggcgaatgcctgaggggtcgggctgacttcggggggctctggcttttaccgtgtggggtggaagtcgctggacggttaggagcagggggcatatgatgtggcttcccgggcagctgtgtggagaaggaacagaggggtaaggcggggacaggggacaggccaggaggcaaccgaggaaactggtgaacgcgacagtgacgggccagcacacaggcagtgggtggcagctgggatgtggggtgtgagaggacatggaggcaaggatccatgatccaaaggggcctttgacacggaactgcagcctctccagctcagaccctgtgctgccatgaaaggaacagggtggcaggcccagggcagtctcccggcttggagggaaggactccagcctcagggagtccgctgtactccgcctcacccctgtacccctgctctgtcccttccacagatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacagggtgggtgaaccagctcgggagcacccgctgcaggcccatttcacaggggtggagactgagccctgaggcttgcagccctcactggcacagactactgccctcccaacttgccctgagtatctgccatcagtcaaggccctgcccgcactcctatcagctcagagttcctgggccaagaggcccaggtgccagggcctcctgactgccggttcccgggaggacaaggtggctgagcctggctcatggccagcccacaactgcactttgtctcctgcagatcacccagctgaaaatcgccagcaacccttttgccaaaggctttagagagagtgacctggactcctggtactgtctgaccctgaccctagcccctcacccccaccccaggcatatcctaaggcctcagttcctgacccttgtttcagggtcacaccctctgacccatcctggggccccaccatctgaagctggccatgatccctggcctgggttcttccccttgatcccctccccccattctcgcttgctctttcaggcctgtggccccacggcccctgctcagtgtcccagcccggagtcacagcagcctcagtccctgtgtgctgaagggtgccacagacagggagaaaggtaaggccccaggcctgcagacatagtgggactaaggtgtacacagtgggcgggaggcaaagggacaggacctccaggaaggggcttcagcagctcagcgaacccacagggcccctgtgtggacacacggagggggaagcagacatgcctaagacaatatggggctcagggcaaagagcacaggcagcgggtgccaggcaggcttcctgcaggaggtggctctcaagctgggccttggaggactgggaagggtttggacagagggagaaggtgaagaagaaattccaggcagagggaaaagcaaaggcgaaggctgagaggtaggtaacttgggaaggaggagcaggaagggaccagggcaggcctgggatgagggatgaggatgcgatgggaggcccagagtccactcatttcctccctcagaccccaacaaagcttcagcttccacctccaagacccctgcttggctccatcatcagctgctgcccccacctgaggtcctgctggccccggccacctacaggcctgtcacgtatcagagcctgtactctggagccccgagccacctagggatcccaaggacccgaccagcaccataccccctccccaacatccgggctgatagggatcaaggaggcctgcctctcccagctgggctggggctcctgtcccccactgtggtgtgcctggggcctggccaggactcccagtgatgccagaagccctggggggaagccctgctaccctggaccttacaccgggtgtgggaatcagcctctgccccgccccctccagccccatctctgtctcaaggagagcagggtaggtgaaagtctagagaaagaggctacctgcccagggtcacagcaaggctgggaccatggcaagcttggaaccaggacttctatctcccaaccccagcagcctgaatactgtgccctcttgctttgggggtaactcccgaaaaccctgccttacctctcccttccccctaacattaaactatttggcatgagtggtcagagcacttctgtcgtcgtggtcagggtgggtgggggcctcaggaactcccagacccatcatagtccccacatcagccctgtaggcatcccgaagctctgcccagtgccgtccgcatccctgggagcacacagtaatattaaaagtggtgactccagcccagtggcagggctgcacttgcccagatgaggatcgaaactggcgctcagagaggcgcgggacctgctcaacgtcacacagcagagcatggcggacacccgccaccccacgtttaaatgctgtgcgcaaggctggggtcatctggtccccaagcccagggtctggtggaagggcgcagaaccacggtggtcagtgaccacaggggccgaggtaggaaagggggagggatttgggaatccggtcaagactcaaggcaggaagggagaagagctctggacgctgggacaaggaggtcaaaggcctggggctggagtccgacggagccagaggggaagacaagactgggggcggcgcgcgccacccagcggtatcgggagggaggaccggagggagggctgggccggacgctcctctcgcgcaccgatcgacctcgggttcctggaggggcgtccccgtgggatcccggctccgtacatcctggagcccctaggggagggacggaccagtgggggccggcggggcctcatcagacaccccaacgccaggacccaacgggaccgaggacggtcgccgggcgcttcacggttcgcgtggtttcaggatctcggagaacacaaccggcaggtcctgcagctccgcgcccatctccctccccgcggccacacccccggccacggcccggccctgccggaagcacagtcctcctggccacgccccccagtccttcgtagcaaaagctccggtccaggccccgcccccagcccgccccaacctcgattgcctactaggccccgccgccctttggcagtaacgtccgagtccggctcccgcgcaggccccgccccgccccgccccgccgccctccgtccctcccatccgggggactcaacgcgtcccaccgaggccccgccttcaaacaggccccgccccctaatggaccccgtcccaccgaggacccgccttcaaacaggccccgcccccgaacagacccagtcccaccgaggccccgtctccgggaaggccccgcccacgaacagacccaccccactgaggccccccgacgccgctgccgctctgcagccccccaggcgggacgcgtcgcgcgggctgccccttctccctctcagctttcggagggacccgggctgagcgccccgccccgcctcgccccgcctcttccctcgcccgatcccgcgccctcagtgtcccggccgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcaggtacagcggccgggaactcctcgccctttgccggaggctacaggagcccggggctggcagggacctctggccgggcacttagccccttcgagcctcggtttccgcctccgtaaa

SEQ ID NO: 13237 - DNA, 95621 bp, Human
ttgaaaacagtttgacagtttcttaaaaagctaaaacatccacctggcatgctatatacagatatcctactcttacgtatttaaccaagagaaataaaagcatatatccattcaaaaacttgtaaataaattgctcctagcagctttatttgtaatagccaaaaactagaaacaacccaaatgtccaatgaaaggatacatcgtatttatttataggacatatccatgcaatggaataccacttaggaatagaaagaatcaactgttcatcatacatacaaccacatggctaagtcttaaaaataattatgcttagttaagaagtcagacaaaaaggtaagagactgttaggagctgaattagcgggttaacagtggcaatgaaaaaggagaaaattatagctacctcaagatagaattgatgagctttgattatgaaatgatggtaagagagagggccatagactctgaggtctgtctctagctttggtttccctatgtggatcattatctatttggatataagaattatctgaaagatgatacttaagcatgtaagaaatgataagctacctgtttaatgatgagcttttgttacctccaagaaccccaagaagaaacatcctgtaagcagaccattcatacttgattgttaaaggaaaacaaaattccattttgtctttttcatcaacacaagtatagctggctaataaaagtgtaatattcatgagagaaaaagaaaagaacacgcacacacatacactcaacaggattcctagagtcattcccatggataagagggaaggaaaggttgagggcaaagagagaagggaaggaaacagactatgatgggatatcttagggcaaaagaatagggggctgatttggaaggcagcaaacttcatggatacttgatttatttaatgtccctgtcactctggcgtatcttaatgtgtgtggtgtgtgatttatttagtcacttgatccaaattctctaattaagtggagctcagaagatatagtgtccattgtggtcaagggcacaggttttggcttcaacagacaaataagctctctgagcatctgtcttctcatctgtacaatgggaatatcagttcctacctcttcaggttgttgtattcataaataaattgtgtacaagaaacattaggattgcttcttacccgtagtaagggctcaacaaaccttctcctccttctcctcctccttctccttcttcttcttcctcctcctcctcttcttcttccttttgcttttctccttccttcttccttcctttcttcctacctccttctcattattgttattaggtaaccacaatactatcagtaatgattggagaaagctttaatctcctagttcaccattagaaaacaagaacacattttggtggttattacccgaagtaatcataatgtcacctttttttccatctgactcattatcccaagtgatttatttatatatggagttttctgagtctttcttttacatattacaaaaaaagagtgtgatttagggacgaagcaaagaaataaaaatttagtgactttcattctgcctgtgccccaattcctattgggcataaggcaagtaatttaaatttcttagcaccttagcatcttctactcaaacagaaatgaggaacagtcacaggttactattatagctgtctaagtagaaggcacacaagttttcacactgagtataacactttatagaaagctaagtgtgttgctcaagttggtacatttctgtagatgtgacactatggcactaagaaacttaatgccacattgaaattcattgagatagctagactttaaaaataattacttgacttcactataaagtatgttcgtattgcatttactccatctagtagaaaatagaccttgtcagttcaaatccctgttgcattaatttcaccagtaatgagtctttttcatttgagtcagcagggtttttcttgcttgttttcaggctttgtggatttgaccctccatgatcaggtccaccttctagaatgtgcctggctagagatcctgatgattggtctcgtctggcgctccatggagcacccagggaagctactgtttgctcctaacttgctcttggacaggtaagtgacctggctgtagcttaggagtagcatgttctttacgatcatagttcattcatgaaactattttattcatctctcggtgaagcttcagagaactttattaggtatgtttacttaacaaaagagtgcattgggggtgatgaagcctagtcaaattcacagaaagctaagaataactttctgctagacattacctcagaagaattctattatttctaatacacacacacacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaaatttgaccagagttctgaaggtcacattcaggtcgacaaattcattttcatgttcaaatatgttaccttctttaacataccattctggggttgccttggaatgtgggtcccattgttttttttttttcagtcattgcttagagtcatagaatttagatattactcaatagcagctgccactgatagagtctccaccctgcaccagctgtgatgctaaacactttacatatattatctcatttaatcatcaccggactcctaggaggcaggaatgtcatcatccatgttttaccagaaaggaaactaaatctcagagacatcctgctacttgcaaaaagaggaaagctcactaaatggtggagccagagttcaaattcaagatctttctggctccggtatgctctgttacctcctgtgctgggcacatggtcttcccactctcatgttcagtgatgcctcctttggtctgctgccatagcattctgttttccaggtaaatcttgtctttgtgggctacataacattttggatgagaaagaaccattttgttgtttcttgcaatcctattttgcctccgtgccaagcagtctaaggctgccaggctgcccacagtgcatctctgcatggtactttacttcagagcatttcactatctttctacacctgccaagtgcctggagcagagttgcagcaaaatttatttaagtactggagaattgtacaaggtgttggttattgttttgtcattttgtgttaacacagcttttgaaaaacagtggtgatacagtttaagaagcatattttgctgtctgtggaatatattttgatatcacagtttcacaaaattatcaagaatggccactagtcttgttccttagaactgtactcacaatgtattctgtcagccttatagaggatgtctttaccgtgttctttcctttccattccttgtttcctttccattttttcctatctcatttctcctctcttttcctttgctttcctctttctttctttctcctgtcctcttaatttttttgtcttatagcagtgtggttttgtaaccaagtgatatcaagtttgcaaatgaaaatcttagaccacacgtaacatttccctgcctactgcctggagtgtctaccatgtttaggtttttggacattcataactcatttgctccttgatttccatcctcatctgtatctatcttcttttttaaaatttaattcaatttttataatgttgacacaattatgcagattcatagggtacacagtgatgttttgatacatataatgtgtggtgatcttatctatcttcttgagtacacacttgcttgaggacagtcatcaaataattgcattttgaatatgtgaaggtttttgacattactgcacccaaaaaactcatattgccagtgaggtgatatggcctaggattttatcagctacagccttctctttcctttctgtacactccagtggtggctaattttctttcctctctcacagaagtatgaatgactaaaagttctcatctctattcattcctactttctaaaacttcagatcggaaatttgaattacctctagaccaggatttgtcagtctctttactattgacattttgggtcagatcattctttcattctttcttggttgaggggttgatattgtttggtgtgtcctcatccaaatctcaaattatagctcccatagttcccatgtgtcatgggagggacccggtgggaggtaactgaaacataagcaaaggtctttcccttgctcctctcatgacagtgaatttctcatgatatctaatggttttataaaggggagttcccctgcacacgctctctctcttccccgttgccatgaaagatgtgactttgctccttcttccccatgattgtgaggcttccccagtcacaaggaactgtgagtccattaaacctttttctttgtaaattacccagtctcaggtaggtctttattagcagcttgagaacagactaatacaaggggctgtcttgtgcattttaggatgtttaacagcatccctggactccaccagctagctgccagtagcaacctccacttcctccagttacgataactaacaatgtctccggacatttctacctatcttctgttgtgtcagggggtgggggaggtaaaattgcctctggttgagaatcaccactctatgctttcccaactcaatgttctataagctcctcagacacactgtactctaaactgcacactcactttatcttctgcaacaagtctattccttttcttttctgtcttggtgacatcaacactcacctagacactaaagctagaagctttaagttacccatggattctaccttctccctcaccaaattatccagttaactatcaagtcatctatgaactgcttctgaatccagacctcccctctatccccattcctctgcatggcacaggtcctggttgtctctgctgcagattccttgcttctgcaccactgactcactttcttggtcctgctactctttctttcagtccatctcccatactgctgctggagaaggctttctaaggcacagctgtgatcatgatgcttcctgactcacctttcagtggctctctcaattcttaacatggagaaaccccatctctactaaaaatacaaagttagccgggcatggtggctcatgcctgtaatcccagctacccgagaggctgaggcaggagaatcgcttgaacatgggaggcagacgttgcagtgagccaaaattgtgccattgcactccagcctggatgaaattccgtctcaaaaaaagaaaagaaaatactgtgtagacttcttatcttaataatcatgaatcactattacaagtgtctcaaacgcaaatttctgaagagtcacaggtgacccagtgagcccttgtccaggctaaaaacacctggtggctgaattctgaacttcacacattcgaatttctcttccattgcttctgagagaccctccaccattacggttccttatcagagtcatatctacctataaggctcatttcaggtgccgtctttttataaaatcttccttcaaactttctcctcttcagcctttatatatacaaaaggcttttctttcttttccttttctaagtttccattgtagttggtttgcttttctctttattattctcattccaccatattagttatgattggatgtcttcttaccttccctactagctcataaacttcttgtggtcaaaaaccagatcttgttcgtcttgtgtgatctccagtttacgaagtcttccatgatacccaacaaatatttgttaattgcactggccaaggtcacccaggtggcttgtggccaaatcagaagaatctacatcttctgatagtcatggcagctgttattcccatccaactcacttcctgtgcattgctactcatcaattccccacttattcttttaaaaacattgcataaatacatatctatgtgttttggaaagattttcttaatctataagcgcatttggcgtgtgcttatatgtctgcttatatgccaaatttgaaattccaaatttcgccatttggaatttcaaatggggaaaagcaaagactcttatctttcccataatcaaaccccttatgaagtaaaatccttaaggtctctctacaggttaaaaataattaggtgatatgatttggctgtgttcccacccaaatttcacctttaattgtaataatccccaggtgtcaagggtggggccaggtggagataattgaatcatgtgggttgttttccccatactgttagtgtggtagtgaataagtttcatgagatctgatgattttataaatgggagtccccctgcacaagctctcttgcctgctgccatgtaagatgtgactttgctcctccttgccttccgccatgattatgaggcctcctcagccatgtggaactctgagtcaattaaacctctttcttttatatattacccagtctcaagtatgtctttattagcagcatgagaacaaactaatacattaggtatatgttaatgatgaggaatgtgtataaatacatatacatttatatttaaatattaatatttacaaataacatgatattaaaaatatggtctataattttttaaattatctacctttctaatcattaacatgcactaaatattattaaatttcaatattatttaattaccatcttggtgtttgaggataactgcttttgatggcattgatagatgcattaacagtgaaacattgtgaccaacagcccatctgagattttatacttgtagaagatggcttctgagtgacagctgagaagactgtttatgtctttgccctacaggttcctaacccctttaataaaatagagctctctgatgcagatgacacatgggccttctttttgctcttgtcccatcacattgtacatagtaaacatttttagcaacaaatagtagatacttataactttaaaagctaagtggttgacagctgagaggcagatgatggtaatttcatcatttttctcatatctcaggcattgtgacactacctctgcaaggtcaactgtctccataggctgttttcatttgcgtagaaataggggggaaagatagcttgaagtcatcaggagccctgcaacccatggattaccaatgttgctaactggagcctggatttcatcttcaattgattgtaatgatgtcttgttctctcaaatctttgcaaatctaggcatttataagactatcctgtaggtcccttacaagaccatgaggatgctagaacttaccctagtcttttcttgtaattgcttaaatgttagtattggcaaatggggtttggtgattataagagtaaaaaaacctgctgccatcccacatttgtgagcagaggatacatttcctatcttgtgtccatttaaaaagaatgattgcttgattggcttcctgatgacaacccatgatatactgattctgttagtttataactttcctagtagtcatatgcttataggccaattttatccttgccatgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtgttttggcactagaaaacacaaaatatgtcctctgtgtctactaggaatgcctctcttcatttagtcctgcttgagtgctcatgatggaaaaatatagactgaaaacaggagcaaaagtgttcatcctactcattccttgtggggtctctttgctttcaaagagatgttagagatgttagtaaatggtgttagaagaaacaatgtaaattgcctgtttagtaagatgatccagtttctaaggaactgttttactggcgccttccatgctaacaaattctgagaaatatttgcggatttctcagtgaagccaaagcactctcttttgactcctatttactctcagagaaaaaaactattcatccatttgaaaagcagggaccaattcaacaagcagaatattccctctactaagcctttggccagagagttgttgctctagttctttccatcactcctgcatcaggaggctctgcctgcaggaaatagtattggacaacagaaagttcttttacttgtaggcataaaataggtataaattctcctccttaagagaaaaacaggttgctgcaccagaaagaacatttgcctcttctactaaatagcagactgttttccaatgataaactcattttaaatagaaaaaaaaaagtcattctctacaaacaagaacattttcattttaggttgtttattgtaaatatttcagaaaaaaaatatgcaaaaaaaaaaatgcccaaaaatcaatgcttccagtaacatatttattagctatctttttccccatgtaaaacttcaggtaaattctttgcagattttttacttggaagaatgataaaaaaaaaaaaaaaagttctgaaatgagttgaattcatccacgtgtgtttttgattcacatgaagagtaggacctccctttatattccctcttcaaattctcccctctgaaaaatgggtggtacactcaaaggaggaccgcacacattgtagtagctggggtgttgggggtggaaggagcaggttttgggggtgggaggagcggtgagtgatcctttcagcaaagtcagtcctgggcaggagacggcttcaggaatactgtcagctttactggattccaccatcgctttccaggactgtttaggccctgggcccttgaagggtttgcgtgcctcttgtctccattcatacctcaagaactttgttcatgttaattttttttcactctatcatatggaattgagtaaaaaaagaaaaaaaaaaggaagccaacacttacttaactgctttaatgtataggactctgttctgggttgtcttctaaagtacatttcattcaatgtgtgagaatacagataggaaagagttttgctagtttctattttgactgtggatccattgattctttctggttctcagcccttaattgctcagctgcagataccacttgactgactcttaaaagtctttggtttattgcccaattctgggaatatgaaactgtaagctgtttaggagaaaaactgagaccaaaagaaaggagaagtgagccaaactgccattatgactgccacttcttattgaagataaatcaaaatatccatttgactagaaatcaattgaattatgcactttaaatgggccaattcaatgatacctgaactatatctcaaaaaaggtgttaaacacaggcacacacgtacacacacatattggaattccaggaaaagtcactttgatcaacaagattatcagtcgtcaaagtgcttggaagggttctattggaataaagctaaaaaaaatcaaagtaaaatttctccttaaaaacaaaagcaattaagcagcactgtattataaaatatgctaagctgcaagtcaaaattcttaagagacttaagcctgtaagcagtaaggatccactcaatgtaaagttactccagagggaaaggcgtgagcccaaccaaagtattaatgctgtgtaggaggttaatttgactcttcttaacatttttacacaccacattatgttttattcaccatttattattaactgaatttattaaagtataatcaaaataatatttttgagagtttaaaaatattctcataatatttaagttacatatactatgcagggaccgtcaagtaattccactctgacatctgtatttattaccgccacctgtccatgatggtattagaaagatcctcatttgttttaatggatgcctctaaaatccagttttaagagggggttggccactttcaagtttgtgttagttaggattcagtttaacccagctcaacaggtatttactaagtaccagcatatccatagggcgctgtatgatactggaggacacacagaaaagagatgtgtaagaggcactcctgccctcaaggagtttactattgagtggtagtgtaatatgaataaacaaatgaatctgctcaaaagcagggcattctaagcaggccctcaccagcctctcatcattcgcatctagtgtatcttcctccatcactttctaaacgctatggattctgagtgaaaaccaatcgctggtttatgcatgtatgcatatatgaattcattcttgacattgccatgcagagtatttagtataactagacttattatccatttatcctgcctagaagcatactgtaatatatataactctaaaagcaagatcattccttatgttggttcttttgagctggcagggggaaagcagagtatgttggcaggggtctatcaaggtagatgagcccagtttgtacatctttgaaatattaccaatgccaatgtgttagtactgcttggatctcttctatgacaacagttcttattttttccttttttctgtttgtttgttttttgagacaggatcttgctctgtcacctagacaggagcgcagtggtgtgatctcggctcacttcaatttccgcctcctgggttcaagcaattcttgtgcctcagcctacagagtagttgggattacacgcatgcgccatcatgcctggctaatttttgcatttttagtagagatggggttttgccacgttggccaggctggtctggaactcctggcctcaagtgatctacccgccttggcctcccaaattgctgggattacaggtgtgagccaccacacctggcccatcagttcttaatttgatgaatggatagaggtttggcttcaaataaatggagttagtctgtcaatatctgtttcttttaaaatttgcaattgtttttatttttagtgtcatgctatgtgcccttaatgatctagaattaagttctaatctctaccctggtataattgatttctccctgtggactcctaatataagaagaaagatgaagtttttcttttaatgcttttagagatcttcattaagtcatttaatattcttatttgctatttcccagtgtgatggttaagactgagtgtcaacttgattggattgaaggatacaaagtattaatcctgggtgtgtctgtgagggtgttaccaaaggagattaatatttgagtcagtgggctgtggaaggcacacccacccttaatctggtgggcacgatctagtcagctgccagcgaatataaggcaggcagaaaaacgtgaaaggggaaactggcctagcctcccagcctacatctttctaccatgctgaatgcttcctgcccttgagcattggactccaaaatattcagttttgggactcggactggctctccttgctgctcagcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgacatgttacgggaatactgcttactgcatgatatggtttggctgtgtcctcacccaaatctcatcctgaattttagcctcccatacttcccacgtgttgtgggagggacccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccccagccatgtggaactgtaagtcctttaaacctcttttctttataaattgcccagtctcatgtatgtctttatcagcagcatgaaaacggactaatacactgcatgctcagtatactcaggcactctggaaactaggtttctacttcggacccctgagagaaaagggttatgtatctccaagtgtggtcatgacaagcatcactactgtgtgcagttgggcctgtggattgagccaccttagcctctgaggaaagcagaacctgagagcatgcttaattcagagtgtgtgtgacttggagtgtggaaaggaagatttccagatttgcggtattggcgactgaaaggatggcaatgctattgatggagattaggaagacaggagagaggtagatgttgagcaactccgaggagtttttcctcatacatgttgggtttaaagtgcagggaagatatcctgaaggttattccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaaggatggtgaattgggccaaataccagagagatggacaggagtaagaagaaaaagactaaagatttgttcatcaggagctcattgtttctaaagggagcatttttagtaaagaggaaggaggaataaaatgcagtataatatgttaaatctaagtataatttataaaagagaaaatgggggtggaatattacaaaaaaggaactataaaccagctctttgaggtatttgtcagtgaggaaaacagtggggctctagttcttgatagcaacagcatcaaagggaactttttaaactaaaatattatgaatttttcaaactgaaataatgagagaataatacaaagaaatctcatctgcccataatccaaattcagtagttattaaaattttgccccattgcttaatccattaatctcatttcattttgtcctttttctttgtttatttttggctaaaacattttaaagacaaatcctaaatatcatacatcagtaggcatttacaaaaaaatttcttgataatcacaatgccattctcataccaaataaacttataataattctgtgatatcatctaaaaaacagttcttttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcccttacatttttgtaaataaaatgttactggaacactgtcacatatgttggggtcatagaaagagtttccgtgtccccaagttataattgcattcacttatattttcttctagtaatttttacccttacatattaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtcttgtctttttctaatatgttaattctgtaccaagatttgttcatctgttaatggatcaatatcacatagctttgtttatagaaggtgcacattgttttaattctggccatgctatcccaccaaatattgccctttgatttttcagagttttactgtggattcttccttgtttctttttctatgtgacctttagaattaacttgtttaattctataagtaaatttattgataattttattgaaattatgtaaaatataaattggcttaggaagtactgatatctccatgacattaagtcttcatatctaagaccaaggggtgccttttcatttgttaaatattctttgtgtctttcagaagtgttttcaagtatccttatgtgtattttgcacaaatttttatatttgtgcctattggatgccacgtgcagggttaaaaaatattatacctattttatatagatatatatgtatataaaaatatatattatatatagttataatacataaatatattttaatatattatataatatatacatgtattgtatttatatatgtatttatatgtgtatctataaatatacatatgtatgtatctataaatatacatatatgtgtacatatacacatatatacacattatatgtatgtttatacacatataaatacatatataaatatactagaaagtccatggggtttcctagtatacaatcatattgtctgcaaatagagattgttataccttttcctttctattccaaagtgtctaaaagattttttcttagctagtggcattggatgacacctataatgtcttctaaaaatagtagcagtcataggcaccatttccttattcttgaatattcattcatgttacaaagtttataggaatttctgaattattaagtacttttaataggaatgaaggttattgtcattattgcatcaaaattcataagaaagtttggtgtcaaatttgtgctttgtgtgtagtcttcatcacgcttttttttttttttttaaccagtgttaaacatccattacaaaaatagtttggaagtttttctttttttttttcctatgtcctggaaggtgtaagtagaattggaattatttgatctttaagatgtaaaatattggtagaattctacctttgaaagcacctggacatggtgacttcttaataggtgagctctctggaaactttatttcttctgtagtaattggtctccttagactttctattccttctggagtcagatattgtatatcaaatcttctgttaaagttatccatttcttcttggtattccaatttttcacattgagttggacaaatgatttctgatgatgtttaaaaaatttctctggtttgatggttactttgaccgtataatttattttgtgtatttatgcttcttttagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagtctacaatcggattttacttattagtcaatctgagaatacttttaatagatgagttacacaaatacatatttattgataccaacacagtttaattcaagatctgttctattattttatatttattatatattaaattgtcttctttatttactatttattgatttattgaatttattttgctttcaggtattttgtatttttgttctggttgttagatttatgcatacttagtcaactcttcctttataaagcattcattttctactatgagcagtagtaaaattagctagtaacttaattcctgagcactctccagtcctagtcactagtaataacgcagtgttaaactttgtaatattaattatacttaagcctctattacttggtttgtcaaaatcaaatgatatcaatttacttccagcacatacctatgaggtaattgtaagctaataataacttccatggctattcttttctctttttttttttttgaggtggagtttcgctcttgttgcccaggttggagtgcaatggcacgatctcggctcactgcaacttctgcctcccgggttccagcgattctcctgcctcagcctcccaagtacctgggattacaggcatcagccaccccacctggctaattttgtatttttagtagagacagggtttccccatgttggccaggctggtcacgaattcctgacctcaagtgatccaccccatcagtctcccacagtgctgggattacaggtgtaagccaccgcacccagcctctcatcttatttttattacttatatttttctacattattagaagttataatacttatatgcacatttctttagccccaaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatgttgctcacaagaagctggatgccagtctgattttctttccctcattagtgatttggactttttgtctgaatgttgaatttttaaatataaacataaattgcaatacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatcataaggttagcagattgagaccatcctggataacatggtgaaaccccgtctctactaaaaatacaaaaaatatagccaggtgtggtggcaggcacctgtagtcccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagcgcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgcaagcgaggctaggggacgggcgcctgccattgctgaggcttgagtaggtaaacaaagtggctgggaagctggaactgggtggagcccaccgcagctcaaggaggcctgcctgtctctgtagactccacctctgggggcagggcatagccaaacagaaggcagcagaaacctctgcagactgaaatgtccctgtctgacagctttgaagacagtagtggttctcccagcatgcagcttgagatctgagaacgggcagactgcctcctcaagtgggtccctgacccccgagtagcctaactgggcacaccccagtaggggcagactgacacctcacatggccgggtactcctctgagacaaaacctccagaggaacgatcaggcagcaacatttgctgttcaccaatatccgctgttctgcagcctccgctgctgatacccaggcaaacagggtctggagtggacctccagcaaactctgacagacctgcagctgagggtcctgactgttagaaggaaaactaacaaacagaaaggacatccacaccaaaatcccatctgtacgtcaccatcatcaaagaccaaaggtagataaatccacaaagatggggaaaaaacagagtagaaaaacagaaagttctaaaaatcagagcacctctcctcctccaaaggaacgcagctcctcaccagcaacggaacaaagctggatggagaatgactttgactaattgagaaaagaaggcttcagacgatgaaaattttctgaactaaaggaggaagttcgaacccacggcaaagaagttaaaaaccttgaaaaaagattagacgaatggctacctagaataaccaatgcacagaagtccttaaaggacctgatggagctgacaaccaaggcacaagaactatgtgacgaatgcacaagcttcagtagctgattcaatcaactggaagaaaggttatcagtgatggaagatcaaatgaatgaaatgaagtgagaagagaagtttagagaaagaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcacattcaggaaatacagagaacaccacaaagatactccttgagaagagcaactccaagacacataattgacagattcaccaaagttgaaatgaaggaaaaaatgttaagggcagccagagagaaagattgggttacccacaaagggaagcccatcagactaacagcggatctcttggcagaaactctacaagccagaagagagtgggggccgatattacacattcttaaagaaaagaattttcaacccagaatctcatatccagccaaactaagcttcataagtgaaggagaaataaaatactttacagacaagcaaatgctgagagattttgtcaccaccaggcctgccctacaagagctcctgaaggaagcactaaacacggaaaggaacaactagtaccagccactgcaaaaacatgcaaattggaaagaccatcgaggctaggaagaaactgcaactaacaagcaaaataagcagctaacatcataatgacaggatcaaattcacacataacaatattaaccttaaatgtaaatgggctaaatgcttcaattaaaagacacagactggcaaattggataaagagtcaagacccatcagcgtgctgtattcaggaaacccatctcacgtgcagagacacacataggctcaaaataaagggatggaggaaaatctaccaagcaaatggaaaacaaaaaaaggcaggggttgcaatcctagtctctgttaaaacagactttaaaccaacaaagatcaaaagagacaaagaaggccattacataatagtaaagggatcaattcaacaagaagagctaactatcctaaatatatatgcacccaatacaggagcacccagattcataaagcaagtccttagtgacctacaaagagacttagactcccacacaataataatgggagactttaacatcccactgtcaacattagacagatcaacgagacagaaaattaacaaggatatccaggaactgaactcagctctgcaccaagcagacctaatagacatctacagaactctccaccccaaatcaacagattatacattcttctcagcaccacgccggacttaatccaaaattgaccacatagttggaagtaaaacactcctcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaactttatagcactaaatgcccgcaagagaaagcaggaaagatctaaaattgacaccctaacatcacaattaaaagaactagagaagcaagagcaaacacgttcaaaagctagcagaagacaagaaataactaagatcagagcagaactgaaggagatagagacacaaaaaacccttcaaaaaatcaatgaatctaggagctggttttttgaaaagatcaataaaactgatagactgctagcatgactaataaagaagaaaagagagaagaatcaaatagatgcaataaaaaatgataaaggggatatcaccactgatcccacagaaatacaaactaccatcagagaatactataaacacctctacacaaataaactagaacatctagaagaaatggataaattcctcgacacatacaccctcccaagactaaaccaggaagaagctgaatctctgaatagaccaataataggctctgaagttgaggcaataattaatagcttaccaatcaaaaaaaagtccaggaccagacggattcacagctgaattctaccagaggtacaaggaggagctggtaccattccttcggaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctgagtaaaatactggcaaaccgaatccagcagcacatcaaaaagcttatccaccatggtcaagtgggcttcatccctgggatgcaaggctggttcaacatatgcaagtcaataaacataatccagcatataaacagaaccaatgacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatggacaaaacctgggagcattccctttgaaaactggcacaagacagggatgccctctctcaccactcctattcaacatagtgttggaagttctggttagggcaatcaggcaggagaaggaaataaagggtattcaattaggaaaagaggaagtcaaattgtccctgtttgcagatgacatgattgcatatctagaaaactccatcgtctcagcgcaaaatctccttaagctgataagcagcttcagcaaagtctcaggatacaaaatcaatgtgcaaaaatcacaggcattcttatacaccaataacagacaaacagagagccaaatcatgagtgaacttccattcacaattgcttcaaaggaataaaatacctaagaatccaacttacaagggatgtgaaggacctcttcaaggagaactacaaaccactgctcaacaaaataaaagaagatacaaacaaatgcaagaacattccatgcttatgggtaggaagaatcaatatcatgaaaatggccatactgcccaaggtaatttatagattcaatgctatccccatcaagctaccaatgactttcttcacagaattggaaaaaactactttaaagttcatatggaaccaaaaaagagcccgcattgccaagtcaatcataagccaaaagaacaaagctggaggcatcatgctacctgacttcaaactatactacaaggccacagtaacgaaaacagcatggtactggtaccaaaacagagatatagaccaatggaacagaacagagccctcagaaataatgccatgtatctacaactgtctgatctttgacaaacctgagaaaaacaagaaatggggaaaggattccctatttaataaatggtgctgggaaaactggctagccatatgtagaaagctgaaactggatcccttccttacaccttatacaaaaattaattcaagatggattaaagacttaaatgttagatcaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagaaactaccatcagagtgaacaggcaacctacagaatgggagaaaatctttgcaatctactcatttgacaaagggctaatatccagaatctacaaagaactcaaacaaatttacaagaaaaaaacaaacaacaccatcaacaaatgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgattattaagaagtcagggaaaaacaggtgctggagaggatgtggagaaataggaagacttttacactgttggtgggactgtaaactagttcaaccattgtggaattcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattgtgagcgaactatcacaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaatactagtttggctgcattgctttgattttcttctttaggggcctgttcatacatacaaaggataccatttacctgtcttctatatgactttctcttaaatcctttcattcttttgttttaatttttatcttcacatcctttatttctgtcactgtgctgtccatagagtttgtctgctgtgtgtccttataattaagtctatgttctgaatgtttttccttttttagaaattcagttctaaagtgtttaatttctcgtatttttttttctgttgcctcaccatatcatttctgagttttctgtttctgaaatgtgcaactaactctttccaagcattgaccagattcttcagtctttttaattcattctgaaataactgggctacagtttcatctgctttgtggacagaagtgccacaaagagccgaattgtcagtgcagacccacatgaatcatagatcttaacgaggtttttactaacgactagcaaaggatacaagctaaaaatgggtacaagcaaacacagcatcattcatcactgtaaagactctgaactatcacatggaacttcaaaaggattcttcttctttgctgcaatgtgttttgatttttggagtgatagatgtttgctaactacgcacgtgacaaaaatttgcttagaggaagccatgttagttttgatgctactcaactttgtattttgttagtcatgagatagaaagcctgtgagattacatgcccttcttttagcagctgcatcccataaaattaaaaattccagttttttttaaaccatgaacaatttagtcagacttaatatatcctatttaaaacattcttagataagaacttcctttgttattttgctaatatacaatcccaccaaatgtctacaagaagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatcaaatattatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgcatttagaaatggtatgttctggaaaatggaactgaaatgttttagcgagagtcatgggcccaaaccttgaaatagaggttggtggagttttctatagtatgtaattacaacacaataagactcaaaagcatttcaataaagtgtggatggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttacatttatttcttaaagaagcttctggtaaattagagcaatagcatcggcttagtttagtgttgttctgttggactaaggatatcagttctatccgtatggtcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaagatatcaagataatctcttatttctttcttgaaaatgcaagtacaaatgcctgcaaagataaaatatcctctggatggagtggaaaggttcaccaggcctctgaaatcacgtgaatgatgttgcgctttgctgttaatgaagctcggtgcatttttcatttcagtttctactaagcatttatgagctattacccttcccttccctaaactgcgttgttttttaaaaagccttagaggcattccttctagaaaataaaggtaagtgttaagtggtgataatttggtaataggtgtcatgcttgtggttcataatgtgttaccctacacattttctcaattatccctagaacagctttttgaggatatgaagttagaccttacaaagcacatctttctgctggaaaaatgaggtttatagtggttaagtttagttgcttatgatcacaaggctagagagtggccggaatcaagactcttcaccctgatttcagtgctttttcactccaccattaatatttattgttgataaataatatcaacactttcctaggtgtattagggtcatctagagggacaggactaataggatagatgtatatatgaaaaggagtttattaaggagtattgactcacaccatcacaaggtgacgtcccacaataggccatctgcaagctgaggggcaaggaagccagtctgagtcccaaaacctcaaaaatagggaagctgacagtgcagccttcagtctgtggccaaaggcccaagagcccctggcaaaccactagtgtaggtccaagagtccaaaagctaaaggattggagtccaatgtttgagggcaggaagcatccgtcatgggagaaagatggaagccagaagacagccagtctagtccttccacgttcctctgcctgcttttatcctagccacgctggcatgatgatgacatggtgcccgcccagattgaggatgggtctccatcttccagttcactgacacaaatgttaatcttctttggtaataccctcacagacacacccaaggacagcactttgcatccttcaatacaatcaagttggcactcagtaataaccatcacaagtccacaccttgtcaacttgatcccacatacatctccttaaatcatacataatctccaaatacagacaataatgtcataattacactgaacataatacaactatcgttcatacaaccagaaatgcaccaattcccaaaccaaatgttattacataaagttaacaacacttaaatgctgatatgaagtcaataaatactttttttttttaaaagatggagtcttgctttgttgcccaggctggaatgcagtggtgcgatattggctcactgcaacctccgcctcctgggttcaagcaattctctgcctcagcctcccgagtagctgggattacaggcacccaccgccacacctggctaatttttgtatttttagtaaagacggggttttgccatcctggccaggctggtcttgaactcctgacctcgtgatccacccacctcggcctcccaaagtggtggatcccaaagtgatccacccaccttgacctcccaggttgtaagccactaaatcttatgtcacatgatacaggaaaaagaaaggaagtaaaatgaagatattgtcttagtacaagtgtatacaggcagaaagatgttcttaacaaaataaggaggaaatactcatgacaattacagtaacctggttgctgcaactcatcacatggtcgtagctgttattgatgactaccttcttctacaacccattctgttttccctttgcctctagcaagtacctcagcaggtcatggttctttacctggtggagtgtcccaaaccttcattcctgaagggtctgggccatttgtagtcctgcctggatcgagttgttgtcattttttattgaccttaatcacagggcatggtaatactaagagacaccctaaggaatttcctgtattccacacatgttcttccttaccttcattatggagtagtagactgagttcatcttgataggctaagtcagtcaccccagccaacactaactcctttcttagcctgttgacttagaggtaggaggagcccgagattgcaatcttaatttccagtttaatgaaatcattattgtgtctcctggtggcaacattcatcgccctggaactgagacttctaggccagcagaacgtaatgctgtggaacaagaagcacaaattttactagcgggtctctaggggtgatggtgagtggtgccacttccatttccaccccttgattcctggacccatgaatcctggctatgggagaaacagtaccaaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgaccactcagagaggtccatccatccacatacctcttccccaaatttcattgtcatcagttttccaatcatgcttctttcaagtccctgaccatccagccaaaccattggctacctcccatgaatcagtatataatcacacatcttgccatttctccttctaagcaaagtgcacagccaggggcactgctcaaagttctgtgcattgggaagatttcccttcactgctgcccttcagggatgtcctagaaaggggctgtagtgctgcagctgtccacttttgggtggtgactgcatcatgcagagccatctgtaaaccaggcccttgtcttctcttcctctgtcagcttatcatagggaactccccatgaggccatcagtgcaggctgggggagagaaggcagggtggcaggagtggggaccatgggcatttgagctacttcctcatgtaaagtacttgttccctcaggacttgcttgagcctgatcatgtatataccacttccatttgatgatggaatgctgctgtgcacaacccactttatggctagatgggtcaaaaagcatctagttcatgataggcaatttaggtagcttggtgatttgatgacctgtagtcaaacatacagtttctaccaaagcacagtaacaggccaagagttgtctctcacaaggagagtagttatctgcaggagatgcagggccttgctccaaattcctagaggcctcccctgtgattgacctataggggcctgccaagggctccaaacaacatccctatctgccattgacacttcaagcaccattggatctgccaggtcatatggcccaagtggcagagcagcttgccaagcattctggacctgttgcagagccttctcttctggatcccactcaaaactggaagcctttcaggtcacttgataaatgggctggagtaacacacccaaatgaggaatgtgttgcctccaaaatccaaataggcctgctaggcattgtgcctctttcttagttgtaggaggggccaaaggcagcaacttatccttcatcttagaaggaatatcttgacagaccccacaccactggacccctagaagttttactgaggtagaagttccctaaattttagtcaattttatttcccaacctctggcacacaagtgtctcaccaataaatccagtatgtttgctacttcttgctcattggatccaatcagcataatgtcatgaatataatggaccagtgtgatatcttgtggaagagaaaaactatcaagatctctccaacaagattatgacacaaagctggagaatcgatatacccctgaggtaggacagtaaaggtatattgctggccttgccagctgaaggcaaattgcttctgctgggccttatggacaggaatggagaaaaagccatttgccaaatcaatggttgcataccaggtaccaggagatgtgttaatttgctcaagtaatgaacccatatctggtccagcagctgcaattggagtcaccgcttagttaagcttacaataatccactgtcattttacaagatccatctgtcttctgcacaggccaaacaggaaagttgaacggggatgtggtgggaatcgccacccctgcatctttgaagtccttgatggtggcactaacttcctccagggatgcaatgttgtgtttgatttactatttttctaggtagaggcagctgtaatggcttccatttggcctttcccaccataatagccctcaccctaccagtcagggagccaatgtgggggttctgccagctgctaaatatgtctatgccaattatgcattctggcactagggaaatgaccacaggatgagtctgggacccaccagccccactgtaagttggacctgagctaaaattccattaattaactgatctccaaaagcccctactttaactggaggaccacgtgatgttttgggtcccctggaatcaacgtcagctcagagccagtgtccagttgtccctgaaatgtctgattatttccctttccccagtgcacagttaccctggtaaaaggccagaggtctcctgggggaaggatgggagaaagagtcactgcataaattgtcagcaatgtagtggggtccttcctcaaggggacccagcctccccttcattcaaggggttctgggtctataaactggttcaagtctgcaaattgattgaggggccgtgattctttgtataatttttaatttaaattagtcttttgtctacttgacctggaagttttctgcttatataaattaagcaagaatgcagtaggcctcttgtcaatttcactttttaggaacactgagattaagtagccaatgccagagctctacacaagtcagactattctgattgttgccttgcctccgctgacctttacggtaattgcacccaccttgccttgatgcttgagtgccaccacttggcccatgccacctcaggatccaattattaccattgtatttaaattttgtagttgaatgactgtggttcccactataatatctagcatgcagagaagagcaatcacagagctcttcaaggatgcagctgctgccctcacaaatctatttcacaatgtgctggtcaaaggtatatcttctgtactctcccagctgggatgagtaggactaaagtgacgaattcactccaccatcccaatctccataagcctttggatcccttcctctacattaaaccaagggagatcaggcatttccagctcactcacagtgggccaccttttgatctatatttcagctaaccaagcaaataaactattagaaccttttttaactctccaagctgcaacattaaatgcagaattcctgcttagtgggcccaaatcaatcaattcagcctgatccaactttatgttccttctaccattagcccacacccttaatatccattcccatgcctgttctccagatttctgcttatataaattagaaaactcaagcagttcttttggagtgtagcgcacctccttgtgggtcacattctgaacctcatctctaaggggcctgccgggactttagtctagttctataactataagcaaacaggggtattgagggtgggtccttaggagaatcaacatcgtctttcctggcaactgcctcaagggaggtcatcgctgatgccttaggcagtgcagggttaaactcctcagacaaaggtgaaaagcctgatggcagcgcaggtggaggaggggatgttgcctcccctctgttgcctgtttcctctggtaaaaaagattcatcagaatttagaagctcagtgcccccagccttatcagggtcctcccgcatggccccattccaagttgcagggtaccattctttttcaatcaatgctgtcactttaacagtaaacacctggcaaggctgtgcacgtacctttcgttgcaggtcagccactcacatgataagagcttgtgtctgattttccgcaatttcagctctttctctacaggagataagactcgaacccagggcaatcttagaagatttgaggctcagaatgtggttctggagctgggagatagaatccctgagttcatcatttttttgttttcatcactttgattagtgaacttaggagcaaccaactagcttcattatattccttggttctccacatatggttaaaggtattaggtataaagtcactaaactccttgcctctcatgagcagtgaatcaggagtatcagatgcatttattttgcataactctctacacagttcacagcaaggactatcagtgttctccacactattagaagtagagtccctagcattttggcgtctaatcatatttagcagccaactccagaaaccccaaaaccatctaaagaaatccatccgtaaaattctgttcctctagaaccactcctggtaccaaaatctgtattagtcaggattcgctagagggacaggactcacaggtgagatgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagtctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccgtgttcctctgcctgtttttgtcctagccatgctggcagctgattagatggtgcccacccagattgaggatgggtctccatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatatcagtataaattagataactgccaagtgagagaggtagaggtagcaagtgctgtctgtgggtgcatgttaactcagtcttaatcttggaagaagtggcagtgtggaatggtacatggagaagcagaagggacaattactgtgagcagatgaatggctcactacaggggcatgggaagaagatgcaagagcagtggaatctttaattgacgaacctggtaccaagctgccaagtcttagtctcaggactggcaccgtgcacttggccattgaaaagactttggaacctgtggagtgaagagttgtaggaattttcaaagcctcagtgtaggaacaatgtgagaatcaaccagggcatggtactccacactgtgttcagatccactggtgttaggggagtcccagagaggcctcttagagggttgaggaggatgggatcaggcatagcagagactagggacacgaggctctgcggccagactgcaggtctgctaccaactacagtgtgattttgcctagtcacataatctctgtgggcctcagttttttgttttttgtttttttctattacaacagtacctttctcgtggagttgtagtgattagatatctagtaccaagactatgcttgttagcactgagtaagaactcaatgaaggttagctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacgcctgagatctaggccagcactttgcaagttgtgctctatgggacttttcatggaagtggctgaggagttgccttgaaggaaggcagagggagtgggtcttgggacacccttccagttataaaacaggacgttgattctgttttgtagttgcagcatcacatataatttcatttattaagaggatcccacttctaaaaataagttgaaaaccagtgatttaatccagcctctctgtttgcatatgaggaaatggaattccggaaaggttaggtgatttgtccaaggttgcagactagactatttattaatagagtagggtcaggaacaaaagcctgctccttgctggtccagcgcctgttactagttacataatgaatgctacctattgctgcacagtgccaaatcattgcacttttcagattttactctaatcaaaagaaaaaaattaaagtgcacttccaaatcagtacttatatgcaagagcttcaagaaacaaactagtatttaacttggtggttacatattgactgtattttcattgagtgaggttagaagagattgagaagcgtgaaatgaagttacaaagtagaaactatatggtgaactcaaggcaaagattgtccatagtaaaagaagacaaaataagaatgaaagagacaaaagaattgccaatgagttgtaatcttaaaagaaagatatatttaataaaataggattgattgttttgaatgtgggctgagaagtcctgccatcttccattgactctgctcacaggccttgtttgtgaactggcttccatggatagcattactctcctgacagctgcagctccaaattcagcatgaaaaggctggcaattctaagaggaagggagggtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaagtttttctcttttaaaaatgaagtctggaatatctccaaacatcttgtcactcacgccttcatttaaatgtcaccctctcaaccacaaggaaactaaaattgccccctacttgctactccctgttttattttctagtagaacatactacagttggagatcatctcatccatgtcttttattcttgtctcttatttgcctctgcttgactgtaagctcatggaaagtaagggaccttcaccaactagcaaagtgcttaggacctagtaagaacctggtcaattctaactgagtgaatgactgaattcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgccagtggaatgaacgggttaagaaatgtgagttttcttttcgtcctgctatagagacttaaggaattgccccgtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggccactatgtgctcccggctctccaggctcatccagggccactgtgcctggggtcacagggttccaggatgtcaaccttctttcagcttctctgactcctcaagcatttttttttttttttttttttttttttggcttccaagacccaaacgcatgtctctcttcttggcacactcttcccaacttttttcctggctaattgctagttatttagtttgagattaaatgtcactccctcggcctggcgcggtggctcacgcctgtaatcccagcactttcggacgccgaggcaggtggatcacgaggtcaagagatcgagaccatcctggccaacatggtgaaaccccgtctctattaaaaatacaaaaaaatttagccaggcgtggtggcatgtgcctgaagtcccagttactcgggaggctgaggcaggggaattgcttgaggaggatattgcagtgagctggatcgcacctctgcactccagcctggagacaaagtgtgacaccatctcaaaaaaaaaaaaaaaaaaaaaagtcactcactcacagagggcttctcagatactcccctgccccctcatttaagttgcaccgcttgttgtattctcttataagccccattctttttcttcttggcattgatcaaattaacagctttattttattttagcattgtgagtgtatatgtgtgtttaatgtctgcttcctgactaaactgtaccctgcaggaaggcaaaactgtgtctgtgttgctcattgttaaaccttcagcactgaactcagtgcctcgaacataggagattccaactcaatatttactgcgtgaaggaatgaatgaatctttatgtccctcgtgcctaacataaagtctgccatatacaatggactaaaaaatagtattcagctaaaactgagttacggagaagatgaagtattaattgtattttttacagagaaacaatggtcagtgtatcaaaaatagagaccctgctctcagatatataacatagaactctcttcattcatttgccttcattttagttaacagaatctgttcatctaagtagagcagagaaaaacttcataattgctgtgtctgtgttattccaaaacatttaaacaaaaggtgaataactgaggtattcttccctgtggtacatacttgatgtgggcattttaaaagattgatcaaatctcctttcagctggatatttgagtaggcacaaccattacagaattttcctctagggacttactttagctcttaaactatgtaaactgaacaagcaaactcaagtggatcattatctatagaagtatagaattccatctccctttggcaaaccattcaaacccagaagtgtgttttacacattctgacagaagcatctgtaataaccaactctaacctcctttcttaccactttagcacccaaaagtataagaaaagaggacatgttaaggcttgttctatttattagaaaatatataaagagttcttggcttaagaactcttctggctatcagctccctgatgtgaaaaaagtaaatagcaaggggtagcatggagtcttactcccgtgtgacagacagcttaagaaagacaattggacatcatgtgactacatgattcaagctaaagtccagacacatcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctctgtgccagggatgtgattagaggaccctgggagggccttcatcctacgaggggttggaagtggaaatggatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaattgctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgatatatttttagcccatttgccttgacccatagcttacaacagttaaagaacactaacatataaacatagagttttgcccaaggccattagctttgcatgttaacaagtgggcagaaggaaggctgggcatgagagagacatgctgtccttctggtgagatcatcaatcccattcttgtaaccttcagatcattgcatttgttcagaatcgtctgcagaggaaaacatctcaaagttgggaggttgttgaagagtcagaaacaaatgggtcctgggtaatttttcaaaacaggctttttgtcaattgtcagtcagctgtttaatattgtcaattgtcactcagctgtttaatattgtgctttgttataaggataggcactgtggtctcagcgttcttaagcttttacatttccgttatttggttttacttctgcattagtagagtagatgtagagtagatgccacctctaggaactctaccagcagcagcatcttagactagaagctccctctctaggactataatctctgtagcctccacttctcccaccccttatttcttctgagcctacttggtctttgatacttactataatactttctattctcttatcataaacagttttctgatttcattttcctctggtttcatactaagccccataatcagtcactgcaagattaccttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgactaggatctcaatctggtttgcaaatccatgcttctctttcttgacttctttagacatcaacagaattgacgcctcctcttgacctgggacacccctcctccttggtgctttcttctacctccccctgcttctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgtccctcaccatttcaaacttctcttccacagggagtccctggttttcactaccatagcatattaaaataccatgcatttcccttcataccactaattacaactttgtttcttttttttaaattttatgttttaaaaattatcttctgcccacatatattgtaagctccttttgagaaagacacattgctgtcctggtcattactatattcttatcaactagcaggggccgtggtcggggcttgtgttagtccattttgtgctgctataaaggaatacctgatgccaggtaatttataaagaaaataggttttatttggctgagggttttgcaaactgtacaagaagcatggcgccagcatctacttctggtgaggcctgaagcagcttttactcatggtggaaggcaaagagagagcaggcgtttcacacagcaaaggagagagcaagagagatgccaggctccttaaacgacctgctctcccataaactgaaagagcaagaactcactcattacggtaggatggcaccaaaacagttgtgagggatccaccccgaacacctcccaccatgccccacctccaacactgggatcaaatttcaatgtgagatttggagggaacacacatctaccctttatcagtgctcaataagctcgctgaatgtagaacagtgatataaggcaggggtgggccaagtataggcgacaggacaaatttggcctgctactgcttttgtaaataaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacctccaaaggcaggatgggggtgaggtggggtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgtttagtaaaaaaattgtttactaaaaaattaacctctcagaatttctgcattcacatttatttcttctcatatcctcgagttagaaaaaggtatttctctcctgtgatgatattgattctgcactcatctattttcattactgtctccttccctccctccctcagtccctcccttagtctatctcactctaccatcttttcctttggaccttctgacattcaacatcttggtcgctcctatccagccacacctctgaccattcaaccatttgtcctcttgattggttccaccttgtcctatcacgctggatatgctgttgctcccaaattgcctccctctgccagtttcttgccccttcctccttctgtctctccctctctctttcaatctttctctccctcagtctctctttctctttccctctctctcaatctttctcttcctcagtctctctcccattctctttctctttctctcaatctctctcttcctctctctcttatcctctctttctctcaatccctctctccctctttctctctctcaatctgtttctctgttaatctctctttctctctccttctttctgtctctgtctctgtctgcctctctctctctctctctcttccctagtgagctcacttgctttcccagtttcagtgatttctattcagatatctccaaaatttgtatttccggatattttatgctttcatggaggccgtgtaaattggtataacctttttggaaggcgttttggcaatacttagtaaaaggttaaatgtttacaccccttgattctgctattgtatgtgtaaggattttttcctgcatacttttgtaagtgtagaaaatatatgtataggaataattgcacattgtttgttgtagctgaaaattacaaataatataaatgcctataatcagagcagttaaatacatatgaacacagtgaaataccaggcactcatttaaaagatgaggtatattttaacaagcctatttgaaaagatacccaatcttagcaagtgaaaaaaaaactcatcaaattgatatatttagcgctgtccctctctcaagtttcagacccacattttcaattttctgttgtcatcttgacttagtctcgtgaaattttaaactaatcatttttaagggaagatattttcttcccttaaaaatgaaattcagacaaacctctgaatttccctctttctgctaatttcttgctttcttttatcatctttccatccatcctaacatacagttccagaggagtctttaaatccttccttattgcctaacaccgaggatcatttgctgaaatcttgttgatttttccctcagatcaacaaaggattttcagaatagccctgatttctctttatcaccacggtgctgtctcacgtcttctctccccctcctcctacctgccgtctcttccagactcgtctctctcccccaatctcctttgcgcactgatgccaaattagtcacaacaaaagtgtttacgtgatcgtgtcacccactggtaagctcttaatggtcttcccttacacattatctcccatttcatctcaggagccttttattaaccactcttcacagtctgactcagccctctttgccagtttctctctttacaaatagcaaagtctatgagctagattactcaatattccctgaataggtcttctcttctcccacctcttggcctttccagtaccattcaatcttcctggaaattcctgaaatttctttcctcctcactcagtcaatgttttgagacccacatcaaatgctacatactatttgttcctttactgatcatgccagttggaaatgattcgaatctgtaaagcagggtgctatggaatgacatttcttatagccctttggtcatttgggagcaatgtctaacataatatcctccaggtccatccatgttgttgcaagcgacaggatttccttcttgttaaagggtgagtagcattccattgtacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacgttgtgatgtttctgtctgtatactcattcagacacacagagtttaagtaatttgttcaagatcacaaagttagtaaatggtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaagaagctctttcaatacatctaatcttgccactattgattttgaacagcatcttaatttgttacctttttaaaaccatattgtacttttcttcaggacagctaaattaaatgtcttatgttgatcccctgggttttctcagtttccatttatcagtttccttttatataaagagatgctaatgggtaaccttacattttgtaaggcatatttttgaagatatacaagtgaaggtttgatctgtacaccctcgttagagctctttattttacatgtggaggaagagatgccttagggcttctgaaaaacaggcttttatttttatagaggagaaacttccagaacatgccatgagcaaatgctctgtcaagtctggttctttcccccattacttaagtgcaaatggaccacatttgaagaagataagtagcagaacaaggctccccacaaggggattttgaggtgctctgaaaaccagactgacataatccatggaggagttcatcactgcaggctgtcacgtctcacagtgggagtcataggctggtctgcttgataaactactcctgatctatgactggagctgtgtgcttcctttaaaaataaatcttgtttttccatgccccacgtgcttctcagcctcaggagcacctcatggatttagactaatcttgtcttttacagtcatgttacttccagattcctaggaatcaccccatttctgatgccgttgatccatccatacccactgaaattgagctaaatgctctagtctgatttgccccttgaagttagtatagaatattttggctagactttgaaaatgaagccctgaccacaatgcataatgacctcagtagacactgaagagttcctttgcatcaggcaagtgacaagtatctatctcatcttcaaagtccacatagatatgtgccagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacactcttgctggaagagtcaagaacgagctcttcgtgggaaactatgggagacgattgaaaaaggacaagaagaaaggagaattgttaagtctccactttctcagtttctgaactgaacttttgctcacagcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacattgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatctctttactgacagtgcccatggctttcttcttggtactctagtgttgagcataagaactagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaagtaatcaacatttttaagtcaaagaaaagaacgtctgtgaaaaagaaaactaatgagctagttgaaaaaatattaattggatctttttctcataccttacgccaaaataaatccccaaaaatggttgcacaacattgtgaatatactgaaatccattgaatcacactctttaaatgggcaaatgttatgttatgtgattatctttcaataaaattgttataaaaatgaataaaccccagaagatcaaaaatttaaacataaaagcatggaagtatactagaaggaaatataagataattttatatgttatgttgtatatatttatatgtaaaatttttttatttatttttctttgcttttaaaagcaagacataatgttctagaggaataaatgaaacgttcgataaatttaattctctattaaatgttttgcagaagaaaataccaggaacaacatcagaagaaaaaacaaaaaaccataagaaaaacaattaaaaatacatatgacaaatggcttattactataatatttaaagaactcttaaaaatctatgtgaaaatgacaaataacagaaaaatacgtgcaaaggacaagagcaggcagtttagagaaagcctataccaatatattctcttatcaacagtctattgtacaagctatttgaaagcaatgtttgaactatcaaaatttaaaatacataagcccttttatctagcaattctacttccaagaatttattctatagctatctgtacacatatccaaagacataaacataaggatagtcattgaatgaaatgtttttaacaacaaaatacttgaaagcaaagaaatgtcacccaagaaagaagtgattgaagaaagtttagcattcagttcagtgaagacatattgagctgtcaaaaaaagttgatggagaactccaaggtctattaactaaaaacaaaacaaggtgctaaacaatatgtttagtgttcatattttaattgtttatatatttcacaaatatatatttgtgcatgcagaaaatattttaacttctttctaaccccgtcaaacacatcatgccaaaattcaacttgtgataaagaaaaaaataaatgaattcctttcgtgtgtagtatctcatttaaattcttcaacaacccaataaaaaagatacagacacatgtttttaagtactacatgttatgcacctttggtttgcttatttaatagttgcaactactaatgttaaattcttgatgccaaggttaaaagcctgaacttctaaaaatatcaagatctgacatttttctgttttcacagattaatctgccatctcctgacctccaacacactgctctatgttctttcatgctgctcctcctcccatgtttaggaccctcttccaaggaggcattcacatctctgcttgatgaaaccctacattatcttaaagcgtccactcgaatgccacctacttatataccatctcctgcaataccaatgggctcagcccaaccatagcccatagttattgtagttgttcttgtacttcaaaagcactacaaaacacaaccatcaggacttgttacattatttgaaggctatgagcatcttcagccgaggccctgtttttattcccagaactaccacattgtttagaatatagtagcagatcaatatacgtgtattagataaatcgtttacccagatcttgatcattttcaattacccataggttgaagaactccatatttaacatggcagacttgaggactgaactacctacctcttctaagaagttgaaatgagaatgttttattgatgggaaattatttttttgttttgccttctagaattcaaatgaatgttcatattccatgaagacaatggctgatagttttttgttaaagatttagaaccagtggatttttatgaatgtgaaccctttcatgtcttgtggaagattttctgttttttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacgttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgccccttcgtatttatttgtttgagaaagcttagctaagagcaacatctgttttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttctttggtggagggctggcacgtgctgacagctttcatgtgggcaatctgggaacttcagagaaggcaggcctattaagtgttaagactccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaaagactggcacccaaacctcaagactatatttctcactgcaggatttggcccctgtctgcctccttctcagactagttaaactttcatactccatccttgttccttcgcttctttcttaggatcttctgtgcacttctttcttaggatcttcttggcacttctttgctcttgaagggcagaaacgctattgtagaaattcaaggcactgtatgctgacatagtttatagttgtctttttcatgagataacacagcggctggcagctcctcttttctatcaaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactagagatatgggtttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctggaagtttggagagggtctctcaaatgccaaaatttccatgggaagccattttcacagctgcttgggagtgggagatattcgtcatcatttctgccccatttagaataatttattactttgcttgcaaaaacccggaatcatccataggacacacgttgtttgtttttccactccacaccaaaggacagaggcattcctggttaatccaagatgccaacttcaagacattctgagaactagctggacagagctgaagtgtagggcaaatcagaacagaagtgatgggcccagggcaaaagcccgtgaagcagcagctgcggaggaaggatgggagctggagctgcaaagggggccatggtggagactctgggcctgcccacagtatcccctctgcccaatgggaattcagttttcctgcatatcattcaattatttctcatttttctaggcctagctcaccttattcgggaagttttgcgactaccccagtccataatgaatttcctctctagactatttcaattcttacagtcactaccacacagtctaggatttggttagttggttgatttcattcatttattcaataattcaatgtttattgagttcctactatggactttgtgccaggtatacaaaactgaatgttactgttgtgtggggtttttttctttgcatttttaaagttaacctggatttttctctcactctttatgcatgtatttcctaatctccctataaactatttgtatttttttggattcctcacagtctatttagcctgtggactgtcaacagatgttacatcattcagtcatttaatagatgcttatttgctagacatggccaggaggacctggaaagtcctcatttttcccatctgttcttaccattctgaaatgtatcatgctcttcagtgctccacagatctagatgatatcaaattattaaatggaaaaagcaagacccatctccttgggttattgtggataagggggaaattgtgtaggaagtgtctattgcagttcatggaccattgtaggcccttagtcaacaacagctatcatcatcactgatgagaatctctggcttaaacggagtaggttcatgccttttttcagtgtaatgaagtgttttagtttaaaggcctttagcaaggcttacaataaaaaaaagtggggactccagggtaacaccaacaatagagacgaccatggctgttatcctgagactattaattatgccacgtaattagatttagagaaaacttagagcaacatttatcttgtggataataattgattgtgattgggacttaccgttgagagaccctgatgaaaactctatggtgaattgctgtggagtcacatgggttcatgcatcattcatcagtgggccctggttttagcctcataacccctgagaatccacctctatcagaaaaccaccctttcagtgaaagttcctcaaggctcagaaaaattcatatgtcaaagctttatatgtaaaaacctatactctctaataaatgtttggtttggccttcacattcaatttaataattatttctacctcttttctaaaccgctcttaaccacagttctatatatttaattctgaagagcctcatgcacctccctccctggtaactttatctacttctctccctggagaaccagccagaccatgattccagccctctgtcctctcttcaaccgtaggtcctctttttctctcctgactcctcaaaccttctccagttacccggatgccttctgtgtgctgctggcttctgcatcactgttcacagggccacttgttcccctggaaatgtcttatgctcttgaaatgctatagccttgttcacctgttcatccaaaactgatcctcagacaacatttctctttcaattggtggaataataaagaggaatatgggtcaaaattcatagacatttaaatacccaaggtgcaaagttaagagaaaacaagataggagaaagaattatggcaacatctctaaaatgtgtactttagtgtttagcaaaaaagggactatggaatgtcaaacaggaacatatatgttaaacataaacatgaagcagtgccagctgctgtctgccatatagtcatgctttgttaatgtggcacatcttgccatgatggtgccctcatgaaacgaaggatgctgaagcagatgccattctgtttgctttgatcagaagccactctctggtcaaggaagtatttgtttcatgcttaattataacaagttctcatcacaaagattattttctttctccagatctggattgtttgcactcactttatattattagacaattactcagattgtttatgtttttatgtttagaaataagacagtgattcagagagtccctgtatttagatgaaagaacattttttaaacatattgactgtaaacactgaaaatcattaattctcaacagttgaaggtttctgacaggaacggcccttggaaattgtaaatgggcacattgtcaggtatgcccattgttgtcacattggagaagattggattctgttctctctggagtcctttgtaatgccaagcttcctctccagggagctggcttattgtcattattttgagataaatggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcatggaattgttgtgacaattgaaagaatgaccagttagtaaagcatcttgcaccatgactagcacacagtagatgcacatgagtgttactaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtagggagttttagcatgaatttgtgggaggtgagaaaaggcagcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactgtagcttctacttaaattggcaaccgcaccaaatataaactgcaaatgtttatagctcttatggaagtataaaagcaaaacaaattcttaaattaaatacaaactaagagggaaactgataataacaatgttttgtgtaattaagttgctgtttgcaacatgcctggggcagactcctggcctctttgcatctgacatgagaggctaccaaggatgtggccacaactgggctctcccagcacttgcttgcgctcagaactgtgccaaaacctttgctcgcccagtgttctgcaacgtccgtcatttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttgtttaaaccatcccccaagactaaaatttgtgaccgggatttagaaccattgacttaattgatgcagaacactctgatattaatgtcttcatgtcttttggaatgtcattaagacaaaagcataaaattttaaaattcttaaagacaatttaaagacctatgagaatccatctttaattctcaggagcgtgtggaacctagtttgaaaactactggcatcgacaattgaatttccactaaaataaaatagctctctagtatattacaaaactacccattctgcaaactgcaggggagctactgataatgcttggaactgtgccaggcactgcctgcataaaaatgagtaaggtccacttcctccatggactgggttgggtaggaggcaaagataattaaccaattattttaatattatgagttcagggttgtaatgaaagtaagtattgagtgctgcagagacccagcaaaggagtccttagctgagaactgatcctttgctgagtgacgaggacattattgaaccgccaggcttgatggcatgttgcatggtaacagaccagtacaccaaacagcaggagctgtagcagagaaagagtttaataattgtgtggcagccaaataaggagacagaaggaaaccttaaatccacctcttgaaaaagtctgggactaggctttttaagagaattctggcaagaaggaggctgaggagctgggggtaactgattggttaggacataggagaggagacaataaggatatagaaactccattcttgcactgggtcagttcctcggagggggtcctcactctggctggcagcagtgaacccattggaatgcaggatctgaaaaatatctcaaaatggcaaacttgaggggttttttttagcatcaaagatgttatctatagaagttaggacattgtgacaggggctacgtgactttgaagtgttaagtggctgtcagaaagtgagctattgcagcggtccccaacctttttggtaccagggaccagcttcatgaaagaaaatttttccacagatggggtggtgtagggtggggtgggggatagcttcgggatgaaactgatccacctcagatcatcaggcattagttagattctcatgaggggcacacagcccagatccctcacatgggcagttcacagtagggttcacagccctatgaggttctaatgccactgctgatctgacaggtggcagagctcaggcagtaatgcttccttgcccaccactcacctcttgctgtgtggctcagttcctgacagattacggactggtaccagtttgcaacccaggcagctggggacctctgggctgtagggtaggctggttaatgcttagctgtgtttctattcaaagcttatgcttttgtttaaaacctagtaatttggttttgttaattttatgaagatgatttcaaggatgagtaggattagctggagtcagaaggacacaagggaatttctggcaacaacattaaactaccagtgaatgtctcatcaagtcactggacctctaattctaagcagtactgtcaaccttataggttatgatgtataagatagtgttgtgatgtataagatagtgcaaaaacctaagttaatatcaccatttctgtagtactctctatttcaaaggaaaaaatcttcagcagtctaatatcctaccaaaattttgaagtcaagacctccctacactaatcaaagaactagaggtgcaatcaggccatatatttggaaaggccataggtgccctccctctgtccttgttcccagcatactaaactatagtctaaaagactttaaaacttgaactgaagaaaaccttaaggaaacaacaacaaaattccatttatttcctgagcccaaaagtagaataattgttttttaatgaatttttctttccctgtaagacatactatgaattgttcaatgggtattcaaagcatatgtaatagaatatgtatgctttcctgaaaaattgaaatggaacatcaaactgttctgtaaagttttgagtctagaccaaactcacagcacttagccagaatatgtacatctgcatctgccactcatggccccatcgctccctccaactgcttctcttgggctgaaggatggaaaagcaaactccctgcgttgagttccatcttgccctgcatggcctcccccatggggtcattgagctccccaccagcttccacctcttccagcactttccgccagagggcccgtggctgcttttgcagactgaaattgattgtggttgattcagctccatttcctctgagtttttactttagatgtgctttttaggttgcatttttcttctggcatataagaaagacagcaatattccatggaacagagtgatgtctgtggctttgtcaaccgttgtttgttagcttgatcaccatttattgagtgtttactactttccaggcattgtgctaagtggtagaaatacaaagttgcctttacttgattcatctgtaaaatagagagagtagtagttcctacagtgtggtttatgtgaggcatagggactgctccctgaaacctagggacaactccctagcagcgacccagtgctcatatcaatagtggtaacaattaggaaggcagctcctacctcaaagacctcatgatctgatggtaaagacagatataacaagaaaattattctttttaaatataaaattgtgatataaaaatagttttcactaaattggatttttatgaaatttacagaaacaaaataataaattaaggaaatataaaaccacctgacattagccaaccatgttgatgttctgattatgttactgcaaaggagtgtagggttaagaacgagggactttgattccaagatcaaatccctttctgctatttcttagctgtctgactttgggcaagttgcttaaaccctttgtgcttctgtgtgcttgcccatgagatggagattataatagcgtctacctcatagggctatttttaatacaagttagctcttagaacaatacctacttaaactaacaatttgtattaggtactgttttattctccatccgtactgtgtatgcatatattcatatttatatttacatattctaattaggattatatacatgtactttctttaaaaataagattttaaataactatataatcagtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccttatcatgcaatgtgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctactggacacgggactgaacatggggttttgctatcactctagctgtgcctttctctagtgatcaaggagatgttggttcagaaagtgccctgtctaatcccactaaggcccgaaggaccaagtgctgtctactctccagattctctgcaacagaaagcagatgcttaggcttcatggtccaggttggaacaggtagttagctctgaggacagttatgcatgaatgtcaggaggggactggcaggggaacatttatttattctttaaaattggaatcaacagttatggatgaaacccagaatgcaaaattcactttcatcttgacacgcaacacatctgtcctttctccttgaatagcaagtattaatcattgagttagacaatgtaaccttcacattcagtgaaagccaaacactcagcaccttctagaaaaatcttagtgccatgctttcttagcatattgcaagtcctctgaggatgatgtgttgttcagctttgaagctgatcttttgtacttgcttatgtagctcaggctagtgataacatgccagaggcatttccaactaagaaaattattcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttctttttatcattgaatactactactccattgtctggattatacacactttatttatacattcacctactgaaggatgtgttggttgcatccaagttttggcaattatgaatgaagttgctgtaaacacccatgtgcaggtaattgtgttgatatgcatttttaatgcttttggataaacactcaggagcacaattgctggattgtatagtatgtttagttttgaaggaaactgccaaaccatcttcccaagtggctgtaccattttccatttccaccaacaatgagtgagagttcctgttgctccacatcctcatcagcatttggtgttgtcaatgttctggattttggccattctaacaggtgtattgtggtatctcattttgttttaattcgcattttttggataatatcacatggagcatcttttaataagcttatttgccatctgtgtgtcttctgtggtgaggtgtctgttaaactctttggtccatttttttaatcaggttgtttgcgttcttatcgttgagttttaaaagctctttgtatattttggataacagtcatttagcaggtatgtcttttgcaaatattttctcccagtctgtggcttgtcttctcattctctggagatcagtggtttttacactttcttctgctgaagccaagtattgtggaagaagccatggggtcaccagaggataggtgcacagggtagtgagggaaagttggagtgaatgggcttggtgcccccaccccgcaacatttctcttgctttaatcagagaagtttgacttcatccagattgcatatgaggactttacatgaggttcacctttttatttgttttaaaaggggtttttactctcaaaatgttttaaagaccactgaactagatgatcatcttaaggcccttttaagatttatgattctggaattctgtggctctatttttccaatgtaatataaccttcctctcgttaaggaaaaatgagataaacctgttataaacactcatgtgacattttttcaatacagttttcatccacgtagtgctcacttagaatgatagaaacaatacacctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactaatacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttgaatcatgaggccagtttcccctatactgttcttgtggtagtgagtaagtctcacgagatctcatggttttatcagggtttccgcttttgcatcttcctcattttctcttgctgctgccatgtaagaagtgcctttcacaagcataaggaagaagtatacttgctggagcagcaggctgtccttcttctgacgatatggactgcaagtgcctatgtttactttgaccaagacggcctttcttttcacagaaagccagggttcaccccttgaatttcataagacctctctttgcagtgggttagatactcttttatatttttatactctgtcaggaaaacatttttttttccatttaaaaatcagtcttttggttgcttccaagatggctgaataggaacagctctggtctgtagctcccagcgagatcgaagcagaaggcaggtgatttctgcatttccaactgaggcacctggttcatctcactgggactggttggacagtgggtgcagcccacggagggtgagccgaactggggcagggtgtcacctcacccacaaagtgcaaggggtcaagggatttccctttcctagccaagggaagctgtgacagactgtagctggagaaacagtacactcctgacaaaatactgcacttttccccacagtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatcaacgatagactggataaagaaaatgtggcacatatacaccatggaatactatgcagccataaaaaaggatgagttcctgtcctttgcagggacgtggatgaagctggaaaccatcattctaagcaaactatcatgaggacataaaaccaaacactgcatattctcactcataggtgggagttgaacaatgagaacacatggacacagcacaaggaacatcacacaccggggcctgtcaggggttggggggctgggggagggatagcattaggagaaatacctaatgtaaatgatgagttgatgggtgcagcaaaccaacatggcacatgtatacctatgtaacaaacctgcacgttgtgcacctgtaccctagaacttaaagtataataaaaaaaaaagaaagaaaagaaaagaaaaaaagaagtggcttttacctcccaccacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgacaaaaaaaaaaagtttcatagccttctacgacatgcacttagaagtggtaatgtgtcacttccagccctttctgttgattacaagtgagtcatgagtccactcagtttcaagggagagggcccagatcccatatctccatgggaagagtgccaagaacaccttgtagaaaagcttgtggataggagatattggtgtggtcatccttggaaaacacaatcttccacagtgtgcaagagaggcttcctgctctgcattgtggcttaattattgttgaaataccaggcaagaaaaggtaggatccagggaaacaaatgtatccaggatgttttggtctgccttttctaggaaaaaaggaaaccctcaaagcctctgagactaggtcaccccagtgggactagaagttccacgtggaaccttctgcaaactcctctgcaatagatggactgtgcattttccaaatgtgtctttacatcatctcctttctgaccttgggaagatagtaactgactgtggagtaggaaatccagaaccctgattgttttaaaatatattacagatacaagtaatgaaaagaaggctcctaaggaaaatatagatccgtaatggctttgtcccaaaagctattaggctataatattttattacaaaggctatatttattacaaaatgtatttaaataaatacttaatatttatttaaataaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaagttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacataatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccacgaacatgttgatatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacagtccatgttttcaagattttacattttagtagccacaatacaaagaagctaagatagtcttgtgatttgtcatcatggctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatgtaatgtattttataaccatcatataaaggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagtaaaaatatgctaccgtgtggtctgaatgtttgtcccttccaaaactcatgttgaaatttaatcccccatgtggcagtattgagaagtgggacctttaagaggtgattggttcaagaagattctgcgctcatgagtggttgaaaccattcacggaataacgggttaatggatcaatgagttatcccaggagtgggactggtagctttataagagaaggaagagagacctgcgctagcacactcagcctccttgccatgtgagccatctcgggaccccgcagagtccccagcagaaagaaggccctcacccaatgtgtccccttgacctaggatttctcaacctccataactgtaggaaatgaattccttttctttgtaaattatccagtttcaggtattctgttataaacaacagaaaatgggctaaaacacacgccaagaaaattgaaagactgtggaagtgaaagaagaataaaaaatgaagtaattttgcaaatgagtctggctttattataagtgtattgtcaaagtgattccctttgttataagatgaaaaagagccaaaatggatagaaacatttatcctatcttaatatcccactacattcaaggcaaatattcagtcagtctctagaacttaacaaggccttggagatgatatcctttggatgagcaatggagaagacaagatggattggaaaaagaaacaaacaaacaaaaaaacatgtaagaggctatcaggaaaactctggagacgatgtcaatgtaaaacagatacaaacctcaaaataattttaatatgtacattgcacaaaaatggacttcttatcatgttacaaatttattttaaaacatataggaggcaacaacaatatttcattgatgtgtactattttataattgttggctctaattttatttagtagagtcttacatctcctctctacatatttacatccggttgtattgtttttgtagtacctgttcaactgcactgaaatcatttcaattaaatgcatggttgaaaagctgacataatacattcaattgccaaattgcataaagtgaataagctatttaataatttggagaaaatatattccatttaaacttccttctctataaccagttcatacactggaccttttgggcacagccatgtgaaagcttttcaaaacttttcactacttttttttgagacggagtctcactctgtcacccaggctagagtgcagtggtgcgatctcggctcactgcaacctccacctcccaggtccaagtgattctcctgcctcagcctcccgagtagctgggattacaggcacctgacaccacacctgactaatttttgtaattttagtagagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttagggacagtgccactcccggaaccacagaagaaccacaatcataggagaagcatacaacaaacatggtgttcatcggacggtcagcttcagtggcacttttgagcaagcacactatttggttgtagaatgagtccctggcagggcacccgaaaggctgatgtgtgactcatccctagtacctctgagaatgctgaaatctcctccttctccaagctgagtggcagctttctggtccagactacttaaattgtgacttgaggaattttcttcactttttcctttgagtcattctgtttttgatcaagatgcgatagaatgaaggattctttcagggtctgctgtcacatccttcctttgggaacagatagaaaatctggcctggcttgaagagtttgtcctcaaacatctggtaagccataggcatcagcatctcttacttctccagagacatttagatgtgtcccccatctccatggaggcccatggcaaggggacccctagttgtactagagcttccttctgggcacagccacactgcacaggcactgcagtgtacagcacagctcctccagcttccggaagactccattatctagaaaagtgctgagaaatggagaagggggttcctctggggtggagatggaaagaggaaaaggaagggagaatgtccaagcaaaatgagagaaggtgagggacagcagaattgagagtgagggagagggagagagcaagagactgggttgagatgtcttgtacatgggggtgtcctcgtggcttcactcccctttcgtttgtaccactccgtttccccagactcttcctaaatatccccttattggctacaagatccagattgcctagaagctcagatttgctgacagcacctcaagactggttaatgacatatagattttttcttgtttccatctttgggatttggagcaatctccagagttgcaaaagcctaccttgttgcaataatatttttgagggtccacactgtctgctcacttgctctatgctgctgggcacagtggtgtggccatccagggtgggagagaccacctgggatatggaaattaccagcagccctgttttgctcttgcagtggttgccaaagcacacgaagcattctgggaatctgaatttctgttgtttctcccaaatggcccctgaagggcaacaggcagcacacatggaccacattttgccagaaaagtccagaaagaagatggctgctgttgtcaactattggcatttcaacaggacctatttttatttctcagtatatttgcacaactaggaagcatctgctgacaaggatgagatgataagctgtattgatgccaaaacaggactagaaaaacaggcttgttctgcaaatggcctgcatcctgagagtccgtgttaagaacattctctctctgcaggcaatatctgctcttaaaacattaacacttgaaaggaagtaaggcttggaatccttagcatagttatgcacacactaggttctcagtaagtgcatgctggatgaaggaacccacacgcaccttaaggaggatggaacattggcagcccaagaaaaaagtcactccccagaggccgagtgccatgtctttgacctccattggcaaggtcatggtgaaatgctgtctcttggggtcgctgaggtcccagcacggtgtgccttcacaccgtgcaaacaataagaagagaagagatgcacacatgtcacctttccaggcagggacatccaagctgtttgagtctccattctgtgatttccttgaacaagaaagggattattggtgaatgaggccagcatcctgggtgggaacaaaaaaggaaattggtagaaagtacatcatccaagtgggggtaactcagccctgtggcttgggcggcttcctaggatatccaaccggaggcagaggctctaggggatgtgaggctgcactgggtatgatgacacagaggactgtgagaggcagagaaaaggggagaagagctgaggccctcctagccctaacctcccagctcacaccctctgctatctgccacctccaggccaacaccacggccatgggaggtttgcccatttttctgatagacacattctttctctaccaacagcccacatggaacataagtgaagtaattcagcagtttccttcttaatctgctgtctctctgctgcttactcattctgtgctgtttgctttagatcaaggtgccccagggtaccaaaagctacattatcctattcaactgcatggaaaccaagatcccgaccattctggtttgttgttattgttacgttagttttaaaccttagccattttccattctgggcagttacaactctgtttactatgagttcctctgtgtagatgtttctcccatacccgacctacaaactgctacgtgagcagtaacttgtcaccatgttatccgcataaagtcagggattgataaacttgggagcctttagctcttgaaggtgctgatgaggaaggggagaggggaggagaaggaatttgtttgtgagatggtcagtgggctgaatagtggtatgaccaaaaagtgttactataaatacacataatctggaaaacaaaaatactgtcatctcctccctgcaaggcgctgtgattaggcaggatggagcttattgctgcagtgttagaaaatgcatccttgtagtcccaaaaaagcctgttccatcctgcccatctcttgttctcaatacttcttacttcacggtcactcattttcttcctgtccttgggttgaggtctcaacttcttgtaatagaattttttcagttataagcgacagaaatccaactcacactatcttaagcaaaaaggggattcactgatacgtgtgttaggaaggatatatgaaagctcaaaggtcaagtgaaaaaaatgtaagaacgaagaccttggtggggtgtggtggctcacgcctatcatcccagcattttgggaggccgaggcaggtgggtcacaaggtcaggagttcaagaccagcctgcccaagatggcgaaaccccatctctactaaaaacacaaaaattagccgggtgtggtggcaggctcgtgtattcccagctacttgggaggctgaggcagagaactgtttaaacctgggaggcagaggttgcagtgagttgagatgtgccactgcactccagcctgggcggcagagtgagactctgtctcaaaaaaaaaacaaaaaaaaaaaactaagaccttgtgactactacctactacctggatctctctctctctctctctctctttctctctctctctctcacccccccacactatcacctctccttgttgtcagtagtttcctttctgcagacaggagttccatgtgctgggaagagggccattcagagcctcgtattctcatcctctcagtttagcaatgcgagaagaaaaaacttttgtctcacaacctcatatacaatctcagaaataggctcttattttctggcttgaggctgtccagaggcaccaggcactgtgatggtctcactttctgtcctggatctatctgtggggcccagacagcaggatctatttcagaaaataggcgagagaggaaaaacttatgtggccgtaaaaaacagcggttttcaagtggcctatccccatccacatcataaacttttctgctgaggcttaaaagtgcttagacttcaaacttgatctaaaacagaaatcctacctggaaaaatcaccttccagtcacttagccaatcgctcatcactctctgtctctgaatctcaccacgagtttcacacgtctcccgagagagcgtctcctttatcattaccacatgtggagtcagcagattgggtttcatctaagctctgcctacctactatccgagttccctagcaggttagtgactttctctgcctttttgtttcttgatgtgaaaaggaacaacagtggctgctcacagggttgtcagttacatggtcaattacattacatggacaattcatgatggtgtcagacctgtctgagaaaaggtggcccatgttaccatgacaggccccaaggctaacagcccctttctgggtcatggctcatacaaaggagccctccttggtttgctggtgctctgagacttgcaaatgcattaggaattttacactgtaacccggttttaaatgggtccagagcatccccattgctagactactgtgctgaggaagggcactggctcattgttacatcccatgaacactctgggtctcctagacctcatcctctttgagcttctctctctcactctctctctgcgcattcaggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgaggtgaggcatctgtgggcttcctacaggagagacataaagaaaacatgcccccaaacctatgtgacagctggccgggaaggactggtgcctgcatatggagagtgcacttgtgacagttcctggcatagaataagcataaatgctataggaggacagaagagagaggttttaaatctgcgagggtcacagggcaagtgtcagagaaggcatagaggaagcgatacttacgcttggtttaaagcatgtgctttggggcagtggtttagagattgggtgcagtgtgcaaataggaggagggggccaatcaagagaagtcagtgaatgtacacatcccctgaagacactgggtacatctgttatggtccctgtgtacactcggatattctaaatgagagaccctggggccagatgcctcacggagagtcaatgttgactccttcatacctgttgaaccccttcttgtcacccccattgccattaccctagtctaagccaccatcattttctgttggacttctgtgccagtcactggatgtgtatccctgcctgtaatctagatcctttctagatcattctccatgatgtgtccagagtgatcattctagaaccaaatctgatgtcatcctcctgcttaaaacccttaagttctcattgcttttagataaaatataaaccctttcactttgtttttattactccttatgattcagcccttacttagcttacaaggacttcctcatgtctgagctctagccataatagctgactgttggatgagtcatcggggggaggttcttcttcaggctgcagattggcggtcagccctcctgacctcagctgggctcactcacacatctgggaggcagctgcctgaggccagggtgactctgctctatgcctcatgtctcctatcctccttgtacccacatgttagctgggacatgttctcatcgcaatggcagaggcatgagaaagtgatcctgtttgggcaagtgcattttactcttttctttcactcatgtccactgacatttcattggccaagcaagcatgtggggtgtccagagtcaaagagggacatgttgccggggtcatgactatttctgagcaataatctaacctatcatagctcagatctcactccttgcaggaagcatctcctaatccttaagacctagttggaacttacactctgttcttccctatggttactgcccattttactatttttctgcccatttagactgacaactctgtgagccatcattgcaatatggcttgcttacccaatatcacctagcatgatgtagagcacatagtaaatactcaacaaatgttttctgtaagagctaaggaaggacatcagcagacaaaatagagtctttctatgccaaaaggtgaaagtggtctcatttccattccattgtcctgtaatttggctagccaaaagcttagtggataccattcccataagtagacctcatctgcagggaagagatggggagactgctgggttatttattgcagactccagcaggaccacaacaatgattcaaagtgatgacactagaaggacaggtgccaatgggtgatgaagccacaatgacgatgtcaagtggtatcactaaaaggacaggtactcatgggtgatgaagcctacatgaccttgggcttacaccaggaccctaggaatgaaagagattccttctcttagtggctatgagggaaggcctatgatgtcttaaggaggttggattcgatcatttttaagggaccttcaaatccttagaccgtgattcaaatggtaagaagtttgctccattaaactcccaggcaccaccctttccggagacaacctttaaaaattattagctcctgggaaaatagatgtatctcattttctttgtatccctcacagtgccatatgtgaagacttacatatggtatatgcccccaacattactactgagtgagtgaacaaagaaatgagggaatgaatggatgaacaaatggctcatggcaggcttttccctgccctgtgaattcggcttctacttggtaagaaggtgattgcaatctctgttctcagggttccccaaggattcctgtgtaacagatgaaggaatcacgtctgtcaggtagagtaggtgactgcattcagagtatacatttccagtctcccctgtctttttcttttgatgagtattatagagagggaagccatgagtggattagatgccaaaatccctggctgagagaataaccttaccctggaggaaaacatattagctttgactctgagctgggaatttcggtgatgttgtagattcaatgcattgcagttgggtgtttttatttgttgaaaggaattgctgaattttcaaatccattaactgcttgtcagcattagcaagcctaattagttaatactaagtaaatttgcactaaatatacaaccctggctgattttactggccacgtctggcagagggcagcagcagggagaaagctctgtagagtttctgttggaatcgtgtgaaaagctggagaggttgcttctctttctctctctctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagatcatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttccccctgcccatttccccccttgttttcctgaacgtgaactgagctctgggcactgttttaggcctagcaggggacaggataaagcctgcttctctaggaattcgcactgagggtgtgagtgtgtgcacgtgtgtgtttggaggcgggagaataaacacaaataaataaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggaccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccgccctggtaggaggtggaaaatgaaaaacacacggccatgagttccagattagggcttctgaaagccctcagctttcccagctcccatcctaaagtgggtctttaaacaggaagaaagaaagattgctaagtgtctttggagttcctcttccttccccttctagggatttcagcactcctggggctcgggttggctctaaagtagtcctttctgtgtcttcccacctacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacctgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaggtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttatttatgaatgaatgagtgaatggaagaatgagtgatctgaaatgatataattagcttaaaaacctctccctcattctgaaggtaaagcaggaacaattggtccacccccaccccaggtttccatttcaggactcccttccctttttggagctacctgcgtgcttcctttacccattttctcagatttaactgatgaattgggagggggtgggtataggacttactgagatgcaacataatattcacacaggctctgcagctagattactgtttgaatcttcattctacctttttttttttttttttttttgcatcaccttgggcaagttgagttccctgggcctcagtttcttgacttgtaaagagagatgacagtgcatctgcctggaagggttcttttatgaagaccacatggttcgctcatggagagtatggaaggaccgtggctgacactgcttctccctctccagagtcttccgaaactgcacgttggactcatttctttattaggatgggttgagggtcttctcattgtttgagtcacatggatttcaggaaactaattcattttcttgtccaagcattcccttggcaagttcttcaatccctgttttcaatggtttcctcatttctaaaatagaaacaagaatagcacttaccctatagcagtactgtgaagattacaagactggacatgtgaagtgcccaggatagtaccacacatagtcagcactcaatccacattagctatttttatcacaattattgttgccctgtctgagcatctacatttaatagaatgatggatatgtttagatttacatttttcacgttattatcgttttgtacatgcctcctgtctttgttcctctgttcttactgcctttcgttgttttagtgatattatggtacaataagaaatatatatttggtctctggccccagtttctgagacaatttctaaaactcttgtagacaggggtgctaggaggctcttttgttctaatatttggtctttgaccctggtttctaacacagagctcccaaatcccttggaatttcctgggcaatagaaacttcttttgttctaatgaggcagctcctggtgggctcctggataacctcaggatggggaatcagccatggcattaaagggttggaactttcagctctaccctttgacctctggagaggctcttgagaggctctggagaggggctgatggttgaatagatcatcagtggccactgatgtaattaatcatgtctatgtaatgaagctgccataaaaaacccaggaggacagtgttgagagagcttctaggttggtgaacacttgggggtgtctggaagacagcccacctggagaggacacggaggctcttcgcaccttcccccatacctggctctctccatctcttcatttgtccatctgtatctttttcattatattatccttgataataaactggtaaatataagtgtttccctaagttctatgagccaccatagcaaatgaatcaagcccaaggaggggtttgtggaaactccaatttataaccagttggtcagaggtatagg

SEQ ID NO: 13238 - DNA, 63658 bp, Human
agagctggtaagagaagcttaacattcacttgatggaatggttactgtggcttgtatccacaggagctccagctcatgcttaaaatactgtgttagaacaaatggatcagagtgaattctgtaacagtaaatccacagaactgaaaattactgacttgcatcataaactggttgcagtggcaaggcagagagttcagattcgtgttgtactgcggaaagaagaaaccaaagaaaataagtggttcatacacaggggactatttaactgatccaagccagaagactactgagggtgaaaggagcattatcagtaattatgtttagacaaaagttgtgactgtccttagtaaaccaggatagacgtagagtcaattcaaaaagaaagaaagaacaaacatatctaatgtacattaagaacccagggatatcgggttcttaatgtgcatatttattggattgcccagagctttgaccttcaagtataattgagttcttgaaacttagatttaggtttgtggttaaggggcaaaataatcagattccaaatagggttctgcagacaaatcccacaggtcctaaagtctctgggtcttttccttgccattgtggtatctcaggggcttgtgtaggcaatgataaccagttccatacttctgctaagagaaatttggggatcagaaaatctttctctgcagctcttcagagtctctttaatttacttcaataacaaggaaatcagaaatctcaggacagtgctggatgtggcagaaattcagggcaattcacaactttcctaccaatttagagttacctgtctggaatcacttcaactgacagtggaagatagtttataaaattgtaggggaggcaaaatttcaccttcgtccctgtagggtcccagcatggccctagtattaaattgatttaagatattaatagactgacaggagacaaccacacaaatgtttattttacatagcacgggggccctcattaaaaaaaaaaaagacctaaagcagcagttaagagccaattgcttatagagtgaaatggacaaaaaatagtagttgtgaaacatgataaggcgaaggggcttggggtaaagaagcgactagaaagatagggattaacaaattttgtttggacagatttccctcgacttcaactttctgtccttgaagataacaatgttattttatagggaagacatctttcacatgggaatttcatctcctccttttaagacacataatatccatgacagtgatcttgcacctgctgtttttaagtgcctttaatttaaaatagtcaatatgccacagcagcatattttgaggtggtatattattaactccttcaaggctaaaagctttgaatatgccggggtagttaccagactggagaaccttctcagctatttgccacttgtggaatgcattcaaatgtactgagtgcttattaacttttctctcagtccctcactctgctgctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggtgagcggcaagctgcggggatacgcggggggcggcaagagcccgccccgtggggccagccccacaagcccccgcggcgttgccctgcgtttccaccggctccactctccgccgcattcccctagggtgccagtcagcaggcggttggggcgggcccgctgcggggctggggcgggtgctttctcgtttaacacgaaccagacaggcagttaggtttgaacaaatgaggatccggaggtccagagagtataggtgcagagagtaaagtgacaggtctaagtagtgaagtagccggggctggaaccctcgtcccaggcagtggggcacaggctgtcttcatcgcggagatggcagtcggggagcgtcgctccagaaagggccagggagtgcgggagcgtccgtgtgcgaaagagaacgccccagtgggatgctttggctgtgtctctcccttttggaggagttggtgggtggtggagtcgttaagtcccgtgcagttgttagtgcagggtaagaatgggctcctccagagagggtagcgccgaataggatttcgtttggaggcaggactggtgcctcaaggtctctttaaaaggaagataagcgagcggcctgaaactaccgggtactccctctgggcccatgggcttcatggtggccgacctttgggtgagaaggtttttgttttttggttttgtatccgaaattacatctagggctaatgtttcttgaaaatgttaaggttgaactcggatttttggggttgagttggatggagcttgcatccttacattcaactcagaacaagcttgaatgcctgctgcaaggatgacctggtctgtagtgtgaccacaagatataaccttctgctaggggaaatttttttccccctggagttagctgatcctttttgatttttatgttttcattccctaatttgcaatctctccagccgtgctgatgtgtatttcaggggaaacctgtgggccgatgagttaatgcatttattctttgctactactattctcctttttatgtttttgggctaaacctgaaacagccaatatttcatggagtgaggccccatcttttttatagctttacttgtgatactatatctagggtaagagcttaccgaaaaatggaagtctttgtttccattaggtttattaagcccagtttaaaattactaagatgagaagaatcatttcgtaattcaaagtaggaaactcctacctaatctgatagaatatacaattattagtatccctatatagttcattactcctcataggaactcactaaataatgaaaattcttgcaacattatatttgcataccactttaaacttctttgtggagtccttggttcctagcccaggttgtgccagtaagtgtttagagtgctgtcatttaatcttcatgtcagagagggaaagcggtatggtacagtaagtagttaagaatgtagggccgggcacggtggctcacgcctgtaatcccagcacttcgggcttccgaggcgggcggatcacgaggtcaggagatcaagactatcctggctaacacggtgaaaccccgtctctactaaaaatacaaaaaattagccagtcttggtagcacgcgcctgtagtcccagctactcgggaggctgaggcaggagaatcgcttgaacccgggaggcggaggttgcagtgagccgggatcacaccactgcactccagcctgggcgacagagtgagactccgttcaaaacacaaacaaacaaaaaaacccaaaaaccaaaccaaagcgaaacaaaacaaaaagaatgtagactaaagagaagattgccaagagtgtcttctgggttctgccacttcactgtgtggccttggtgggttatctattataactcctctctgcctcactttctttttttgggatacagttatacctgcatggtaggagcgccgtgaggatagacctaaagtacttaggatgatgtcttgcacattactaattttggttaataaccattttcagggattagggaggaggaagttatttcaaggccactgaatgatgaaatgtccccaaggctttttcctgggcctgtaaacagttccaggcctcattcaggcagtgtggttagtaatcccgtgatttgctattgctagatggtgcattttaacatttggttatattgcctttgacttatgctgttgtgttaggtgtggctataggtttgcaataacatgattggtgtgtttgcctaaagccgatactttctctgttaaatgtgggagtgcatagagggcaaaagaaaccctagacagcaaaacgcacagtattaatggcgtagcgtaggacaggaagcattgtttacctagggtcaaggatatattagtgtgcctatacagtgttcatttaaagagtgcctattttaatattggagcctctgctaggttgtaagctctttgagaaatatgtattttaaaaaatttgtgtatataacacttgcctttattgagaacttactatgtgccaggtaatgtgccaagtcctttacatacatctaattttagtcttacagcagttgaatgagtaagatagcccactttacaataatttgcctatgattacatagcttattaatgatgaaatcaggatacaaactccatttgactcaaagactcctatttatgttgccagtaccagtgcaacaaaagacccataaaatatttaataagtgtttattgaataacaaagaatgaggatacaaacttgaataagatacagtccatgtccttaaggaactaagaggtgagtcagaaaaataaaggagtgccggggttcaaagtgttgtaataaagatatggacctggtgccaaaggagaggcgcttacatcaaatcagtgagcagggccagaaggcatccttccttcaaattccagaggtggaatttgagctgaaaggtgaattggagttgtccaagagaggatgtggggtgcattccaggcataagaatagaaaacgttgtttgatacatctaggtagaaggtgtgagagtgataagggataaagtatcagggttaggagccaaataattaagggatttgggtgcaaaattgagcgatttgaactttatcctgaaagcttttgggaaagggacggtcttagcatgtttacatggaagagtttcgtgattacatttgtattttgggaaggttactctcgtaagtagcatggaagatagaatacagggagaggcagaagggatgtcctgagaccacttatactgttctcataagtgaggagggcctgggtaagtcagtggggttgaagagtagaggagggatttgagagctattgaggatatcttggtgactgagggtacatgggaagtttggacaaaaggtggcccaagtttatggtttcggcaagtgttggttactgagacagcaagttcaggaaaaggagcagatacatgcaaaagtgctatgtttggtttgggatatattgaggtagatggaaagagtggctagagagcagctccatgggtgtttgcctcactggtagggactggggatgttttgggtgtgacagagtagatatgggcacttaccagaatgtcagtggtagcatatatgagaatataaaatagaaagttgaaccccataaaagtattttgtcccaaccatcatacatacacctggcaaagtgtcagcagtttgaacctaggactgtctggtttacaagcctgaggctactgtttcatgccaaaaaccggcctctttttatttattttttgcttatattgcctcccaaaggatagattatgggtcagttactggttttgtgatttcttttttcaaatagttgtatgccgtggtccaggcatgatccagtattggtccctgcgctgtctacccttgtctttccatgcattctgatgccactcttgtgttaagttttcttagtacagcctggtctggagattattgctagttattcttaatagtaacaggtagaatttatgaggatggggaaagtagtgcttcctttcagcattgctgcttgtgatgtttttccggaagatgttaaggggaaaaattacctgacattcatccctcccattttagtcctgagatattgttgtcaagtggtctcaagatagaaaacctgagtttcaagataagtttgtgatcatgaggttagcaagcttacctcccagttagccctcatgccagaagaagagaacttttttagctgtcggacagacagcagccctacttgcccaatgattggcacagaaagggcagacagacaacttgtgaggaacttttcctcagcctgaccttgcctgaggctaaatatgtgtataccaggtggtgtgcgtgaacactgtagacagatattcatgactggatttcttttattcatacttttgaaaacttttttttttaggcaacctcccgacttctagtaaattacccagagccctatcgttctcagatattggattatctctttaaggtaatgaaaacataattatttcatggtacctgtgatattttagaaattggatggtgaatttcaccatagaatttattagcctcacaattctagtttttgaaaaaatggcacattacttttggaataaattgctatttgaagttttgcttttgtttttgcgtctgtaaaacctaaggcagtaattagtaattgtcttgaagcttcatacaatacaacactatgttaatactgttacttcttttcacagccgaattttggtgcctctttgcatattttaaaagtggaaataggtggtgatgggcagacaacaggtaggagaatttgggagataggatttctcccatcaacattttaatctatacctcagcatatggactgtgatttcagaatatgtgtaaacaataccaacacttttgagattgattgttgcttattagagttttcctcattttttaactgtaattatttaaaaatattatatagaatatgactggtccatcaaaaacaatattcaaacttcaaattgcttatttagttgaagtaatcggtagtaaacaaatccacagttttctaaaacctatatatacaggacagagcatagggacagttttgaattttattgagcagttagaaagattttaatttcgtatagaacaaaaaaagtgttattaacttaaaatatgtggtaaaaatgatacagcttttttttcttttaaaaacaaaacttatctttaatcactaaatcttcagtcttcattgtcactattttgattggctttatgtagtccatgttatcaactggcagtttataggccttttgtttccaggaagaagaaaagaaattctctctatgattagatatagcttattatttacagaacagattccattataatgaactctagagtattacttgtattcctgctagtgatttggaagtaactctttgttgaacagatatgtctgtgtggtggtattagtgtttatgttgaagaaaaagtgcaaagcaaaaacaaaagaaacccccataacagaaactttcttcaagctattgcgttttactgttaaaaccttttaggcagaattgacaatgatggactaatttcacttgctgaagctaaattagaggtagaggtacataaacaggcagttcttgtgaattctgatgtttacctttaagaagaaatgggcaagggcctctcggaaggccctacttagcaagggcagatgttggtgaactgtgggaatatacgaggactttgatagcaattacctacctcagtgctaagacaatgtaacctctactaactgcagatgttagtatagaattttgttatttttagagtggatatgtatactcattcctttttttttcctcaaaactcttcctatatcaagacatattataggctaaaggtgtgggttctgagaacagggctcacgagtccagggattcatatccagcgttgaaaagctgaaagttgaggtaatcagaacttaaagttggacatggggatttgaaaactacagagagatcaaaagcccagaagcatgaatactgggaatttttagttatatgaggtgataacatttctctcagtactgcttgtaatagaaggttgtggttttattaagacttttacaatgcttaagataataaaaaaaggatgaaatgatatgcttttatcatccatcctttagttgtgtaagattatgatttccccaacttcaggattagaactggaatactgcttttgtgaagtgtgtgtctggggtgggggtggggagtgagatggtcctaggaagtaccattcatggatcattacttccgtttttgctctcctctattcagacggcactgagccctcccacatgcattatgcactagatgagaattatttccgaggatacgagtggtggttgatgaaagaagctaagaagaggaatcccaatattacactcattggtaagaaatgaagtttgcaatgtttcttcagtctcttttcctttaacttttaaattctgaatcgtgttggtggaatctctattaatacggaagtactcataatgtcattaatgctaccagtatgctaccagcagcaaagcatgtgccaggggtgatcctttctttgcccttgtatattatgttgaatccttataatacctgtggagtaaggcatgactctttccattttccaggaagaagcagtagaagcttaggaagattatgccactgacctaaggtcatagacagttagtaaatggcaaaatcggtgttagcacctaattccatgtttcctatgatgctaaactactttccttcacaagatctgtcatcagtatttataaaagggtaatactgttcacaaaaatgtatattacatgcagtagtacacctaactagttacaaaattgtatattgcatgtagtagtgaaccctatttttagaaaaggtacatacaaaagtgttttttgtttattagttagtttttgaacttcaataatgtgctggttactgttctgggactcaggaagccaatcccgtccccaattcctgcacctgtggggcttaggttctattgggaggatcattggctagttgcttaaatgggactatgtacatttcacagttctgtgagaatgtgtacagagcttgtgaagtatttcaaacatcaagagtgatgggatactttcatcatttgaaatgaatttgattttttgaaacaggcttaaattcaaactaagttaaatgaaattaatgattcattttaaagacctgatttctagttatttaaaaaataattttctcaacaatcaggttaatgaaaagtaatattttctaagttaaaagaaattaggagtaagtatgttctttataaatgggcttttgtaagagattccagaaatgctgtgagcagtaaaagcatcactgaattcagcacatatccactagactgcttccaaggtcagacctcatttaaatgtagaaaatatggcatgctaaaccatgtcctaacaaagacttggtaggccttcagattgcatttagcatttcattgttttcaagaattctattactttaatgtcacatttcttatgtaatacacttgggtgttcctcctgagtttagaaaataagcattttgtcattttgatttttatttttttcagtggtgaactagtttggtaatatatttattgctgaggaacttaactattgagcctattttaatatattagtagcaagttaaatttagaattataataagtacttttctactcttcttatttttttacttaaacataatcaggattattggaagaatatggacttatttgatgtgtatcacttaacaagggtatatttctctatggagtcattgtcatttatagtgatataagaacaaactagttttgctaaattagattgcctgactgattaatattttaaggaccctaaattgtaagaagatgtacaattgaatgataaatttgtgttatacataactcaaaggagtagtttggcataagccttttagaattctttgatttgacctcaaagaacagaagttgaatattgaacattccaacagtgagtggacatgttaagttaaaacatatggtacatttctttctattggtaagggtcttggagagaggtgtttgtatttgttatttttcttcttcttggaaagaacatttgaaattatgggacctgactctagggatcaataaggaattatagtgtctatagattggaaaggatttcaataatttttatatggtatataaactttcctttagtcagatctgtattggttttttgctagttgaatgcttttcttaaaaaaaatttgttttattttcaatagcgccagcaccgttatacctcctctacctttgcctcctcccttctctctgcagggttgccatggtcattccctggatggctgggaaaaggtttcgactggccttatgtcaatcttcagctgactgcctattatgtcgtgacctggattgtgggcgccaagcgttaccatgatttggacattgattatattggagttagtaatatatttaaaatatgattcagttttggacatttgtttgtaatttagaaaataatttgattctgtggtactttttgactaaccattttatgccatgaggctaatttgttctaatggtgtctgataataacacaaactaagtacctgtgacctttaattgctcccctttgcccatcccagtgttcccacttttgaaaactgtgttgagtgtatacctccttcctctgagctgggtttttttttttttttttttgtatcaacccaactcaaattctccttcaaagctttccctgctttctctggttcctacaacagtgttgtgtttcctatacagcttatggggggttagtctcattttatcctcttgttgtcttaagccaaagattggcaaactttttattaaagggccagagcataaatagttttgggtttgtgggccaaaaggcaatattgaggatcttgaggtaaatatatagccatttaaaatgtaactatttaaaactaaaaacacttttagctctcaagttgtaaaattacagatgatgggccagatttggcaggctggctgaaatctgcgttcacctgtcacaaactgttagttaacaccttttaaggatttgaaaagtatgaaaaatgatatcatgtccagcttgtctcttggctgggtggaggcatgccccaggctgcatcgtaccccacagggccttaacacacacatagtgggtctccataatcatttgcttattaatataccatcagttaaaactaatacttaaacattttcatgcaatcatgacttagattatcagcaaacaattattgagttcctactgtgttgcaggaactgtgactgtaatatttgagggctactaagattaataagctcttgtgttcagtaagagaagtagatgctggaacatataaactgtaatactacatgatgatacagggcatgaggatgagccaagggctggaggaagtcagaagaaagaatatactagtttttgctatccttttccaaattatgactgaaaaattagtttatatttgagaactttccttttttttttacactgtcacccggattggagtgcagtgttgtgatcttggctcactgcaacctctgcctcctgggttcaagtgattctcctgcctcaagtagctgggattacaggcacccgccaccacacccagctagtttttttttctttttattagagacggggtttcactatgttggccaggctggtctcaaactcctgacctcgtgatccgcccgcctcggcctcccaaagtgctgggattacaggaatgagccaccacgcctggccggagaactttcttaaatgtcaggacatttataacctgtagtgagactaaatgtaggtttggtctaatagctttctcttatggtacagtcacaagtaatgggtgattcacatcttgtttagactcatgataacaaatgctatgatgaggaggttcattgataaactctttcctgtatcattggagtaaaaagacctgcacctggattctagaatcgtctcttgttattaacagttttctcaactgtggagttatggaagttctttcaattctaaaaccccatgcttcatgactctaaacctaatagatgtatatatgttccttttatccatcctcattcagagttgcttttgtgactagtgtattactgtgattctctgtgtatgcttaaaaatatgccttctatacagtatacatattaatacttggctttcagggatcttgtcataattgttgtaacagtttccctgtctattagttctccaatgcctagtatagtttctggcacacattgtactgtcagtatgtgttgaatgaattaatgaatattccattgttgaaaatctttggaataaattactttttgaaaaatacccactaaatattttaaggtttttaaaaataatattttaatttttaaaaagttgtgctatcttataactatctataaattctatggcaggatatcccataaagttaaaaaatggcgtatcagataatatgaaagatgatgagagaaatggtatcgtaacgataatctgctttctgacattttgtaactttcaattcagacttttttgactttttgttttgcagatttggaatgagaggtcatataatgccaattatattaaggtgtgtacaactttagtatctttttgtttttaactttttagtgaataattccttatggttcctaacacagaaaatagtaggaaatttgtgttggaaataccgtattttttatactacagttatttattttgctggttgtgacataaaattcaagcaaaatcttaacaatgtttatattcctgatattaaagcatatgtaattctttgtgagccccgaattacctttgtctaaagagttgtgttgaatttttctattttaaaattcattagttttggaattctgataaattttatgaaacaattatatcattttagatttttagaacttcaagaaatgtagctttttttctttgtcttttgtcaaaacttatggcatatattctaattcttgttttctattggagtgtgttatagtacatgtttctctttgtgattagcaaagaggtagcagtaacatctgccaattgtgttatttttgttccacttttcctatttatctccatttaattctcacaaccttacctatgaggtaactactgtaattgctattttccaggaaaggaaaaacagaataataacttctgccattggaaaaaaaatggcagtttcacttttcaggtggagctaatctttagtttacttttcacttccttttgtcttcttgtatgtatcttttctctaagaaatataattttgggacagtattttatttcaagttttcaaaaatttttatattaatttttttttatttccataggtttttggagaataggtggtatttggttacatgagtaagttccttagtggttatttgtgagattttggtgcacccatcactggagcagtatacactgaaccaaatttgtagtcttttatccctcacctccttcccatcctttccccgagtccctaaagtccattgtatcattcttatgcctttgcatcctcgtaacttagctcccacttatgagtgagaacatacgatgttttgttttccattcctgagttgcttcacttagaataatagtctccaatcccatccagcttgctgcaaatgccattaatgcattcctttttgtggctgagtagtactccattgtatacatacaccacagtttctttatccactcgtactgattgatgggtttttgggctatttccatattttcacaaatccatcaatcctgctactgggtatctacccagaggaaaagaagtcattatacaaaaaagatacttgcacatgcgtgtttatagaaaaaaattttctttgaattggatgttttatgttcttaagtagataaggttcaatacatttctttcatctcttcattcggttaatcatagagcatttatttgctcaacactggtttgtcaggcattgtgtgtatggttataatataaggatagagaatactgttttctgcccaaaaggattttttgtattggggagggtggttataaagtcagatatagacaattaaaatgtgtcataatttggaatgtgtcaaataatggaataatacacctacagggttcttaaaaggcgcacagaggagatgacacctctccctgggttgattagggaagtcttttagaggaggtgatgtgtaatttgaatcttcaagaacggatggataggaactctccactttgctaaggcaggggcatagcatgtgcaaagaactgaagattgagaggtaaagggatatgggggaaaaacaagtcatgaaagatggattagacaatggaggaagagtgggggcactgacccccatcagtaagctaatgtattcactggaataatggctttttttttttttttgacagagtctctctctgtcacccaggctggagtgcagtggcgccatcttggctcactgcaacctctgcctcccggatttaagcaattctctgcctcagcctcctgagtagctgggattacaggtgcccaccaccacgcccggctaatttttttgtatttttagtagagacggggattcaccatcttggccaggctggtcttgaattcttgaccttgtgatccgcccgcctcggcctcccaaagtgctgggattacaggcatgagccactgcgcccagccaataatggcatattttaattaatctgtagttgtaggcgtggagaaggcatagattgagaagatctattgcagccagagctaggtactcaagggcaattccaggttgaagtatgctgatgggagtgtggtggtgggagcaggttgggtgggggaggtggggcagtggagctattaataagattggagcacagggattgtaagtggaaagtcatgcctgctgtgagcacaggtctgataagagcagtaaggggacagagcagaagccaagttggtgcatgtatactggataactctgtaatgaggtagatggtgttgctacagcatcttcatagtgaaaggtgatgaactttttaaatacccaaatttgacatttcaaagcttaagttttattttcttgtgattgtacacatgtctctcttgtggtcatttcatttgagggaaacattaaaagtattacggtttccattttcttttaaactaatgaaataagacagggctatattttatgttatttgaacttttttactattaagagtctgttgctgactccagtgcattctaattcaactaacctggtttgaaagactaattgttgctctaagacatattttcagtgtttcagacagttcagacttcatttccttttttttgaaccttgagttttcttgcagtaaaatctctcaggatacaaaaactttttactttgtgtttgccatttttttccagcaagattttattgggatctgtgttccgtttgttgaaatgcctgttgcaggccaggctcagtggctcgtgcctgtaatcccagcactttgggaggctgaggcaggtggatcacctgaggtcaggagtttgagaccagccagaccaacatggtgaaaccccatctctactaaaaatacaaaaaaattagccgggcatggtggcagacgcctgtaatcccatctacttgggaggctgaggcagaaaaattgcttgaacctgggaggcagaggtttcagtgagcactccagcctgggcaaaaagagtgagactctgtctcaaaagaaaagaaaagaaaaaaaaagaaatgcctatcacaaagagttcaataatgacgaatgtaggtgctcagattggataaccttaatgaatgtatattctttatgggataataagatgacccctggaaagaataaggatttgtttttaatagtagaaataaatataatacaaaggagcaatttatataaagatgacaagggtattgtttctttgaagtttttttttttttttgctactgatatgtaagatttatcgtggttttcagtggtgttcttaagttttctaaattgtgtctggaaaatctcatctaggatctgaggatagtggatggaaatggaagtgcctgggtctttggaccttcattcacttcaaccagaacaagttcatttccatttgtcttataaatagagcttctatttaagctttttctggatgagaaagttccaaaacaaaaacataatctgaaaatatgttagataaaactgctcaaaagaatgctgttcgtaatgacttatggagggaaacttatttagaaatcatagcatgtagacttgtaaattttggaatgttattcaaatacaatgtataaaaaagtaagcagtcttactgggattttctaggactaggactagaaagactagatccatccgtagtgaaaaatgcaaatttgactaagttgctcttcctcttctctgtaagaataaagaggccgggtggagtggctcacgcctgtaatcccagcactttgggaagccaaagtggcggaccacctgaggtcaggagttcgagatcagcctgaccaacatggagaaaccctgtctctactaaaaatataaaattagccaggcatggtgccacatgcctgtaatcccagctactcgagaggctgaggcaggagaattgctgatcctgggaggcagaggttgcagtgagccgatatcatgccattacaccccagcctgggcaacaagagcgaaactccgtctcaaagaaaaggaagaacttcagggtgatgaaattcaggattgatcctcctgctagagggataggggttctcaatcctactgaatcttgagagttggtctcggtttgctacaaaggatctgttcatgctgtagacttctagggtgtcctagaactcaactgatccagtttgaaagatgaacttagactgccacctctaattttcaccccgttttctaaaatcctataatatatctattttaagaaactgtctgttgaaaagtataccatggatttaattggagcttttattatttgcgtcctaaaagagcacattaattggaaattgccctagttcagagaagttggaatgtgaagagagagcttgtgaaattctttgttctttcttaatttcttcaaccagtagtattgagcatctgctgctatgtgccagagatttccgagtccttgggggctatagtagtgggcttatttgtatccattcatcaagaactgcttgtggtatgaaatctgatcttcctgatcctgagtaaaatgatgtctccttttctctgctcttgatttacatataggcaatccatacattttggtatgtacttgccctttgattttctagtatgccctgttagttttggtgtcctgttgagtgtgtttgccacctaagggtgagggctccctctgatacttcttttagagtcctcatggggcccaagcatagtactgagtagtaaagtaggtactgtttgtgcttcgtttatttcctgttaaaatttagcttgttacttttaatttttgtgggtggacagtcctacaggtaaattttatttgctctcctgtttaataatggcagaatatttgaagaccgtggaaaatacttaaaatgataagttaaagcattttgccaaatggtatgattagtatgttacccatttgattattgtgtctgcataggagacttcctggaagaatgcatagcaaaataatggtggttatttcagggtagtaccatttgattatttttgtttcattcccccccccccatatttctatggttaaacgtaattttaaagtcaaagtgaaaatcctctaaaacattttaccccttgtgttttttttttctttttacattcctagtgaagtaggttatcttaaaggtaatgcttttattttccataggagggatgtttctattgagaaaatatagtattgaaattatcatccatgaggtcaggagttcaagaccagcctggccaatatggcgaaaccctgtctctgctaaaaaatacaaaaattagccaggcgtggtggcgcgtgcctgtaatcccagctacttgggaggctgaggcaggagaatcatttgagccctggaggcagaggttgcagtgagctgagatcctgccactgcactccagcctgggcgacgagagaagcctctgtctgagaaaaacaaacaaacaaacaaacaaaagaagctattatccagaacgctgatttgtaaagataactttatctatcttggtcataaattcaacagctaaaaattcatttgtatcctttcatatgttctgtttcttactccaaaagatattaagaaaaatgctgaattatcaaggtctccagcgagtgaaaatcatagcaagtgataatctctgggagtccatctctgcatccatgctccttgatgccgaactcttcaaggtggttgatgttatagggtaaggcatgttttacttggaaaactagcagtttctgattgcttgctctgtgtattgactatctttttcttgccttctccccatttgattacattctcagaaggtagctctcctgtattcacttacctgaagcatgcatggctcatagttcattattttctcttttaaatatattttaggatctttctatgacaaacatgtattgatagcttttaaaaagcatgttgatgtttggaataataaaacagggctttgttttagattaaggggcagagtaatacctgtatttaattttagaaattataaaggcaaagttgtgaaattagtttcaaactctcagatattctgtggttggaagttcttgcatgaacacttttgtaaatggttcattgtgatcactgacaataacttttgtcatgcctccttagtagtatagttttgatgcctactctttattccatttctgccttttagcactctgggccctgacctcattgggttcattttttttaaaaagtgaatttacattttttctaccatgactcaggatataaacatttgaaaaataggatatgtatgtttgtgtgtgtgtgtgtgtgtatgtatgtgtgtagaatttgttctttatccagtgtgaagactgattgatctctccatgtgctttatttttttaatgaagaattttgaatgtacacaaaaataggcagaataatacaatgaatatctatgttcttatcactcaacctcttgaactgtgaatccatgaccaattcttcatccatgcgtctatctactcctcttcctttcctgcctacattactttgaaagaaatcccagacattatttcttccataaaaatattactgtgtatgtgtctccaaagataaggattatttttctacttaccataaacaataccattattatacctaaaatgtaatagtttttgatattaaatatccattattatcttatagttttatttgattgaatctagatccatttaaaattcatgcattgtgattggttgatatttaaatctattctaatctttatgttcttgctctttttctttcttttaatttgttgaagaacggggttgtttgtcttacaaactttgtgtcagtctggattttactgatttcaacccctacagtttaatataacttgctcatctatcctttttcaatggtttttgaaattggtagtttaggttagatttaggttaggttagatttaggcttaatttttttttgcaagataaaatttcttaattatatttaaacattttatacattgaaattaaaatgaaagttttgctgttgttaaagctttcataaatagttgaagtcttgaaggaaaacaaagttgtgttaatcttaaatatattttcttataaaaatattgcatgaaaatatgggttttactgtatcttcatgaaggacttggatatgtacttcattttttattgatataggtattttaatgtaatgaattttcctctgagtactgctttagttttatctcatagggctgttttatcattaatttctaattttattgcactgtggccatttaataccaaatgtattatttacatttttttgggaaatttctcaggagcttattaaaaaaaaatctgaaaaaataccttcgcttttttcttgactatctcaagagcatattttgatttattaagatgtattctttattaggatacagaattgagtttatatataaccttttggttatattgttcaggtattttgtatcttaacgattttgtccacttgaactgttcagggctacccaggtgtgtttgtttccttatgttagtggggtctatttctcctttcaatcttaggcagtttttgctgtgtggaagcttctgctttgttatttggtacgtaaatactggaagcttctgctttgttatttggtatgtaaatactgatgaatgttttatcttcattatgatttatttcttatcattagaaaatgccattctttgtctcgtttaaagcttcttggcctgaattctgctttctgtgtaactaagagatctatgctttcttttcattaggatttgcctaatatatttttgcccttttattctttacctttcaaggccgttttcttttatgtgcattgcttgcatatagcatagagttagattttgcttttttaaagttcctctgaaaatctttatattttaatgaatgagttaaactcatttttaaatataactgatgtttgtgttttctatactactatattgtcttttgttattgaatgatttatactatccatgtactaatacaagctattctgctatgtgatttgtttactttgcacttatttaaggaggtgtttcttttgttatttagcaaggtttggtttttgttctgtcaattacatttatactgatttataccagtattttcaactgagaataattttgcctcccagacggacatttggcaatgcctggaaatatttttaattgccacaaataggtagggcggtgccactggaatccgatggatggaggccacgaatgtttctaaacatcctttagtacacaggatagttttcccataacaaaaaatgatccagcccaaaatgttaatagtgctgaggttgaggaactgcttcatactaatactcttggtttcttcttcgtttagttattgtctgttggtttactatgagcaatactaaaattatttgataacttcttcctccctttttctcccctaccgtggaattttaattaccagaattatcttagttttaatttttgtactcttacatgaacttaagcttctactatattgatttgacagctacaagttttaactgtttactcccaaataatctgcaaacttagtttacatttcaccttctttccttcttgtcctacttcatgtagctgtattagttgtactttagccaagtgtgtaatagttataatttaattactatttcttttaatctcactctaccattaaacatattaaatgctcaccttcaagtcctttgccaaagtttctccctcattttcttggatatcagaagtgtaattatctattaaatgtctcagaaagtgctaatggaaacaatatttcttgatgtgttcagatgtttgttgatgtttatctatgacctttatacttgaaggacagtttgactggatataatccttttttaattctcaaatatgtgtaaatatatcataaaatttgctccattagttatttacataaaatgttgctattgagaattttgactccagagatatttccttttccttataagtaacttgacacaattcctttatgcccaaagaatatttttattcatctttaaagtttagttgttgtatacactttaccatttccagatatatagtatatgctctcttaatgtctatatttaagtattttcttatttcagtaaggtttacttaagttataagttaaatcattattccactccattactttggttttctttttagaagcaccagttatactttggtcttatttgcatatgcctttattttgtatttctctgaatttttctctatctctttatttatgttttctattattttatccttactattctatattcctcactgtgttttccacagtgtctgttctgtcttatgttccttctagtttagccttcatttccaaagtgtgtttttgaaaataattcttctataattctctcattttaatttcctatattgctaacaattcatctttaaaatttttaattgaagtacagcatacatacatacatatataaaagtacaaaaatcatcggataatagcttaatgaattatcacaaagtgaacgtacctatgtaacagccacccagaaaattatcagtgcccaagaagcttggttactgatatctcctcttggaaagatttttccttggaaatctttccaataattaagctctctttttgccttaaaggtaactactaatctgacctctgacaccatggactaattttgccggtttaaaaactttatttaaatggcatcctatagtagctgttatttcagccaatattatataaatttgtgagattaatgcatgttgttatatatagaggtagttcatatttattgtttagcatccaattgttggatgctaaatgtagcataccacaacttatctgtgtattattttttaatggtcatttagactgtttccaattttgggctattggaattttgttcaggagatatttcttggctcacatcttcataggaagactattcctccctgcctcattcatgttgtgcttggcctgtgctatatctgcagatttttgttttacagttacagtactttctagggtctgtttctgctgggccccattcttcttagtgactgaaagttgttctccctcaaacaaagcgttcctgccttattcaacttggattctacttcaaacagcttattttcatgttgaagctctaccattcctgattatttgctaccttctcctgaaattgttattgcttaaacctgtattgttcaatacagtagccactagacacatatgtttaggaagcacttgaaatgtggctagtttgagtttaggtgtgtaataagtataaaatatacactgggttttgaaaattgaatataaaaatattatttacaattgttttacactgattacatgttaagtgataatattttggatatattgggttaaatatatcattaaaattatgttctccatgtttttctgctttgtaaattcaattaaattttttccatttatgtgttttattgtggtaaagacctttgctggtttttaatgtggctgctagacaacttaaaattgtctatgtgtggttcatatcatatttctaccagacagatctggtttgaactgttacagtattgggtttgatctcctaatgaattcactgttttgagcattgacccctaacttcaagcctgtgaagatgttcccatcttcctgagttggtcttctatgctcccccttagggtagggtctactccttttgtgtgagtaccggccagtcccctttcacttctagtttccatataccatctgctgatcctgggccatttctgatgctgcgaggctcctggggagagtccctgtcacctggtttgatggcagtgttatctgtgagtttttcctttcccttatctggttggtcagtttggtttcaggaggagtactgaggagcttcagaaactgggctgctgtcatgttctgccttggccagaaattctaattttttaaagtacaaatatgttcctctgttaggataaactataaagttggtttactttcattgatcttaattttgtctgttattgaagtttgaaaaataatgctgtgaagtgatagagaatgtttgcctacttatatacattaaaaatttatattctttttttttttttttttttttgagacagagtctcactctgtcctctgtcgcccaggctggagtgcagtggcgcaatctcggctcactgcaagctttgcctcccaggttcatgccattctcctgcctcagcctcccaagtagctgggactacaggcacacacctccacgcctggctaatttttttttttttttgtatttttagtagagacagggtttcaccatgttagccaggatggtctcaatctcctgacctcgtgatccgcccgccttggcctcccaataaaaatttatattcttaaagagcctttacattttgttgcactagtaataaatctatacattaagaaagacccagattttagtattagttctgcctttctttgctcatatcatgtaataaatcatttgggttttgaatgtggtaacagtttcatcattttctgaatgaaggatatatcacctattcctataacttcaataaagttactttttcattttataaatataatatgctcattatagaaaatttggaaaatgtagaaaagtataaaaatagaatttcctcataatcctaacatctactgattattggtaacatgctagcatattactttacagtgttttctttaatatagaaatatattttaaccaaatacaccaaacatgcatttggcaactagacaactggatgacaactagatgagtattaaaaattaacatttggctgaggtaccaaagctgaatttcatggaaatagaatggagttgtgggatagaagaataaatctaaagtgtaattttttgaatttatattatttaaaagactagtagccagatttttcaggttgggcgttatagttccagaacaatgattgcttaaccctgttagatgctagatttctgttggtatctttgtagtgtagatttgcaatattgaatagatgcctgctttcacctgagtttagtgactcagtaaaatcttagtggaacctcatttttctctaatacttctttttatgttctccagtatatattgtatattattttcttactcatgaaatcctgggatgccaaattgatattgtgccctaattcatcttcactaggtataaagaattaccaaataggattttttcctaaaagatttgtgacctaaaagggaattaaataactaaaaagtaaaacaagtattcacaatcattcttttgatgttataaatactactacaccaaactacaaagattagaattatgatataacttaatctccattattttgcttgcattgttttttgtaaataatttttaaactaaaaagtagatgctcttattcctacagttatttagctagtgtgctctcttattggattgtcaatctattttctattttacatttaaaatttattgtttttattcctataatcagtgtcttccacaatcatcattatgggagtattttactcttgcagtaatgaatatgcatttatacttccaccaactgactcccctcccatcgaatgatagagtgaaggaggcattcattttctggggcagtttctcacctgctgcactattgatattttcaatggataatttttttgttgtaggggttggtcctgtgcattgtaggatgtttagcagcatttttggcctctcttctctagatgctagtagcaaatatccctgaccccaggtgggacggttgaaaaaaatgtctacagatagtgccaaatattccctccagggacaaaaatcatctgggttgagaaccgccactgctctgatacagtaatttagttttcccaaggtagcttattctttttattcaagaaataaccatgtgtgggttttgttttttgtttttggcctgggagtaaatgccaagctatctttctgtgttctaaggacaggagtagtggggagagtactactttatataaaggtttcactagtcttatttttggcctcctcctcactcgtttactattgccccaagctccttagcttcccctgggaagtctgaatcttatctttacttcattctcctcttggagtgttctaggctgtggccctctctgctacctccatccttcaacatgcttccatccatcttgtgagctccagaaatagattgaaatttcttatctattgatgattttccttcctatcctgtatgctgttgtaggtttatccccttttgttttctttgctgtcattttaatggcatgctgagacaaaagggcataaagcagatgcttagattcattatctacctggaagctacccaactgttttaaaatagaaaaccttggagaagactcgtatttttatatactcaacaaatctatacgtatataagtgccacgtcgtgaccttttttcattgacttccaccctttttttttctagggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttcgtaagttattaaaaaccttttagagttcttatcaaaaaaaatttaaaaacataagagttagaaaaaaatggaattccttattcttccagcctagattcaatgattgtaaacattttgccttgttagcgtcatctatttgtatacctatacctaatctatatctaattttctatatttgaatatagtctatattaaataaagtcaggtttattgaggtataatttatatgtagcaaaatacatgcagctctctgatttttgacaagctacatgtatttttaataattataaagtaaatagtatatgtaaggacactttatctctaaatattttagcatgtgtctccaaaacataaggatattcttttacatgatcacagtatcatgttttcatacatgagagtgtttttaattctcagtctatattcagattttcctaattgtttcccaaaaatgtcatttgtagcttttttaaagaaaaggaatagtcaagcacacacatattgcatttaaaagttacacccctcaagtctcctttaatctagagtggtttccttattcctcatttttgatgacagtgatctgttgaaaagaccaggctggttgtgttgtggactgtctgcttcccagcctgtctgattgattcctcatggcatcacttgatatgtgtaattgtttgtttaaaaaacagatgttcttaagggagaacacaactatttttgttcctaagggaagcatttcttaaatgctttgaaaaacacttgaattgtgaatagattccaattagctttttttaaacaatgataaatagaacaaaaacaaaccaatatttatgtatttgttgtgatgttaatgtgggttgctgtatattgtatttgttctttttcttctctttgtgaaagaaaagacacttaggagagtttggttataacttaatttggtcttaaaggtaaggcatcttcatggcagagaatttagaaaactgaagataggtacaaagaaagaagcaaaatcacctacagtcttatgatccagagctaaccatcctaaacaattttagtgaatgtcctcctgttttatattggcatgtatacattttaaatacaaaattgagaccatactatagaatctgtttaaaaaactgcttttcacttgagacgacattaggaactttttctcacatttacctatatttctacttcatcatttttaatgcattttaaaatattttgttacataaagcaccatttcccagacttgccttaagaagcacccgagacactcgttgttataccttctccttggcagctgcccagacattgtgaatcagaatctacagggaaggctcctggtattctgtccatctagtcagtgccctcaagtgattctgatgccacacaagttgggaaacactgatgtggaaaatatattattgtttattgaatattctcctcttttagaattggaagttgtctctgttttaattaatagctttgtacaaactgaaatgatcaattgtatacaaatatctttgtatatgcccatgactattttcttaggctgtattcttagaaatggaatggtcagaaatacatagattttgaagggttttgtatgtattttacaaaatgccctccagaaagcttgtcttgagttatacatctatcactagccagaaaggataccacacatcttgcaaaccatgggcaaaattataagaacttaaaatattcactagtagtaaggtgttttgaaaattaggactattatttctactttgtactgatagaattagaaggctttgatttgctaagaatgtcagtctcttttttttatactggatgaggacttgataggaaaaataaaattctgtgggtaagctttgttttttttaatctgtgagggacccaacaataccaagttcaataacttcccttttgtccttggatttcctgagaagcagagagtcaaagttttagggtttagcacctgctctggactgttagggcctgatcatctgagaaagaatgggccacaaagcagatcagcaattagatccaattactacttatagatgaagtggaatcatatttaatagcaatactacggcccagaccttgttccatactcttcctatgcattagtacatttaatccttacaaactcacgtgagagagatataattattatcctcattttacagagaggttaagtggtgaaaccatggtttaaacccaggcagtctgactccaataattctcaattgtaaaactttggaacagttcagagtcaagttcataaaaattatgtcataaaactggggcattaagaaggctgactgttgaaaggaaagtaggtatgcacaaagcctttatttgtatttgactcaaatttgtgatgtgttgggtattggtaaggcatgattcgtcttctggctataccacagttcagtaaaaatttgcacataatacatttgtattttttatcatgtgattcaccattaaaaatattacaatgtaccccacactggatttttcaaaatgtgaataaatttagacaacttatattttcttattttgggtgatccttttattgtcatttatgtagatgtgtattactatgataaagtctttttactccaggtttttagacatttacatttttatcacaagttgtcttggtgtttcttttttatcaaatcttttagcacaatcgcatggaatttagtggctagttactatgaacagttgccttatgggagatgcgggttgatgacggcccaagagccatggagtgggcactacgtggtagaatctcctgtctgggtatcaggtatggttcagttccatctctcactccctaaattcttctctaagagacaaagcagaaaaaaacttagagaagattatataaactgtgtgtctatgcgtgttttaagtatagatttaagttttaagcaagatttgccagtgttttataagaatattttgggtaactagactactctctgattattctaagaccaggcttttagaaaagtgtaggagaggagggggagagagaggaaaaggaggagctgtgtagtgatagagacacaaataaataatcatctaaggatataattacaaatgatgataattgctaataagattatgtatttataaacagagtagaagtcttaagattagctttgaagacattttgttctcttatattaatagagtttcaattacaatcgtatgctagcaaaatcaaagggagatgattaaaaatactgtattattgaatcatcaaatgaataagtaaatatgaaagttatgtgaaatatggctttatattgtcccctaaatctgtgaaatgtgggttgtgaaaaggtaaatttcaaaataggtaacaatgtaaagctcaaaagattttaaaagtgagcacgtactgaagattttatgttactcatatgatatgaaggatcctggcagatagatggtagatgttagaaacagttgaaatgaaaagtcaacatagcacaaattttcgtagtgtaagggaattggagatgaattgtcaatggaggcaaattgggtttcccacaacagggaagaaattaattaaatttctaccagacaagacataatttacatagctcagagacaatgaacagggctatagataatacatccgtttttattgaaacacaaaagttttactacagtatcattcattagtcacaagggaaattgagattatgcagggatggatggcatagtgtcactttttcatgaggagataataaccatactaatagtgattatattttaaacaaagtaacaaaatctattgctgaataatgttgaaacttttctgcagtttttttgtaaaagattataaacatttattaccattttgttttaaaattctaacaatctttctaaaaagctaatttctttaaaggtaaaatgctttcagaagaaaattatgaatttggagtgaatttgtttttattttaaacttaaatttggtggttttcccttttagttgtgctctcctaagacagatttgtaatcatattaatcatgtaatcatgatattattctaaactccttaaattgtcctccaaaaaatataagaaaattaaggttagacttgtatattggacttgtatattctaatattgagaattatatgagaaaattaaggttagacttgtatattggacttgtatattctaatattgagaattatatgagaaaattaaggttagacttgtatatcagcgccttgaatgttgaaattgttggccccacattatctagatgaactaatgtactcttaattttgtgatttttccaagggttgggacatggtatattgcttagtgcattttcaggatgagcttaggaggtgaccaataaatgtacatgtggtggaaataaatatgtttgaaaccataaagttagtttctgaaattcattattaactttttaaacctttttttggtagctattttaggatggattaaatagtgatgaaccaagtttggggggggaataactattttattcttaaaaaaaagactgatcatattcttgaactgacaggttcatttatttttacccatcattccaggaatcttcttgcaattgtaccatttatctagattaattatttaaaaatttaaacatgaggttgacggatatattcctgcaaaatagaaaatagcttgtttggatgaatcagactcaaattgatatacagctttttttttttcccaaaagaaatactattattaccatttttgtcttatttggaactttctgtttttctatagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaatacttttgttttacatgtaaatacataagcatacagacagatgccaagatcttatggctttcatttaaaaaattttagccatgagtcgtaaaacatagcacacaactcactgatttgtacaaaatagttggctctcatcttttctccactttgttcctggcagttgggataaaattaaggttacctgtgtaccaatatttgtggagacgaccttcacgaccttcccttgccctgatatgtatatggaggctgtggctttttcctttttcatcctcaggttgttttggggagaccttaagtctgttgagagcaacgagcttaaaattcaagtgattgaggggcttgagtaggaagggaataggtctgacaggtggacagaggcatgggaggaggtaggggcttgaaagcagacatatcaaggattcaagggaactgaatgaaagaatgaaggtgaaaaaacatggaagcagaagcagaagccagtggagagaagaagaagtctgagaggtgccagtgtggggagatctcaagcttcccaaagaggtcaatgaagttccaacaagaaggaggtagacagaataggaagtgcatatagtcagcagggctttgtgaagaaggatttctggcaactaagttcccatgggagaagcaagatccaaaacagagaacagagtagccttaaaaaaatggtgtgtgtgtgtgtgtgtgtgtgtgtgtgtgtgtgtgtatcatatcaggttctgaatgtcagcctacagtttggccaactcctgaccatagactcttaaaaaacaaattctttcaaatatcctactatcaggtttgagccaggacaaacagtaaatattcctggcagtattgaccttttcaaaccaaaggtgtctattaagtgactcacaacacaaaccaataagccttttatgtcttatcgtggatgaagaggatcctcaaaagagggtgtaaaaagatgcagccctcccagaatctacacttcatcgtagtcaaaaggttgagaagtgatcctccaaagacctagaaccactcccaaggatagtcaaaagaaagacccagataacctccctactccccactccctgtcagagctagcgatagttggtaaactggctgcaaatagggtgcgaatcacatttttgtctggttatattcttggggcccccaacttgaagttggctgcctgcatacacaaaactgacagctcacacatccctaacaggtgggaagtcaagccaggttctcagtacacaaaatgagacaaataggaaagcaatagctgaccctgggaaggaagggatctacaggtaatgagcacccaaaactaaatttatacaggaatcacaaaccaaacgaatgtttttcttctgcgaatctgcatttggagaggaagggatgaggaggtttttgtttgtttgtttgtttgtttaattgtcttctctcgatcgggtacttcaggcagagatccagaagagcaggccttggtgagaattcttaacctttctgccacctttttgtcagtgtctcaggatctcatctgcaggctcttagagtgagtaggcatctcatcttcttcaccagaaactgtcttcagagataaggaaaatagggagagcacctgttgagtgagggtcttatgacctgcttcagaggagaaaggagaaggtcagagagtaaacttcctgcttctacatttttctcaaattatttcactttaaaatatttgcggggagtgtgtcttgaaccccatcatggctgttatgactaatggtgtggattagcatatgtgtacaagtttttctgtgaacgtgttttcagttctcttgggtatgtatgtaggagtggaattgctgggtcacatggtaactctgtctttaggattttgaggaactaccaaattgttttccaaagttactgcaccattttacattgccaccagcagttttatgaaacttacaattctccacatcctccctaacagttcttactgtccatgcctttgattatagccatcctagtgaatgtgaagtgctatgttattgtagttcgatatgcattttcctagggactaatgatgtggggatcttttcatgtgcttattggctagtagtatatcttctttggagaaatgtctatttaaactctgcccatttttaaattgggatatttgtgtttttattattgagtcataagtgttctttgttctatataaaaattccttatcagaaatataatttgcagatattttctccctttgtatgggttgtctttcattttcttaatggtaccctttgaattaaaaaaagttttaaattgtgatgaagcccactttgttttctcttttgtttcttgtgcttttggtgtcatatctaagaagctattgcctaattcaaggttctgaagatttatatttatgtattcctttaagagttttagagttttaaatcttaaatttaggtttttggtccattttctttcttaactggggttatatgtgtgtccaacttgattctcttgcattttaatatccagttgtccctgcactattttttgaaaagactactcctttttcattgaattgtcttggcatccttgttgaaaatcaattggcaataaatttgagggtttatttctagaacctcaatttttttctgttgacctatatatctgtcctgacgtgagcaccacactgtcttaggtactgtagctgtctgataaattttgaagtgaggaaatgtgagtatttcaactttgtcatatttttattttttattgacacagggtacaatttgatgttttgatacatacatgtggtataatggtcaaatcagggtatgcccatcacctcatgaatttatcattcctttgtgatgaaagcattcaaaagcctctcttctagctgttttgtaatacacaaaaccttactgttaaccgtcttcaccctagtgtgcaagaaaacaccagaacttacacctcctgtccaatagttactttgtacctgttgaccgacctcttcctgtccttcccttcccagccccaccctagtgtctggtaaccactgttctactctctgcatctgtgatatcaacttacacctcctgtccaatagttactttgtacccgttgaccgacctcttcctgtccttcccttcccagccccaccccagtgtctggtaaccactgttctactttctgcatctgtgatatcaactcttctttttttttaattctacatgtaagtgtgatcatgaggtatttgtcttattgtgtctggcttatttcacttaacatcatatcctccatattcctccatttgttgcaaatatcaggatttcattctatgactaatagtactccattgtgtatatatatatcacattttctttattcatgcattcattgttgaacactcaggttgattccatatcttggctattgtaaatagtgttttaataaacatgggagtgcagatacctctttaacgtatatattttattttggggggatatatacacagtagtgggattactggatcatatggtagttctacttttaatttttttttttttttttgaggcagaatcttactctgcacttccaggctggagtacagtggtgcaatcttggctcgctgcaacctctgcctcctgggttcaagtgattcttctgcctcagcctcccaagtggctgggattacaggcgtctgccaccacacctggctcatttttgtatttttagtagagacggggtttcaccgtgttggccaggctggtctcaaactcctgacctcaagtgatctgcccgcctcagcctcccaaaatgctgggattatgggcgtgagccaccacgtgccccgcctatttttaattttttaggaatctccacactgttttttatagtggctgtaccaatttacaaccctaacaacatgaagtaagtatttctttttttccacatcctcaccaacacttgttttcttttgtttttttggtaatagccattctaagtagagggaagtgatatcccattgtggttttgatttgcatttccctgatgattagtgatgttgagtattttttcatgtacccattggccatttgtatgtcttcttctgagaaatgtctattacagtcttttgcccaattttaaactgggctattttgttgtcgttgtttaagttctttacatagtctagatattaaccccttgtctcatgtataatttgcaaatatttcctcccattttgtaggctgttttactttgtttcttttgctgtgcaaaagcttttcagtttgatgtcatcccctttgtctatttttgcgttgtctgtgcttttgaggtcttatttaaaaaattcttgcccagctcattgtcataaagcactttccctttgttttttttctagttttatagtttcaggttttatatttaagtatgtaatcaattttgagttgactgtgtatattgtgagagacaggagtccagtttcgttcttctgcatggggctatccatttttcccagtgctgtttatggaagagactgtcctttttcctagcgtgttcttggcacctttgttgaaaattagttggtcatagggcatgaatttatttctggactttctattctgttccattggtctgtgtgcctgcttttagacaaaaccatgctgttttattaatcgttactatagccttttagtatatgttgaagtcaggtagtgtgatgccttcagctttgttctttttgctcagggttgcattgactgtttgtggtcttttgtgttcctatataaattttatggttgtgttttctatttatgtgaagaatgtccttggcattttgatacagattgcattaaatctgtagattgctttgggtaatatggctgtgttaacaatattaattattcactatatttttgtgagttttttttagtgattattctggggcttaccatatacatcttaacttattggactcacttcagatttaaactaaccgaattacagtagattatgctgaattcccttgttgctctgttccctttctccttttgttctattattagcacacatgtcacaacactgcgtgctgcgaactcaataggacattgttactttatacataaatttatatgtttttaaaccagtaacatgctgttttggttactatagccttgtagtataatttgaagttagataatgtgatacctccagattgttctttttgtttaggattgctttggctgtttggactcttttttggttccatatgaattttaggattgttttttctaattctgtgaaagatgatgttggtattttgataggaattacactgaatatgtagattgctttgggctttgtggtctcattttcacaatattgattcttccaatccatgagcatgggatgtatttccatgtgtttgcatcatctattatttctttcagccatgttttgtataatagttctccttttagaactattggttcttggttaagtatattcttatatgtttttgtagctattctaaaagagattgagttattggtttgattctcagttttgtcattattggtatatagcagtgctgctgatttatatacattatttgtgtacattgattttgtaacttgaaactttactgaattcatttatcagatctagcagtcatgtatcaacagagcagaatacagaacccaaaaataaagccaaatacttaaaaccaactgatctttgacaaagcattcaaaaatataaatttggggaaaggacatcctatttaataaatggttctgggaaaattggatagcaacatatagaataatgaaactgcatccctacctctcacctcaccgtatacagaaattaactcaagatggattaaaggcttcaatctaagacctgaaaccataaaaattctagaagaaaatctaggaaaaattcttctgtacattggcctaggcaaataatttataactaagaccccaaaagcaaatgcaacaaaaccaaaataaataaatgggacctaattaaactaaaaagcttctgcaaagcaaagaatcattggagtaaacagacaacccacagaatgggagaagacatttacaaattatgcatctgacaaaagactagcatccagaatctataaggaactcaaaccagcaagaaaaacacaaatcccattaaaaagtggcaggtgacatgaatagacatttcttaaaagaagatatgtctatagccagaaaaacagttaaaaaaaatgctcaacatcactaatcatcagagaaatgcaaattagaaccacaacgagataccaccttactccagccagaatggccattaagaaacatcaaaaaacaatagatgttggcatacatgtggtgaaaagagaatgcttatccactgctggtgagaatgaagttagtacaacctatatggaaaacaatgtggagatttatcaaagaactaaattgattgatctgccattcattcctgcaatcctactactggatatctacccaaaagaaaagaagtcactgtatcagaaagtcacctgcacacatatgtttatgtagcacaattcacaattgaaacatatggaatcaacctaagtgcccatcaactgatgagtggataaaggaaatatatatataccatatatatatggtgtgtgtgtgtgtgtgtgtgtgtgtgtatatatatatggtgtgtgtgtatatatatatatatggtgcgtgtatatatatatggtgtatgtatatacatatacacacacacatcatgaaatactcttcagcatagaaagaatgaaataatgcctatttctttgaatgtctcattttttgtgtgtgttgttggaaactggaccttatatataatatatggtagcaactcgtatataatatatgctatcaactctgggcattgatcctctcccccttgaggcttgttgttgtttatttatttacttagtgatttgctggagtattttagttaactctgttccctccttcttcccctccacacactgtaaagcctgaaatgttgctccttggagaatgtggctttgggcatatccacagtcaccctgggatttgtttttccaggactctgtctggttccttgatcacacctcactgtaagttacactaattgctggtggatttctgtattgttttaaacaatgccctggggacttaaattgttccaaagactgatccaattaaattccagctcattttcaggggtggtttgaagttagtgttttagttttcttctgaccacaggagatttttttttttaaactgtcacttttttttttcatttcatcataaatttattttcaggcagtatgataatctattaatactcggcatactctgaacttacagaataagtaccactctatacttcctcattaatgactatcattttacatgagcttcttctacaatcacagtgagagaacagattgctacatgtttgctaaatacattcagtaaggcactcaaatcctagacacgaactaaccacagaacgctcttccccgctttaataaattgaaacatgatctcatttccttcgttttcaatgctttttatagaaagacacgcttgtcttgaacttgtctaaacagaggtttatataaactaatccattatcatgtatagttgtaatcaaggaaatgatttcacattgacggttttttaggtagggataagtaaaagcactgcagcagtttctgagggaatgtcttccctgtggttcctcatacttagtacaatgcctggaacgtagcagggactaaatacagtgaacaaatgggcaaacctttaattcccagggatctgctacatattgccttgactggtagatcatttctccagaagaaaggaagaaaccaaaaaacaaaaataatctttttaaacctcacaggattttcttagaaaaaagttttaattgaaattctctttgtaaaatgtatttaataaaaaatccaaagcaaaaaccctatcgtttatttacttcaaaagacaaatcatttcagtacttcttccttgaaatgcctgccatttcttcctctggcctcagaaaagggcatcggctccatgctttacagtgtcaggataaaaatccaggagggagaaatcttgttgtaatggatagctgctttcatctaacacaaaaaggctctgaatctttgatacacaaggttctgcgctgactgccgacaaggagtgtaacaggtctgccatgaccatcccataggtgatctctgaggaagtaactatcactctgttgaggcagtctgcaaaaatgttgagaagaatcttctctatcagctttgagtctacacggatgtaaacatcatgtcttccatcaactacagtcattaaagctggcctatagtatattttcttcatagtaaatggcaagcagctaaaacattgtttgtagatcctgttctcatctgtttctagttccaatccatattttgcgcagccagtatatatgatgttgggaagagaagaaaagaaatactcttcagagaactgtgagcatttagagctatcttctgagctgccgtaataggaaatgacagctctgaaatctgggctttaattagaaccactcctgaacatttatcctctaggtgggttgctaagtctgatatcttccaaaaggaaggtgcacttttttgaaattttgctttaaatgtaattgcccttacatcatcatcaaacaagcactcacaggatgaccaaggcattgtatgcgattttaggttttctagtgtgtaattgcgctgaacaaaaagatatttaaattcccaaatataaccttttttcctttgcagttgagggtaccaggctgctccaggactccataatacaagcacataatgttgatcttgggcctgttccactgttaacataactttttctgcttctgtcctctataactgtatactgcctctgtcagtatagtgaaatcaacaactcttagtattgtgtggactaatacatcaggctgaaggtgctccaattctataaagtctatactgttcaccctctgaggctgcctcggaggaagatctctgaggtaggaatgttttgaggacacctgtgccagtaggtcttgaagtacaacatcactaactacactggaatattcttcaggctgaatagatgaataactcccaagatttaataactgactgctaaatgttgattgtagtactgtctcgccaacccattggtcctcatgaataacaacatctgcgagtaaaattatatctccaagaaacactgtatatgcccaaaatgctgcagtcctctacagaaaaaccttcttagtttctgattgatcaattactgtaactgttgctaaaggcactttagagccagaatttggtccgaattttatgtttatttccttcacatgacatggagatagcaccatgactaaacaatcatacttctggcttttagaatcacagttttttattaatgactttttttaatacccttaaattcagacacattcctctgatccatttctacaacagaatctcctgcattagaaatcaacttcattttcttagctacttgaaggactctagatagagcttcagactggcccactttatcttcagaggtgcagcttcttttaatagcacttttgtggaaggtgtttagttgggaacacagtattcctgagctacacaactcaatacgtatctcatttggtggcagttcatcttcagaactgaaaagttcttgagatcctgtattttcttcaggacctttgtcagagtttatgtgaatgtggctattttctgttttaggaaaaacaggactaaaatgttcaagagaatatgcttggttttgtccactttcatatgcttctgtaaaatcatcaagttgaatggaattctcttcagatattcttatcttcccgtaacttgcctttggttcagtctccatgtttacattccctttatttataggactccgccctttatctttcttttgagctaaaaaagcaacctggctggaggtaattatacagagaaattccgtatcagttgacattttaaggtctgagaccttcctaactgctgcttcagacttcagaccttggcttatctactgtgttcaaggaaaataatcccaaacactggttttgtatttcatgatattctgttggcacacactctctttgtaccacttcaggccctatattaatttgtttagtactacaaaccaaatccaacatagctgcacatttgtggtctaactgaaacaaatttgagtgaaagttctgaccacagatatctgactgatgtttaggctgttcatctataattttattttcactgagaagcttttgatacttttcagttaaatgcagaactatgctttcaaatccacatatttgcatattagagctcgttacctcactcagtctagaggagtgaatcttctgggattctatattctgtgtttcagaaacagaatgtacaaagtaatctttcacatgaacatgtctattcatacagtttgctaagtaagaaatgaccactaagatctggagaccaatagattctgggacttcatagttttcaagatttttgtgctgtttttcatccttcagatataaagaatgttgactgtataaaagctgaatttttttccgggggtcagcaacggacattaaagaaactgtgtgttgtgatactgtcatttttagtggagcaacaggatactaggctgggtggttctcaacaggatattaggcagggttgtggtttagcttatgcctatagtgaagccactggtttcttttttcttttcaccaaaacctccattattttttagaacaacattagtcttaaacctctctatgctctgtgtcaaatatcaattcctttaagaaaaggtttgaagctatttcatgccttgcctctccccctaggtaaatctctaatctctagtaatgtcacctttcttattgttgaagtgtatgttttctcttaacctgattttttattagtctggctagaagtttttcaactgtattgatcttctcgaagaatcagcttttggttttattattttcttgtggtttttaaatttgtttttgtttaattcttctttgctcattattattttctttgcctattttggttttttctttatttttatttttactttttaaaaaaattttatttccacagttttttggggaacaagtggtatttggttacataagttctttagtggtgatttgtgagattttggttcacccatccccgagcagtatacattgaacccaatttgtaatcttttaaaatttgctcctatttttctagtatctcaagacagaagctgaactctcaaatcctttcttggtttctaatctaggtatttagtgctgtaaatgtcctcctaagtattgctttagtggcataccacaaattgtgatatgttgtgttttcattttcataaagctgaaaattctaatttctctttttatttttcctttgatctattgattatttagaaatttgatagtttgtaaatatttttgacttttccagaaggttttcagttattcatttctgatttaattctatagtggttaaaaaagtactttgtgtgacttgaatcttcctgtatttatgaggacttgctttatggatcagagtatggtgtagtttggtcagtgttccatgtgcgcttgaaaagaatgtgcatcctgctgttgctagatggaggcatttatagatggcatgttgtttggtagtgttgatcaaatctcttatatccttgctgattgtccatctagttgtactatcaattactaagagatggatattgaaatctctgattatgaaagtaattttttaatggtctgcaaagcctgaaatagaactgtgtactataagtattctgtgactgtggaatctcttaaagtagggattatgtctcatacttcttttgatcccagcccatagttgtgactatttagtaaacagtgatggcaatgtgagaactatgttacatatatttagctgaccttagtgtgtatttgatatctatatatactatatatacacacacccatacatatatatatatattttttacttcttacatgagaacgaaagttatatttagatgagatgtcttttcagtgaaaacatccttacttttgctttttatttgatgtattttagttggaaaacagttataacaaaaaattaatctgtatgccatatatgtctctacagtttagctacgaattcaaaatttgatccagttgaaacgccattgacctttgcatttgactaggaacatacaatacacattcagtaaatattatattataaaaaagtctttaaaaatgtgaaataaactcatatttgttatctagtatatgtaaatttctgttaatcttgggcattaactattgaactttttttcccctaaggtagcttatacatcatttggataatgtatgtgattttttttttcagagtcataaacattctaagtgcatacggccatttcttccttatttcaatgtgtcacaacaatttgccacctttgttcttaagggatcttttgtaagtaaatatgtttaactttattttagttttgatttaagaatttatatattctgtcacaggccagtagttcttaagtgaagccttatattatgaacttttaacagtttgcatatgaattgacagaggccctggtgtcttctgtcttctgacttgctttaatctagcaggacagaagccagtaggaggtaaaatgctctgtgactttgaggaacacttacaaaagtcacttgcaagaaagttgttcttggtggtagaagcattttatggtctagggaactttcaagcattgatatttacagtatactatgccaaaaatattgtttaaaagtaccagatacttgctatttctgtgaattgttaggtttgaattgacaaactgcagtaccctttctgattactaatggcataagaattgttttttaataccagaaagttattttaatttagaagttattacacaggtacagtaatgaatgtttttgaagcaaagacactgtaatttttttatcatttgccaaaattctttagtgtttagagaataaagtatttgcttgaacaatgttttcctatttttaaaaatattattatttaatatttgaggtgtttctcctgataaatagagataatattgtcattggtacattcttgctggtactgattttggaaatcctcaaagaggatgtgatgaattactcagccatgcttttttgtcttttctttacagagtgaaataccagagctacaggtatggtataccaaacttggaaaaacatccgaaagatttctttttaagcagctggattctctatgggtaattttaaagtaaattcttatattttgggtattccaacagtaaaacagtaaaagggcacagaaatgtcattaattaagaatttttatttttataagtttgtgtgtttatagatgtgtttagctcttagacatttagtttgtcttggtggatggtgacgccatcacctggtttcccaggttggaaatttaagtcccatttgagactctctgtctttcccactcaccctctgtatcccgccagtggtcaagtatagacagttgtatccacacatttctcttactcactccttattctccattaccaccgttacttcttgtttcagttcttcattatcgctctcctggatttcagaaactgcctcttgtttttccagtctgactttccaggtcacccatcacactgctacagagtgaaatgtcaaaaatgcagatctgatttttgtgaccactgtgctcagaggacctcagtgattattttcttagaagttaacattccttagtgtagcacatggccctcattatcctcccagaaggtagaagactggtcttcttcctagagatgtgtcctactaaactggcctctcttcacatactaaacttacatttttcaaagcatagcatgcctgtttatttacctctgtgactttgcacatactgtgttcttcacctagaatggcctctcctcatctttgtcatcttttgagactcaattcaagtgtcttttcctctgacgcttcctcaccagtcttagctcatattcacctagggccatgtgcttacctagttaaatgcttttcctgcaccactggacaccttgaagactgagccttgccttatttagctttatatcccaggtgcttcccacagtgcctcatccatggtgctttctggggaaaggtttcaaagaacgaattggcccaaacaagcacattatttcacttaattgacacaagtctaccactttttctggttattattaatgttctgataaccaactagtcactaacagtgataaaacaccttattatatattaagttctgaaaaaaaagttcatactttttgtgtaacaaattgctaggaatggcataataaaattgattttcctcataagaaaaataatgtcatttggggttattcttcaacctgaatataacgtcaggtatttcatagatctgatcatcaatttaccattaaaacaaggataataactccttttattcaaaatagaaaaaaactgttcaaatttcataaaaggattccagtgtcttcagagatctacatttagcatagaacaactttgatactgggagcgttttccattggtcacacactaggcttagcactttaaaagcattatctggtttaatcctcacagcagtctatgaggtatgtattttttcctcattttgtagatgaggagattgtgacttaaagagattaagttgccaagatcgtaagtgtgacataagcctaacttgctagttgaaatatatattgatcataaaatgagcaggatttttctctcttaattgtaaaaggatttctgtgattaacagctgggtcgacagtgatattttatgaatttttttaccttagtaaattactgagagaaaaaagcaggtctcttagttgcatgtatcgaatatatccaagctttaaggagcttactgtgtagtggaaaagaataggctaatagaaatagattttgagattatttagtccttccttccatgaagtaaggttgtttaaaattataaagcataattttataaagttttctaaaatacttaggaaaaaaagattccaagggccttgatattggtgagttttccacaaatgtttaggaagttctaacagaaatgatttggacttttctttaagctaatttttttaaagctattttgtccacatgagatgagctatagtacctggtcctgaatacagtagtgtcttctttttcagctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttggtgagtatttttcactaaaacttaacttggtctctatatttaacagtagtgtgttgatttctacctgtcaaactgggtgcatgatggagtggctgtcaaaagcacattcatttacctcctacatctcatatgcggtaaaaggagggctaattttttgcattactttatggtaaatctaaatttgaggaccctgtatttttcagtttcagaaaaaaatatagggttcattgttagaatgaaagttatagttctgatttgtttttggtgaaacttaaactttgtaactttgctactgccccattagccattactgacatcttccttctgtgtggaggttaagacacattcatatctgtctttctgcagtgctagtgaactgagtgcttatgggcagttatgttgtccttggctgatccaactcattatataccatcccgtgcttttttttttaattgagctttcttggttttctaggaagatctgtcctaaagttgttagaaaagtttttggttataggtgatttaggaaaaccacttggaaaaaagttagaagacatggtcattgtagttatattcctagtgagtaagtaacaaaatttgttgactgcttggtggtgttctgtaggtttatgggtctcacggacagggtcaggtggctttgtaatctgctcctaaaatctgtagcagcaggagagtaataaggagggagctggcattgctggagcatcacttgaagctcctgtttgctgcagagctgcttgttccaccaaagatggacactcctatcaccctttcccagtcactgctacagggtctcgcctccctttctcaggaaatgatctagttggctggagtataaggccttttggactgtgtaatggagtcctctcaactataatacagacaacagtgatcctcagggggagcttggtggtttgtttttctgcaactctttgaaatggcctcttagataaacccattaattttgtgaaacacagggtctttaaaatctgttgctcgcttggttctctgttagcaaaagtgacttttgccttcagtaagtgaggaatctgtgtgggatatggcctagataatgagattgaagaacttctgccagcaccaagaccaatattttgtgaccctgaagactaagaggcaatttcaaaccttcaaatataaaatgtaatactttatgagctacaatataaatttaaaactaaagttaaatattataagctaggctctggagatacttgttagggttctaaatgtctcaaatgaggtaatgaatgcaaaaacacttggaaaagcatgaggtataagagctataagatatataaaatttctcctctacagcattcattattgtaagactataatttaatttagtaaaactaaaaagggattgataacttaggcccaaaactggtttttgctgcagtttagaagtagaagaaaatttgtaaattttatgcttgatatagtaaacctttcttatgctcttttggcagatgattgtgacgcatgatttggaaccttgcttgacagatattagaaataataaagctatcccttattgagcccttgccaggtgctggcttatgtacctgttatcttttctttaattctcttgtcctcctgcaaacctggaaatgaagaaactttagatgcagggcagttaaatagcttgtccagggcgacagactgaactcgaatttgaatctaggtcttacttcaaaactcatgacctttcctctacaccagatgcctggattaaatattatgcagcatctatatgtcgaactcatcatcttgatatttagtaatgatgatacaaaaattaatgtatctttattagacctaggccctaaactttggtttagattttatttatttatttaaaagctttcagaagtgtttcagacatactataaaatatcagcaaggagagcttctgaaggatttgatactaaacagagaatttcttacattctgaacagattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggtaagattgatgttctcaatgtggatctggctgaaatacccttgtaatattgtcaggtacattttgaagtgaagagttttcaatggtcctcctgtttcaagaacctaatagatgtgtaatatgtaatattaagggttgttgaatagtatggtgatgaccacaaagctgcaaattgttttgctgccccagtgtccttccctcatctttgccctatttaatagtgattattacaggagcaatttgattccagtataaaaactaaggacttttggacccaattataatttaatatttgtttataaatagacggatttgtgaggtatttttaagtttttgttttgctggagagttgatttgttgatctggtgttgccatctagtggaccaatcttagaattacaccgtcttagccttattaaaagatctatttaccaggtgacagtagatggcaatagtaaaaagctaatcagctttagtcgcctagtgaatttaactttttatttagtcatctggtaaagagacaagttatattattcacataaaatataatgccaaactaaaactttcccttcctcttttagttacagaatttctatgtgctgacttattccacctgtcatgtgtttctttttcattttttcctataactagtatgattccactgtgggaaaagaaacacataaacattccaggtttagagctagtactagtaataccaagccaccaaaaagccatatccgaagcttggaaactggagagggaagagaaaagaattctgaaaagagccttgaattgcctgtctatggagtgtgcagaaagtgtttatccctcctgaagtgccttactcccagttagaaatcctgattctagtcccaagctctgacataagtcttaagaaacttttagttatccagagcccctggaacccttataacactatgaagagttattgaggtgcagtgaagaattctttcctaatttaggatgacatttgtggcttgtgtttttacacagaatttctgcttgtcccattgtctctgaggtggaaactttacctagattttccgattatggcagtggagttcttggcagccttatttgtgactgatggtcttattttaagtccagtggctgggtttaagtgtccaaggcctgggtcccattgttttgatctccagttttgaagtcgccgtataggaaacttttttttctgtgacatcccctataccccatgcacttgaataccatagagggctctttctaaactcaaactcaatcttatttctggctgggactccaaaaagattgagaagccccttaattgtagtatagaagtgagatatagcaccatccaaagatttactcccccaaatcttcatatatttgaatcttcatatacatcttcacaatttaaatagcaatactcagtttttactaggatctattgcagtgggtaaggaggtggggatgagggatggggaagggtgtagaagggaagagagtgacatattctgaaaggaaaggaaccgggaagttgcaattttgcgtgtcaagaaaggcctgccttcatctttctgaagccctgttttcatcatgttattcccctgctcaggaagatgcagtgactctctcctgctacctgtgttttccacttctaggcttgatttccaagaccctttataatttggtctcatctactatgtgttattttccagtactccaccctctatttgaggcagccagatctgctcagagatccacacaaatcccttgttcatttctgttgtctggctgctgtgcccacttattgtgggaaaaggagggaataaaaattgggtaatagtaggcactttgatggatttcccacacaaccactttatggtggagatatcatcgtccccaccttgcagactgagaaactgcatctttggaataagatgtacccaatatttcacttgtaagtggcagaaccagggctagaagccgggtctgtgtgactgagtagcccattctctttggagtacatctcacagcctcattttaatcatcttcttcctaaaggtaggaaatgggaaatttgtttagtttatctgtagtgctattttagtaaatctgctctcaatgagtgcacactactcacagtttttagacttgtgttttgagtagaatttcctctcttatacctagatttagtaatttaccagcacagtaatttgattatatgggatagattgtactataactggctacttctatcttgatagtgagcattggttggaatcctttaaagacaatcacaaaattacctttccctgcacacagatgaactctctttgatcaaatttgccttatgtattggctagtttttgttctttaagcattactgagagattgtggctgtggaagaataaaccacacttttattccatttcattcattatctgtgaaattgcctggcaagttctgatgcaagaatcacttattctggaatgtggtatatagaaaaggaaagtttgatcttctctcattccaactctaaatagaataattttatggtgctgatggtatttgtagcactttcaaacttctgatgaaccagaaaggaggtaagggatgtaagtaccagtgttgattgccagtggtttcatgctggtgataatctatggagagaaaactccctctgatgtcagaggacatacaagagagaatgggcttgagttacttagcatttatcttcctgtaaagtagtccagctctgcttagataattaagtgtggattgtcctccctgtgtagctgatgtaggtacttctgtaatattttcctttatgtagtaaaatttcactgtgcaaaattcactgataagacacagaaatgtaaaagccacataattctagatctcattccccccagcccatttccagaatggatttcttggtgtttccagttttatgtgagatatattgcttgatttatgactgggttatgtgcaggctttctttttcttcccacttgcagttagatactgagtaggaagtgaaatattttcagagatcatgttggtttggggtggttgtagcattccagaaggaaagtgttgtacctggtagcatttgtaagaggaaacctggaggagagctcactgtaaaagctctggtagtccctggacagctgaatcttttcccatctttgatagactgctgtggatcagtgagcctagaaccaggattttattgcttccttatagacagatacttcataggggaaaatggtcctccaagtggcattcctggatgagcagcatcagcatcacctgggaacttgttagacatgcacattcaaggggctgccccagatgtactgaatcacgctgtggggtagggccagtgaactgagtttaagaagccctccaggtgatttcagtgctgttcaggtgtgagaagccctcctagagagtcaactctgtggtctttgcagaaaaataattttagatcttttcttctggagttttaaagttttgttagatttaaatgtaaaagttggccccggaatagcttatgttctcccaaaggctcctagcatgccttcattgcctctctttgttgatggaagtttgaataaacattttccctcagaattgtgtggaactttttactttttaatgtgttcatagacaatagtggcattttaaaatattgtattcttaagatgagaagttgttttattgtagaaaaaaaattttctcaggaaacttaaaaatcataactattattgtccagtaatcatttaaagaggcaatgaaatgacttaagtcatgtaacatttaaaactgttgtcaataaagattcttgaagcccatctctgctacaggcttagacttagcaaatcacattctcacctcaattagaagtttggaagcatgtgctgtgaaatgacatatctgtactatgttacaaagggcatattttaaagagtactaatcaactgttttattttgcaggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttaggtaagtgacttttttttttttttaatagcatatgacttatgggctatgttactttgagcacctacttgttatttgtgggagtgataaaaagaattcaacccaaggtgtttggacatctaattgggaagggatgtaagcaaataccaaatagtttacaattatagaaagttatttaattcctagagatgggggcagctctgtggaagggaaaataattgtacaaagcttttaagggtattgtagagttgaactgggctgtgaggataggatttgcatagatagtatcaaaaccatctgaggtagtggtggtagggagagaatgctcaggaggcaccataaataaaagcaagagtatacgactgttgctgctgtacctatagaaatataaggaggggaattgatcggcttaaaatggaaaaatctcatttttgaatttagttaatacttgaaaatagcttgacttttctcagtcatctttacagcctttgtgttaggtaggataatattttatccagaataggtgcttcaaatatgttcagattgaactgtgtccacttcagattggttttgatacacaccactcctttgaagctagaccttactggtagtgacttttcttgattctcagtctcttgactttcgtcttaccttaatttaaaaatatctcttttatagttttctgctctttgctttgactccataaataaaataaaaattaaagaggaagtaggtagtaaggatattagaacaagagttacatattcatagcattaccaatctgaacttacctcagtgatattgaaatcgaaaacatagaaccagtgaggttaattgagtggcctaatgactcaaagctagttagtggcagaactggaactaggaatttaaatctgtgtctgcagtccctattgtctgttttaaaccgcctacttgaaattttgtcctggggttctcataggcattcaaataacactaattccaaaaattaacttactattttctccctctaagttaatactattaccatgtgaccaattagactggctggaaattttatattctgtctctcttgtcttccatattcaatccagtcatgtataaatgtgtacttgaactacagatgctaacacctcatactatcactggtttttaagtttatttcactggttctgttgtgagctcacatatagtatatggctcagagtaggatctcagtatatgctattaaatgcatggctaaatgaaaaatgttttggcttaactcagttgtagatctgggaatgaagggacatagctctctgttgaggctgactttactacatacagatgccactcgagaaccccactgaattatatgattctgtgattgagatctcaaaattatatctattgggataatatttttgtgttacagctggatggattatatatgctttaggacgtgttgaagttacagcaaaaaaatggtatacactcacgttaactattaaggtaagtattgctgattggagtctggaggtaaaatgctcttttgttgtgcatttctataattttctgttataaaataggagggggaaagtgtgacatataatgaagagagacaaagaatctgccttggtgccgggaagccactcatccctaggatagttacatgtgtgagggtaacctatgtgagaaccatcagcagttgactttatcaggtcactatttttttaaaaaattttattttgttttttaaactgaggcataattgatagagtcaataattgaactatttttttcaagtttgcttgaaccaagactgtacatggagcttatagatgtaagcaaagccatatgcatttatttttgatggttaagaataatttggttttcaattataagcataatttttagaaattggtttccatgaatattttagtcagagaaaataccagattaattttagtataatagaaatataaaaatgttcctgagaatcactgggtgatcatgagttactgctcgacagtgcttccaagggatgctgtgcagataaatttttgtgtataatgtgttggtctctcccaagatagctctctcacaattttgtttagagtgcagtagaaattaaaaatcagattccaataactttggaatttgttctctcaaccaccaaaaatgacagcactaattattttttagcattaacaatatgtatattgaagatttggtttggatgtagcatagattatttaactataccacactagccaaattgtagccattttatagcaattataataatattcactattattgaatttgaagattttttccaaactcatagatatgatttgtatttccttgataattagggagcttgcacatctaatgtttactggctatttgtattttctcttctctgaagttgcctgttcacttctttcttcatttttctattgtgttgtctttttctggcaaatttgtgtgaatttaatatgtattctggatagtaacccattgtctgttacatacgtcacaactatgctcttccttcatgtgtattctaattttgcttatggtatttttgatgattataagttttacattttgatactgtcaaatatttcactttttattcattgcttttatgtttcatgttttaaataaggccttcttgtttctcaaggttaggaacatttttcccccaagctaaacaaagtttaggatttatttttatgtgtaagtctttaatacgtcagaaatttacttgtgaattgtaaggggaagtactgaatataattttttaaaaaatggatagccatcatttattacaatggactatccttttgcccataatttaaaggctacctttttgatgtaacaaatcagcacatgtgcacatgcttgtttctgaacttttttctgttctccatattgatgtttgtctattattatccaaaatcacacttttaattggtgttcacattctaaaagctttgatgatacagctactcccttgcttccttcagagttttcttacctgaccacctgatagaaaacagcgccccatctcactctctaactcctttctgttgctttatttttctccaaaagttttatcccaagctgacatcacacatattctgttaattgttcatgtgttttcctactcccttcactagcacatagctcctttagtgacaggcttttctccatattcctcactgctggctctgtagcacctagaaaagtgcctgacagccaggcagagcaagagtccgaataatacttggtaaatgaatgaatggatatctggtggggcaacttcctcattgtttctttttcaaaattatctttgctattccactatatatattattcgatttgacttttaaaaaacaaactttcagttacttgaaaaatggtgctggtattacattaaatttacacatcaatttaggaaaaaatgacttttttttttttaacaataatgtgtttccccatgagagaacacaggaacaaaagcatgctatatttcaccatttattaagatttgccactatgtccttcagttttatttttgcaaacttttgattaggtttgttttagtaattttatgagtttttttgaaatcatgaatgagattttaaaaattttcttaatttttttcaggtactttgcatacctggttaaaatatcaataggatgtgaggcatcttgcctcacatcctgttccttcttcttgaccccattctgtgtcttgtacttctgatacagccactcttcactattttagctgtttcttctggtgtgtctttaatataatgtgattcattacttttaaaaattggctcttgtcttgctactaggatggataggactttgctggcttgcacccacctcactcccctactcctgttattttgtgtttcatcaactatgggcattctgtttcctcttgaatctcagcttttgccacatactctgagggtcttctgtaactatctgcactaaagtagtctgtcaggcacccattgtcaccttgacctggcttaatttttacatgctacttatcttttagctctcattttgtgtgtgtgtgcatatctgtccatctccttctactagaatataagctccataagagcagggaccttgtctttcttgttcatcttaaattcccagtgcattaaacagtatttgacatataaatcttctttgcgtaaataaaaaaaacaaaacatcatcttctatgttgcccatattccaaattacagctaatgtgaggattttgtcactgactatcagccacctgttgaattcttctcagcacttgtcaggtgacttgtcccagttctgttgcatggtgggtagcacaatggactttgaagtctactatattctacttgcaagtattttatattgcacagcttcaattttcccatccatgatatcatgaagaacacttttcttatgaagattcaatgagaaaataaataaatatatatatatatatagtacctgatatgtggtaagcacttaatgagtcaagttaatatttttaggagtaggagtgtttggaaccagacagaccagcattcgtatttcctcactaacacatgctgagacttctagcaagttattccacctctttgagtatccatttccttatctgcaaaatggagataacttctgtgaggttgttttgagggttaaatgtgtttcattcttatattcaacacatttttattaagcccctactgtatgcactttactaagtcctagggatacagcagcgaacgaaacagacaagattcctgctctcttagagcatatattcttctaggacaggggttggcaactttttctgtaaagggccagatagtaaatattttagacttcgtgggccatgtggtctctgctgtggctacccagttcggctattgtaatgagtaaaaaagccatagacaatagacaataatgagaaaaaaagccatagacaatggatgtggctgtgtttcagtaagattttatttattaaaaaaagggcggttggcatgtaggtcatagtttgctgagccctatcctgagataataaacttgtaaataagtttataaatgattatgaagaaaaaatagagtcatgagataaagtagctctgttaccctgattctctaaccagggaggtgaggaaagacctcactgagtgggtagtacttgagtgcagacctgaatgctgggaagaacaatttgagcagaccaagtggcaggtgcaaaaggcaggtgtagctgacattgtgtgaagagcagcctggaggctggggtggctgaagtctggggagtcaggagagataaggtcctgttagacaggttttgtgcttaatgtgatctgtgatttgagtcccttggctcggtgttaatattgagtgtttgatggcagcagaagatgttcagtaagcacttctagagctgaagatagctgtgcaagtctgtagtaataggaatgtggctctgaatttggagctaggtaacttggagtgaaaacctgtgactttgagctttaatctattaagcctcagtgtttccatgcataaaataaaagaactaaattaaggcccattacattatacttccaagacttaaaagcagatttattctggttcttggcccagtgctttgagttttgagctcttcaccttctgagagtagctagttttatatgattgactgtagttagtatgctgtgaatatgtgctcataaatgtactatcataaagataataagagctgagatttattgtttaccatgtgccaggcactgagctaagtagaatggcaacattcggaggaaggtgtaattttttctttcactgtcagtgaccagtaagtcacaccttatagatgcctcccttcttccacccgctgcaccctactccagcatcactttaactgatggttactgtttttccaacttaagggtaggagcttcatatggctttgaagtgatattctattcatggcaacaaaacacaaaaactaaggttaattatttttcttctggctgggcagaggctccttaatgaaaaccttaaggaagcaatgaggtagaagcagatgttttgactccagcagtcatgtctgaagagctggtggctgttagccacaccacttgtacatgtgactacttataaataacttttgttaaattttaatgagcttttttctaaaactttataataatgcctgaaaagttttgcattttgttggttttaaattttggtggagcacaggaaatattgaggtattccttgtacgttgggaacgatttaagtaggtagataagaatttcttcctagagtttttttctgtattttaaacttttgctcaaacttgtggaattgtgttttgctgtggttaagtcttgagtgagtagtacatttgctccactaagtagtgggccatacatgatcaagaaacagacttcagaggaccattttcatatggtttcaaggaatgtgtttctttctactctagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaatctttgtgtcaaatatatttttatttcttctggatgaatactgaggagtgaaattcctgggtcttatgttaattgtatgtttaactttataagaaactaccaaactgttttccaaaatgattgtatggttttacacttctatcaacaatgtttaaaagttccagttactctgcattcttgtcagtgcttcatgttgtcattctttttaattttaacccttaattgtgggtgtatagtatgtacatttctctgatgactaaagctattgagcagatgtcatggacttaatggacatttatgtactttgttttatgtaatatctattcaaatattttgctcatctaaaaaattctgttttttccattgagttttaagagctctttacatcttccagatacatgttttttttttaaaaaaaaaaagttttgaaaattattttctctatttctgcaaagagcctgatggaattttcattgtgattgcatttaaattatagataaatctggagagaactgatatctgactaatatggacccttcaaatccatgagcagttacacctttttaaaaattttattttactttaagttccaggatacatgtgcagaaggtgcaggtttgttacataggtatacgtgtgccatggtggtttgctgcacctattgacccattcttttaagtgcagggggggggggggggggggggggggggcccctggtatgtgttgttcccctccctgtgtccttgtgttctcattgttcagctcccacttatgagtgagaacatgcagtgtttgattttctcttcctgtgttagtttgctgagcatgacggcttccagcttcatccatgtccctgcaaaggaaatgatctcattctttattatggctgcgtagtattccatggtgtatatgtatcatgttttctttatccagtctatggttgatggatatttgggttggttccataactttgctattgtaaatggtgctgcagtaaacttatgtgtgcatgtgtctttatatcagaatgatttatattcctttgggtgtatacccagtaatgggattgctgggtcaaatggtatttctggttctagatccttgaggaatcaccacactgtcttccacaatggttgaactaatttacattcccaccaacagtgtaaaagcacttctatttctccacagcctcacctgcatctgttctttcttgactttttaataattgccattctgactggcatgagatggtatctcattgtggttttgatttgcatttctctaatgattagtgatgttgagctttttttcatgtttgttgggtaggtaaatgtcttctatttgagtagtgtctgttcatattctttgcccacttttcgatggagttgtttttttactgtacatttaagtagcttgtgaatgcagtatatcaggctttgtcagatggatagactgcaaaaatgttttctcattctgtaggttgcctgttcaatgtgaatgtttgtttcttttgctgtgcagaagctctttagtttaattagatcctgttt

SEQ ID NO: 13239 - DNA, 146104 bp, Human
taaaaccttcctagaacgacatgaaaatcagagctcattcattatggtgtgtgaccttgctgagttcttatttttaaattcagtaaaataccatatgtgcctgtcaacttggtgtatatgtgtgaaaacactcatccattcctgaaacaagaccttttggataaaaaacaaagataacttctttgaataaagcaaagactaaggaggagagtgagtggagctacaactgtcttccattctatggatactggcacagatgccaagtttatagaaaatgttaacttattttaatgatctactatgaccaggaaataattttccccctttgactcaacttatctttagctacgtcaggccattaaacacatcagaaagcaaatgagcttggattctgtgaaaaaaaaaatcaatggcattagaaaaatatgaagacgcttttctagaataaaacacactaaacagaacaagcaaatgcaatctttgattggatcctgcttgtcttagtccgtttttgctggttagtttataaataatggaaatttacttctcatagttctggaggttgggaagtccaaaaccaaggcttgttctctgcttccgagatagcatctccttgctgtgtcctcacatgacagaagggcaataagagacaagctcattcccgcaagcccttttttaaaaggcaccaattcataagtgggaggggagtccttatgacctaatcatctcctaaaggcctcacctcttaagacaattacattggagagtaagttttacatgagttttagagaaacacattcaaactgtggcactggtttttaccaaacaactgtaacttttctgtgtgtttgaaaattttcaaagtaaatagtggaggggaaaagcaaaaatattctagctccatctctttaaaaaattacctgggattatggtttggaagtaatacagagagagaaaaacactaaaacttgttctataagaagaaggactatagctctgtacatttttggtaagatgtttggcacaatgctttataggagcataaaaatattgtcctaagggttaagattttaaatagagaaacttatagggaaagaggatgcagttcctggttatgaatcatgtccatcagcctgacactttaattacaacttctttggagtttatagtatattatcctcattaatccccaattagaggtttgagtcatcaaaataaatctgcaggacttacacacacagagttcattatggagcagcctagcttcacgcttccaggtgtatgacatatgacaccctctgtcctttcacttctgatgtgtctctagttcttccaagccaaaagcagagcccaggattagagcaacatatatttaagggtgtgtttttgcagatgtcagttgggactagaaaacaaatgtaggcatgcttaaacgctgagaccaatgtggaaacttcacgaggtgggggtagggggaagaaaatttttggtggggcacgtttaagttcacgttaatgtataacgctatcaattttactaccactgagtgggtatatgaaggggatgcttgcgtgtctgtgtgtatgtgtgtgtggtaaaggagggtgtgtgtgtggcggggggtattttcacaaaatgacatggaaacctgactgcagttcttttgggaagaggacttggaggtgtcttgggggtggggaaaagatggaagactgggatttcttctggacttcagggaagaaggatgaaaccaaagggaaacaatccaaggcagattaatgaatttagtctaatatttgtgaattcaaagtagattctaatcagcccatctcctccctcttctgtttgcagaactggcactaaagaggattccccaagctgcttcatcactccctgccattcgctgtcccaggaaattctcctgactcgccccggaatccgtgttcgactcttctctggctgagctgttcattgccagccaccctgagactccccacgcggcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggcgcggcatctttcttggatgttttttctctacacagacttctttctttccttgggtaagtgaagtccagcttgtaaataaccaaagggtagaaccgaaggggatggagggggattgcagtagcccaaagggctaagttttcttgggagggaggtctccctccatccccactccatgcagtccactccaaatacgcagttgaggaggagttgtgtttgatttcagacacgttttgggaaacggtactgggatttatttacctaattttggtggatttttttttgggggggggcgggtaacttgcttttgtctacattctgagaaaggagaatgaaagtggaggtgagagaaagctccagaggttggaggtggggaaaagaaaggagggggcggcatccagtgattaagcagagagatcatcccaagggccaatgactagtgcaagtcttcaaggcagaccaggagcactagacactgatcctgctccctgccctaatagagtctacccccacctccccatccccaaccctccccttataaccatcctgctgttgccattctggggaaggtcatcactactcagggccccaaataacttttaatggggacctgcaacctgtcttgtacacaagtgatgctcaataaatgtttgttgattggccgaatgatgttgcatcctaagggtgcagttcctgccacaggaatttgccttggacagtgaactaattccccaatgcagaccccagaacacaaccataggtcagttcattttgcaaaggaggagggcctggaggcttggaaaatatcgtatttagaccttcattacccaaacgaacccatgggacaggttcagggtcagattcatgggtcccgggactggatgagctcacaaggttctggcatggagagcatggacctttgtgtcaacaaacttgggtttgaatcctcatatcgtgaccttgggaatgtttctttatctctctgagccttgatcttctcatctgtaaaaggaggccagttacagcttctgcaaaatgatctaacaaagatgaatggagaggaaatatgagatggtgagggggaattcagtaaatgtcaatcttgcctccccgtgctctgaggactcaggagagggtgtctttctctgctgaagcccctctctgactctgatgcatgtaaaaaacattgtattgcagtgactgtgctagagtccagctgtccgtgaacagttaaagagaagagcgcagagggaggttcgaaagcctttcttagaagcatctccctctggacttgagaacagaatttacatacacactggtgtctcggggcatggctgggagaagcagagattccttgtttgtttgatttctatgtcttagccatcctcccagtcctagtagagagaggcaaagtgtggttacagagtccagggaagatggttctgaagcacccgggaacctgcctaaagggctgaagagtcagagtagcaccatcagattggtaccagttttgcctgaacggggtttgcagagaattcagggctccagcctggggtgcctgtgacagcccagtgacaaagcactcacctttcccacagaccacagcggacctctgtaggtcttgctcttggactcagaaaccttgatgtgatagtgacggatggatggtgagaaagatgctgctgacatagggctccccagaagcctcaaggtgccgtagagtagcatgcaacttagagatcagctgctagtgtgggattttaggaccccagctggcaggcataggaatgagctgggcaatttctatgcgtaagtaaaggcaacaacaatctaacaggaccttatggcactagatagtaagccccatgaaggcaagatctctgtcttgttctctgccatatggccagcacatagcacagtgatggcacttggaaggggttcaatatatatgttgaatgaacaacaaattttagtaaccttatctggaagccagagtaggggtttaaactacttcctatccaacactgcagcatgcaattcatgtcttcatttagcaagtatttcttgagcacctactacgtgtaaggctccgttgcgaggcatccgaagcaatttgtcagcatcattcatgttgatactcggagtgacccgttcaagagcacctcagcaccacctggcttttctgaagactgaggccccaccacaaacccctgtggggcttcaagcaggggcagtgagagggcgttagacgaatgctccaggtttagcccctttccgggaacaggtctgggtcccttcgcatctgccctgctggtcccaggatcccggggccgccgcttccgggagctgccgggtcttggcaactccgctttcctccgggggcccccgtgcctctctcaagcctcctttccagccaacgaccagcggccccagtccggctgcaggtagctggggaagggaccaagctgtgccttgggagcgagcttccccgggcggggagagcgcagcagatgcggagcggtcccagaacaaaaggctcatggctggcacgggcctccttggagtgcggcggggacgtgggttcgggactcaggcgagagagccagacgcgggaggaaaaaaaatgaagtgagaaaagagaaggagggagagctcagggtgagagcggtgagaagaggtgacccggaggccgaggtctgcggcggagccgcagcggcccttcctccgcctcctgcagcgccttccaggcaaccaagcgtgtctccggctgcaactccagcaagcgcgccgctgccgcctccacgcccgcccgccggccggccgagccagtaagtagcggcgcgcccaccgctcgttccccgcccctccgcggcttccccgccaccgcccaccgcctcccgccgccccgcgggcaagtccgcgaccgcctcccgctgccccgagccgggtgccgggggctcagcgcgccttcccagctgggagcctcggtccgctgctcgccctgctccctcttgccggggcgcggcgtctggggcgcgccgcggggagggtcgccctcgccgcgcgctgcccgggcgccgcgccacccctacatccaatggctttcggggagcgggaagtggggggcgtcgccgggggcgaggagccgcggccggggtggggcgtgtgcgctcagcgcggccgagcgaggctgacgtgcccgcccaagcgcgcgcccgggagtgtgtgtgcgggtgtgtgtgtgcgggagtgtgtgcgcacacgccttcgggggctggagtgacactgcagtgggcttctccgtagccccagccttcaggctgcgcagcccctaacctgccggcaccgcttttgggaagcagcttggctcttccatctccccaagccttcctctccatcctttcatccacccctcgccgatcttactttttcttttacccacggggccgcggccggccaccccctggccggtgcaaacacccaagccctctccagttctcccccaagctaatattttcccacctgtctttttctggggttcctccacgagccagtccaaggctcccccatcctcggaaattgttttgttggactgctaaaccgaggcgtgtaaagcttgaggactttattattatttgggttcttttcatttcttccccttctgggcaacgaagcaatgaaatttccaatcgagacgccaagaaaacaggtgaactgggatcctaaaggtgggtgtttcctacttttggctgccctcgccctgcctctgtctccggcgtgtgcgcgcttccttgagtggaagcactcttgcttctggcagcgtgtgtcctgaggctgggaaatgcgcctgggaactgcagcgcgggtgggaggagggcggaggcagcgtgggttccgaacccagatagtgcctgtcattaccacataatcattgtccctcctagattgtctccagatctatttagatagaccaagccgactgtttggtttgaaattgcaagtgtcggtatttgcttttgactttgagtgtgcgagtgtgtgtgtgtgtgtgtgtgtgtgtgtgtgtcctttgtttctggtgatctttgtctctctggcagatgggtggggtgcttccccctggacctggagctgcgccgcatgcccgggtgtcctcagtgggaaaggtttcctggcagcaagtggggctcgagttgcagcagccgtccctaggggtgggccgttctcgcagggcatgcagaataatggagcccacagggcctcctgagtcttcgttcaatcttattaccaaacctagcagctagttaggctcaggtcagagtagaagcaggaggaggggtggtttgtgagaagggtggggctggcaaggcataggggaggggcacgaagtgtgcccgcccaagcaatggtgtggtttgcatgcttttacgaatgttggaccaggtttcatccacgcaaaagggagggattaagacggatttgtgtgtgcctagcgtcggccaccgtgtctgtaattagcatacagatgttaaggctccaagggagtgatcagtatgagagcagaacaagttggaaccgcgtgtccagttgtgacaagaatgctctttagcatttcttgtagctcatctgacgactgtgtcaggctaggcaacgcctctgtgtgtattggaattgaaatttgtttatttggggtgcgtgtgtgtttaatgttctttatgagcgcatttcttctttttctccagactggaaagaagaaaccatcttatttgttgagtaaatgtcttaggaattgactggctattgaagagtgagtgaagagatactgcctttttaaaacactgaggctgttacatcttaaatacagcccaaaccttctattttgtctctacttgaaatctctggaaatatggaggtgtgcctttgcttttttggggggagaatccctgaaaagcatatttgttaaatacctattacatgctaaacactgtcctaagctctggagatacagtcagaacaggaaagataaaagctctgacttggagtttacagtgagggagacagacctaaatcaattccatggaggaatgcataattcaaagtttatgtatgctccagggagagcatcagaggtttaagaaagtgtctgatagaagagattgacaaggaccagagaaggcttccctgaggacatgacacttggacttaggcctggaggatgtataggagttaattgtctaaggaggaggggaattgttgcagaagagggaacagcaagtgcaaagggcctgaggcagaagaggtatgtgtatatgatgaactgaaaggaggttcccatggctacggcagagtgagtgaagaggtattgccttttttaaacacccaggctgttatactgtaaatacagcacaaacctttcattttgtctctatttgaaacctctggaaatacggaagtgtgccttggctttcttttgggaaatccctgaaaaatgtatttatccctagcagagagcaagagggcttgtgttttgagatatgactgggggatccacaggcgagacgcccccctccaagccctgtgttgttggaggtggggtagcattgtggggttggaagagtatagtatttatctaaagccaatgaagagtttcaagacgaggagtgacatgatttgagctaagtttcaaaacaagtgctgtgtggctcttgtggatgtaggggaccagatacaatggtagcatgggccagggtggttgctgtgggcatggagaagcggacggagtagagagctgtagaggacgtgaaatcaacaggctttgcatgaataatgtgtggaagtgaagtgaaggaattggaatgactgagatggcagccagggcaggaccagtcttgaaggaaagctcatgagttcaatctaggacttgttgagtaggacatgtccccaagccatccaaggggtgtgttaggtgggcagctgtctaagtgctggggtcaggatcttcaaggaacagagggagtaccgtgagactgattttgtgaagctggctttgtgttttaaggtacatttctgtgtgatcatcattctatatattcatgttacagtgatgaacacagacaaattttacacattttacagcctgacacagtgaagaaaagcatacaaatagcaccttcagttacaaccagtggtgctaaaaatgaaaaaaacctcaataaaaataacaacatttaatgagcaaccattgcatgccaggtgctttatgtacattgtttcatacaattattttcacaatacttatctgatggtataagtgttatagttccatttggcacttgattgccatcatgacaccactaatctgccttccagtggagttgctctgactttgtgcacagttattcccaaaggtaggggtgacagtagtctttttctagccaggggatggaggagggaagagagtgaggagtgaggtggcatatctcttatctgtatagaattatgtgctaggtgctcttctaatgttttacatgtgttaatttaatcttcacaaacattttaggagaaaggtattatcctaattttacagatgagttaactgaggaacagagagtttgagtaacttgcccaaggttgcacagctagtaggacaagattagaatctgggctcttaaacactcttcaagtctgtgtttcttattgggacttttggcttttgcctggtaaggttcccaaagctcaggaagtggagaagcttgttgcgaggaggaaaaggagaagagagaggatgaagaggaaaagggaatggaataggaggaggataaaagagaggaagagagaggaggaaggagaagaggagacagtggctcaagcttaccctacttgttcctttctctactaacctattcagacaataatcttttcatttccatgtctgatgggcaagtcagtgactactggacagagtttgggtctctgttttggaggttctggattacacagaccaaatgtgtttagcagggaaaagatgaaggggagcccagcagtattaggggaaagtggagagacagttcacattacttggactgtaggatatgtctatcaacagacatgacccttcaggcggaggtgctctcatgggttctggaaggcagttgtaattataatgtttttcttacagccttattaccctacaatttaatagcaaaaaatgaaggtggtttgagaatagattggtttggatagcatttgggtggattaagcaaagcattgtcaagaggtgtaggtaaaaacaagacccaaatataaaatggttcatctctggtgagctatggccttccttcatattcatggaacagagacttctatgaagagcgttactgtttgtgtaggacctaccacaagtagattggttctaagtcttagctttcatagcagaatttacgtgcactttaaatcatcagcatcatttgttgatgattttctgcttaaaattggtatttacttgctgcttatgtgtattaagatctttttaaaaccagtgagatctgcaaatagtattcctctcactagaggcaagcagatgaatacagtgtaaaaaaactttggatttgggggcaaaataattaggttctaaaagcagctgtagcaatacttagtggtatgactttgggctgctcatttagcttttctgggtttcgcttcccttccatggagaaaggagtcattgcctttgtctacctctctgactttgtctcttcaactttccccatcttgatctgatcttggggccagttggcttcctttcattcctcaaatagatcacacttgcatctgtctgagggcctttgcgcttggaattcccactgcttataatgcatttcacgtagttggctcctttctgtcatttgaatctcagctcagatgtcctcttgttagcaagggattccctgtcttatctgaaagacctctcctcctgttccccagcaccatcattttctcttgtgtcacctattcgattgtcttactggcacttgtcatgatttgaaaccatctcacttactcatgggtgacatttgatgccagcctcctttactagcatatgaggtgcatgagcagggactttctctgtcttgtttattgccataaccccagtgccctggaaagtgcctggcactcaataaccctttgctgaatgaatggaaggttggcaggatggactggagaggactgaaggctttatgcctcatggaaattgcaggacgcctctcagctataaatggcaaagtacaaataaggagaaaggaagaatatccccaaatagtggcatatcagaaaggacgctgatattcccacttccttgcaagctccagctcgctctaaacctccagtgcgctgttttccttcttttctcgtctttgaccagaagtaagaaggctgaatagaagtgcagtgagggtggatgggtggactgatctagcctgctgaagatatggtcagtgtccaataaataatttggctcatattagctattggagtgtggctatttttaggcactttaatccacttaagaaagaagcaaagctctaggagtggaggtggatttttttttaaatgctacacttttagtgcacactttaatgcaaaattctggagaagcccataccttatgtgcatagcacctttcagtttacagaacactttttaggaatgatctcatttgtactttaaaaaaccctatttttgtagggattagagtcttagatttactgacaaataaagcaagatgtagaaaggataaatgatttatgtgggagcccaaagcaacaaacaggcagagctggggctaccctaggccttttgatgcttacgtccatgacagtttccttcaagctttccttcctcccagcgactttgttcattccacactctcctgctctttgttacccaaaagtgtgttcaaaggtttctctgagagatttagaggaagcagtctccctgttgatcagtgaatctttagttgatggctattttcagcaggttgtgcttattgtacaggtctacactttcattctatgagctcaggtgaagacccttagatcttccttctgctgtactggctaaaagaagattttggtcttttgtgaatgggggccattttcaacttgctaggttgcttaagtgctagctttattaacgtgtttccaaacacacatttgtggagcttagatttcctggaaagaaaataatctatttttgatttaatatccaattttcaggagatcagtgttccaaatgggatttaaaatgtgccaaaatcaccacaattatcctcaaaagtaccaaggaacagtgttccaaagactgtcttggccaagatttggttcaggcttcttttccagcagtgtctaaggagcttcaccatcctttttgctaatcccagtgatcactgggttgaattaagactgagcaggttgactttgctgttccacaccatttccaaaacatctgtactttggctccatatgaaccccaccttaaatctgatgcatttaaaaaatataatatagtctttcccctcattaggaaacttcaaccacaactgagatatggtgtgaagtatatttaatataggcacagtgagctagtgatttccttttgacttttagtctacaggaaattagaggaagagtttaatgataaaatggaaagaagccattctactgatagccagttaggaagtttcagtttggacagctcccttggctgatgcagaaaggtggataaaaatgacaatctttttcagtactctgattcttataaagggcacctactggatgatccagatgaggttagagtgagttaggggcttagctctgcatggcatgtttacagaatctacctaaccatggcactaggagtgtggtcaccctgttggttccacccacctgggtgatttctctccataagaatcatggaggtcaaagggaccttccacttctggggtctggtcctaggggtactctcagcggagactttacagtttatctatgtctggctcattaccatcacctacaatggggaaataaagacctcatatttacttgctagaacatctatttgtcatttgcagccacagtttaagagttttttttttctccctgtgagtgtctaggactgagtactctgaattgaaaatgaaacctgacttcctaatcctccatttagggttgaagggagggagtaagggtcataatcactggcaggggagggcacggtcatgagggagcattgcattcttttcctttgccattcccagagccagggagatggggaggggtgggcattggaggtagtggggatgaggctgggagatggatgggatttcaggagattttaggttttgtattaccaataactgctagtctcatcacttaccctttccatggaagtaactttgaagcagagtggaatggtggggaaacaagattagaaaggaaaacataggatttactgccatacataagccaggtgatcacagggaacttttccttcattcctcccgtccttcttttcttcattcccttgttccctccccaccgccatccccccaaatcctgcagagtcttgatctcaattgctctcgcttgtgcaaagggtcctttctcccttactcaactacccagtgtggtggggctggtggtatttacagtttaaaaagagttgcttgaatagaaaatgaaaatttggtcgggtgatggagagcctggaagtcacggtaacctttgcagacgcctaaaacaccaatattcataattttgacatgcaagctagcaacaattttactaccaagaaaatgagtttcttatgtgcaagcagaactcgagatcccctaaataatcacacaccaaatatttagcatgataaagataaatagtatagcttactaaatttaatgtgatatgagcctgacaggcagaatagagatgcttgatattaggtgtgataaaaggtttgacatccaacattcacttacttcgtcctctgagacaaaagtcaggcaccaagtgtttaagaaaaattgatgggaggaaaagcttagagatgaataaagtctatttattaatttatattttcctctgagaactggggagtgttgttacccatgttaactgtggactaacctgggccagctcctggattctactggctaagaatgttgctttaggccaaaggaatttatccctcatggtggaatttgaggccatatgggaggtgattatgatagatctgtttcggcctctacattcttacaataacctgaaaggagattaaatacatgttatagtcatttaacctagactccaggcaaaatgtcaccctctgtacagtataggagcttaggataggagacctggtttctagggctggcgctgccactcatttagaaaaggagggagttgagttgttggttgttgagatcccttccttccctgatagtcttagattgcctgagtcctaatccaagcatgatttactagaggctgatttgggaacattgcttcatttttctgtgacttggtatcttcatctgcaagatagggataattacagccattacttctttggtttgttatgtggattacataaagtgatacatgcaaagctcttagaagaatgccggatcatcatgaaggctccatgagtggtacctgccttgtgctgttctcacagttgcaggaggcagcctgtgaagtcagggtagcctccagctcagcctcttggaagcatctggttcactgtctggatcatccaggaagtggtccatagcagagcacaaccctcctgatactctggaagactcttagtattcttagttcagatttaaacaacctaggctgtcctggttaactcagagaaaagaccagtgaaagaacatggcttggaatcacaatatttgagtctgagttaatgtacccattttattagcagtgtatcatagttgatttcggctgctttaataaaattccataaactagatagattatagacaacagaaatttatttctcactgttctggaggctgggaggtccaagatcaaggcactggtagatttggcatctggtgagggcccacttttcagctcatagatggtgccttcttgctgtgtccttacacggtagaaaaagtgatgggtctttcttgggcttctttgataagtgcactaatcctaatcatgaaggctccatgcccatgacctaattaccttccaaaggccccatctcctaataacattacctttggggttaggatttcaacatatgaattctggggggacacattcagaccataacactgtgtgaacttggccaagtcacctaacctttcctagcattagttttcttttgggtaaaataaagatcacaataacaaccacttcacagttgctgagatgatcaaatgagacaaatgtgaataaacttcataaactgttaaattccagaccaacatttcccaaaatgtgttctgtgagacataagctagactcatcagatactctgagaagaaaagtggtgtcatggtaaagtcagtttgcaggatgatacgtgctcagtcattcctagagagtcatcatgcacgttagcatgttactgtattattgtgtaacaaataaccccaacatttagtggcttaaatcaatataaacatttattatctcataagttctgtggatcaataattcagggatagtttaattgggtggtctgactaggagtctgtcattgattgtggtcagatgttgtccgggctgctgtcatctgatggcttgactggggcaggaggatctgtttccaagctggtgtgctcatgtgacttgcaaattgctgctggttgttggggagagggctcatttcctgccaatgtgggcctgtccatgggatgcttatgtgtactcatatgtgacatggtggctggcttccccaagaacaagtgattcaagagagaacaaggtggaattggcaacactttttatgacttaacttcaaaaatcacatattgttaccaccaccacgttcttttcattagacgccagtcactaaagttagtccacatctggggagtggtgggggtgatcacattcacgttggaagggagacatgtcaaagaatttgaagacatattgaaaaatcaccgtaagaattttttcctatcatttattgaataggcaccacgtgctaggctaaatgctttgtagttattatctcatataatcctattcataatccaaagaaataggtgaaattattatctctgctttctgaatgaggaggctgaggcctatagagcttaagtaacttgcccaaagttacctagtcatgctacgacttgaacccgagtctgtctgatttaaagcctgaactcttacctctgcctcatatgcctctctctgataatcctgtagttcagaagtctgtttaattttgtttaagcctgcattttctacttaaccacagaatgatgattcatttaactccatttttaccctttcatttaccaacggcttgaaacattattctagaaagacagtgagcatgatgatgatttatgtataatatgaacatatggtctcataatagatcccagcatacctatcagtccaaactttttgtattattcaaatactggaagtgtctattttgcctgtcttgtgtgggcaccatctatgtgtaaatctgtaaacattaatttaaaaaaaagaccccataatccaccctattttttctgactgtgaaactagaggtggggtgtgataactcatggtcccacttctcttacagagtccctttctttgcaatgtcccttcttttacagattcagtgactgacaacttaactttcttgggtaaagccagaaaaaacaggatggcctccaggccgagcagtagaaatgctggggaatggggtgtctggtgtgtgtctggtgtgttcctgcagtgcctgcaggccatgtgtctgtatggtgactgaaacgcaagtcggcatccagccaggatggcagggaccgtgtgcctgggggtgacggcaaacacacagtgagaagctgctgatggagggaggaccgttagcactccttgtcatattttgagtaaacatttttttacaatcttgttgctttttctgtacagtcttgagaaaatgatttccaggaagcaggatgcatccaatgacttagaggttcccatgtttccaaacattacatgcctggcttattcctgaggcagttttgtattctgaaggaagttttggagcttctgtgttctgggcagaggcgagtgaatatggtttcttttgagtagcaccgtggacttgagaatgatcaggagctggacattgttgaatatgtcacttactgcacaaaatggcaaagacagggtctgggacagggtgagagtgtgttgaatggagatgcctggggccccagtcacattcaggagccagcactgatggcatctgtaaccatagtaaccaagagtggaaaaagtctcaggatgccaagacgccactgtgccccccttctggttctgttgttttcccctctattctttcatccagaaattcccccatccctgcccccaaccaccctgacaagggactgactttcagggtggtttctacactggtgattttaacttcctactaactcaacacttcctgtagcccctttttcagttctgagatccacaaggattcattatgatccagactaagcctcatgcacctaatttcttccgcttttccatttttactgtgaaaattggtcctaagtcctgtagtatacatactctagacttatttacagctgggcataacaacggtggctcatggcactcaaagtttccagtaacactcctgcactcacagtctggtatagatcatgagatttttttagatgtgttttaaatgaacagagaaaggcaatgaggcacaggaaagagagccgtggtctcttgtttggagatgtgggttttgctactggttggaaagtgaggtgtggcatggcgcatgagggtggggagaggtgggtgatgctcaggtcatgtagggcatagtaggtcttacttactaaggaactctttttttctgagaataacaggaatgtcttgattgatttgaagtgggaggatgacacaatcagatttttaaaagattatttaaatcgctaataaatcaaatgatgggttcagcgaatgtttgcagaggatacttactgtgtgacaggcatagtgctggccttacctggggtatctgtgtattcttgtaggaatcctacataaaagctgttaaaatattttaacagaaaaaagcttttcttgacatctttgaattatgacaaccaattccaaacttctggttgcaaatgggaggtgtatcttaaagcaatggcgattgcattttcaatttctgttcattaaaatgatattttccctggctttgttacatgacccttgattctgtgataatttgcatatctagagtcgatgaatcaatacatgcaaaactgtggtgcgctcgctcatattctgttatacttcagacgccttttggaagcatgtggctctcagttcagcataatgctcctgataaaattgccccctccatacccgctgtcactttgttcctggtgtgtccagaggtattgtaacattggggtatttctcctttgactctaatgggaccccctgctagttgtgttcttgtggcctcagcttggaaggcctcccaaaagcctgaattaatgaaagcttctgatgtgccgatccctttctctggcagggtgagaacgcagtttctataggagcgtgaatgcctgctgctcaggcaataatctctgcattcagcctcagtactaaagacaggcagagcagacagccacagggggtgggatttgaggagccctataaagtccctctccacagctgacacacaccactccttcccatgactatcaggatgcctacaatcttaacagttactttattcattggctgttgtcactcatccatctggttattccataaacacttagcgagtgagtgcctgcagaaatggggctaggcattggacacagaaagatgaaaaagacctgaggcgtgtacccagagaagtcacagcctagccactgagacaggtgcatcatcaagtaattatgatataccatgataaatgcatatcatttatatggtatatgatataccatatgatatggtatatgatataccatatgatatggtatatcatataccatatgatatggtatatcatataccatatgatatggtatatcatataccatatcatatggtatatcatataccatatgatatggtatatgagagagatatggattaaaacatcagctccagaacacatcttgttaacatgcgaatgtagttcctcagggtaacaaactaatttccaattacccgtgggtacagccaaattaatagttcctatgagagaactggaccaagagagaacagaactagggactgatatgtattgataggctggtgtcaagtgggaaggggggaagtcaggtgctgtgtagggagcagactgagagctctggagggcaggagtgccaggaaggtcactgaaagcaacttttcatttgtgcaaatgttgtcagaggttgctctgctcatgttaaactcactttataaagtggaaggaacttttaagatatccaagtccattgaggcttcttagggcaatactgaatctagattggtgaagtgacttgtgcttgcccagacagcaaaaagaggacaaagcatatctatgaacccgtaatgctaaccttcattattcaacagtgatgcttatggcaatgccaacgggtgttggggccttttattaatttttaattttagttttttatgtttttgagacaagatcttgatttgtcgcccgagctggagtgcagcggtgcaatcacagctcactgcagcctcgatctcctgggctcaatcaatcctcccacctcagcctcctgagtagctgggactataggcatgtgcccccagacttggcaaatttatgcattttttgtagagacgggattttgccatgttgcccaggctggtctcgaactcctgagctcaagcaatccgcctacctcggcttcccaaagtgctggaattaccggtgtgagccaccgtgccctgcctgcttgagcctttttgctattctccctcctatgggaaaaagaatcgagaaagagcagtaggctctactagagtctggagcatatcggttctgagatttcagattaaattctctatgtctgcagcaagtacaaatgtgagtgtatattcagcctcttgaagaagacatctatccatttcttcagtgaatatttgcccggagtcttcttcgtgacaggcactgttgtaggccctggaggtacagcaataaacaagacgaagtctctgccctcctgaaactaaccgtttagccaaggcttagcatctctcacactcaggtcaacttctgcattttagaaatctgtttcaggcacacatttgacaagtaaagaggttccaaaaatacattaataaggatgaaaatgaggccattctgatattccattgcttggcaaaaatgcttaatatgggaatttaatatggaatgggtgctgatgctgtcaaaggtggtgacattctgttagaaaattcagtgatttcaaagaaggcctcagagctgcctagtttgtaattagatattttgaagaatctgtgttaattaggactctgtggcttgtgcatgtatactgggacgagactggagtttgtgtctctcccatgatgatggcatgtaaattaatctccaaggaattgcaagatgctgaaatgtgaggtacttgagtacacgttgcatgagtgcacacaagtgtgcctgtgccgggatgcgtgtgcacgcgtgcacacacatacactctagcagatagtaactttttgctacacgtgatttccaaagtgtctaaatttacatgtcttttgagtaggaggaaattaggacttttgtctgttatatgccttgcagtctcttggccttctctgggctgctggggcagaatgaggccaacagagaaccacggatgccagtctgggtcacaagggcttaaggaagcagcagatggttggactgactggggtgtccattaagaatccaggggtagtgagagtcttacctggagtttgaggccgcacttccattgccaggactctcagctgagtggctggaagagacctgtaggagccatccttccagtatctatcagaggtttctgcactgttttaagctcgtcctagtgatcgagggaaccttgactgggggtgctgatgattattaacagtggccatactcccacggctgcaggtggagatgaagtgtttgatgagaagatgagcaagagctcaggtgtgccccaccagctctgccactcccaagctgccgaacttaggcactaacttacctctctgtgtctgcttcccaacttgagaaccggaaatgataaaagtacctgctccctagggagtaggtatggttaaatgagacctcttaaatgagaccatgcacacgaagagcagagcacagtgcctggcacacaggaggcacctaataaacatcaatgatgctgctgctggtaacacccatttgctgagggtcttcagtggctcaggcacagtactcagtgcttaacatataatatgtaatttattcttcacagtagcctgagtcacttgcttgttcttctggttaatatcctaatgtttagctcaccgacttagatgctcatgacttccaaaggatcttcatgtaacaaggactccatatctatttttaaaaaataagagctttattaagatataatttacataccataaaattacctatttaaaatgtacaattcagtggtttttagtatattcacagagttgtgcaatcatcatcactatctaattgtagaaaattttcatgactccaaaaagaaactccatatccattagcagtcactccccattttatctctcccagtccctggcaagcatgaatttactttctgtctctatggagttgcctattttgggcatttcatgtaaatggcatcatacaacaggtagatatttgtgtgtgtgtgtgtgtgtgtgtgtgtgtgtgatcagcttctttcacgtaacataatgctttcaaggttcactcatgtggcatccatacctattttgaatgaagaatgaagacagtcatctgagacagttgtattagtccatttggaagatgaggaaactgaggctgagagtgtgtatgtaatttgctcatggccacccatcttgaaagcgcttgagctgggatttgtgctcaggtccatcttggctccaaggcaagaccttggccttctcatccactcactggtctctggttggacctctgcatcatgctgaacaccatttctatagagatgggtgtgtcccactgggtgtggacatcctgaggaattgctgtggttgcaagaactctgatattttccatctaccttgagggggatatggtttcatgtctgtatactcacatagtgttgaccagtctaattcttttgtccatttcctaagggttatgatatgaacttggaaagttacagaaatgaaagtgataggagagatatactttctgggttggaaacccagcaaccagtcactcaatatgatggaggaaatgtcatccttcttgtgttgtcttcaataatagattgtaatgaaacactatggtgtcttagttggctcccctcctgccccatgccccctcccccagccccagtgcttttctggagacatgagatggtgtatcccttcctcagttgctgtgatagcagtggggatgatggggacaggtattcatggaaggaaaaggcgtggtaccagcaggctcttgggcagggatgtgtgtcttcacttgatcatcagggaatgagctatcatgatgacagagcacatcctatgaagtacaaatcttcccccacatttccccaaaattacttttgtcctgctctgttctctcacatgctattctagggaaaaggtcccattttatcattaaaatgcaaatgagatttccatcttgcttctaccaaagaaggaggaaaataacctatataaacaccatgaaaccttactttgacttaaaactagtggaaattggcccctgaatcagataattagctgaaagtacatgaacaatttaggcctccggtagtggttatgtgcttgttgtataggaatttcgtctaccatggatttcatggaagtggccccattcctgctctgggtttatgtaagactttcagcagcagcccagtctgatgtagcagatgttccagtgcctgtccctatcctcctgctcgcaccacttcagctcatgctggctcacttctgactgccaacttggcattttttttgcctttttcttgactgagcctactttgctgctcccatggaaggcaggaagtgttggggaattagtggaccccaggaggagccctcaaccaataactgatggaagatggtgcgtaaacaccccaattccctcagccttgggtagggtaactcaggaatatggtttacatggggtcccagtttcctctgtaggaaaaattccactgggcgacagcagtagctagttagaaacttcaccttttattggttttcttggctgccttcccagccctttctcttttctctaattccctactggcgatttcttcacttcccaaacaaaccacttgtgctcaaatcgtaattgtaggatcagcttctggggaaacccaaatgaagacatatggtaaagcttccctcttttcttgcctttctgccttttgccccaatcagttagctttgatggtgggagtgaggggatgctcaacctctcaggcaggctaatggctctcaggagacacaatccacagctgattggcagttttctccccaagatatcttcagaacaaaccctggtgctggtgagtgatccatgcagcatgaaaagagagggtgaagcttgatgaggcatgttccagtctcatcaaactattttgtttccataattttccttctcagaaaagggcagaatcaagtacagttgattctcatcatttatggtaattcttgtgttttataaagttgctgtaaatcctgaattagcaaatagtgaaccgttgcttttaggggaaatatacggttaggttcctgtgagcctctagtcacaacattttcttcttcttcttcttcttttttttttcgagcttagggtcttgttctatcacccaggtgggagtgcagtggcgcgatcttggctcactgcaacctccacatcccaggttcaagcgattctcccacttcagcctaccgagtagctgggactacaggcatgcaccaccatatccggctaacttttgtattttttggtagaggtggggtttcaccacattggccaggcttgtctcaaactcctgacgtcaggtgatctgcctgcctcggcctcccaaagtgctaggattataggcatgagccatcacacctggtcaggtcacattttcatcaactaaatacataaccttgttgtatgtgtgtttctgtttaaagacatcttatttcatatatactgttgatttgttagcattgaactcacagccacagcactgtgactcatttctgaacaaagttatctaacacacatattttctccataaggcacctcgcatcttgcacttaggaacactggatagcacttcagcattgcacttgggggtgattttaaacagtgcaaacactaacaaaaaagcacaaaatgtgaaaaacatggcactaaatagatcacagaatggacactagcttacagcatgagcgctcgaacaagaaggcagagcgctgccttgttcaacctcagctgaggacatgtgcatcgggtgactcaaacttttttcactgctgtgtgcatgactgcgaatgactgcagaacaccatgaatattgatttgatttcggggttacaaataaattttaacacgtagaagaatttgcaaatatatattcagtgaataatgagggtcagttgtctttcttacttcattacaataagactctacttcaattcagtatttttatttcattttattttgtttttgagagatagggtcttgctctgtcacccaggctggagtgcagtggtgtgatcctagctcactgcagcctcaaactcctgggctcaagtgatcctcccgccccagcctcccaaatagctaggactacaggaacatgccaccacacctggctaatttatttatttttttgtggagacggcctccctatgttgcccaggctggtctccaactcctgttttcaagccatcccccttctcactctcccaaagtacaatttagtatatttattaaacgtgtgttccaggctttttgattgctattgagatgctaatgagatggtccctgtcattaaagagcgtccattctggtggcacaaggaactcaaattatgacacaagacagaatacctactccagaagagagttctgtgaaagcgtgaaggagggacttgagtgtgcgattcaggaaggacttcacattggagggagtttttttagataggtcttgagaaacattttacattttgaacacctcatacatcattgataaaaaaaagaagcaattggtcgaaacaacttcatttccccagatcaagtcttctaggttacctgcatctgcacccaccagtcccaccttgattcctctctagatgaagggcgtcttttcctacctaaggccgtcccttctgcttatgctggggactcctttgctctttggggcatcctctcttctcctggggaattgatctctccctctctacttgaatattcctactagtgtatacatgggcttccgtgtcatcccccttgatcccgcattgccgccagccacccctcattcctttaggcctttcacagcaaaattgctggaaagggtggtctgaagtcaccatcactacttcctcccctcacattctttccaagccaccaccactttatgggggctgctcctttggaggccacttatggacattgcatcacctttctgtccttttatcttaagtaccagttaggatgctttcagctgcctgttgcagaatgtcctgatacaagtgacttacacaatacggacattgactgttaagagagttacgttctcactgaacaaggatgttccaggcttggcttgggtgtttcataacaccttcaaggacccagacttcagtttcctgccctgcctctcttgatcacatcagcagatattatgtcgtctaaaaacagggaagggagtgaagtagcctctgtgtttttctttttatcatggaggatgttttttttgccctgcaagccccatgcacatttcttaaatatcacccccctaaactcatccctggcaaagggggatggtattatccttattggcttggaccaattaagattcatcccctgagtctgtgaatgggacgcatcttctttgaaatgttgtcatttaaccaaaattggatctgttaaaggaagggggagcgcctaaggtgaaagtgccaggcagtgtctgccacattttccctgacccttcctagcaattttgacagccagccaccccatccttcttgaagcacttcatttccatcacatgctttgtgacatcatttcctctgggttttatttatttatttatttttttatttatttgagacaaaatctctctctgttgcccaggctggagtgcagtggcacgatctcaattcactgcaacctctgcctcccgggttcaagtgattttcctgcctcagcctcccaagtagctgggataacaggcatgtgccaccacacctagctaatttttgtatttttagtagagacagggtttcaccatgttggccagactggtcttgaactcctgacctcaggtgatccacccgcctcggcctcccaaagtgctgggattacagtcataagccaccgcgcctggccgctctgggttttcttttaacttttctggccactcctgtttcctgttgactcctttctcattgctctacctctaattggtggaatgcccaaatagttagacctgaggtccttcttgtcaggatctgtaggttctcctgagtgatctcagcagtccctttgtatcatctatatgccgagtatatcctaaacttgcttctctcaagagtttgtcatctcattgaatgagtttcccatctcattgatgggcaccgccatctatctgtatagttgcttaaagtacgggcatgttgcatgagtcctctgtttcccacccctgccattttgttctccactcaccagcaagtcctgcctgatacgatatctagaacacatccagaatctgtttgtttctctccatttctgctcctgccaccctcattccacgcatcttcctgtgtggagagctgacagcctttttatcggcctcctttcttctacccttgctcccaataattgatcctccgtggaacagccacaatgatcttttaaaaatatgaatctgatttctcttgacccgcagcttaaaattctctatcggttcctctttccactcggcataaaatctgctttctggtgctggcctgcagcaccctgagtgctggctgtgctgacctcctttccaaggctggtcttgagccgtcttcctctaacctatgctgcacttctttctgctttccttgaataaaacaagctcctcctgatctgagggcctttacgggacctctttttttttttttctcctaggattatcttctgcccaattttcataggactggcttctcctcgcctctgaaatctcagtccaaatgtcatgtcctccaagaatctttctctaaccgcccactcctgctgggcaccctctgttgtagcatactgttaggagtctctgcatcatgcctctaactctttgaaaaaaagttctatttgttagtttaataaactaaaactaaaaaatttataaaccaaatttcaaaattttaaaaattaataaactaaaaacagtacaatgatatctctgtgaagtcaagggaggagagagttttaagaaggggaacttaattagcagcactaaaggctctacaacgactcaagataatgataatgatgatgatgatgatggtgataatgacagtgataactaacatttattgttactatgaacctggaagagtgccaggcattttgcgtacattatcatatttaattctgacagattaaaagtcctgacaatgcctctactgtcaaggaatgttattctcattctcagaacactgagacttagggaggtcagtcaaagtgcctggcacatggtagctttcgattaatgtttgctatgtgagtaaataaatttccacaaggtcctggagctggtgaatggtagagttgagagtctaacttagatctgactgaatccaaagtccgtatttgtaaccactggtctatatttgctcagatgaagacagagaaccccttaacagattgagaaaaggaagcctaatataggataaatgatttcttatttatttaaaacatatgataaataaaactaattttcagtccaaaaccttctgaattttggaattctggactccattcattcaattcatttgaaggcataggtgagttctttaaaagaagcattaggaatgaatccagattgaacaattttcttattaaaataccctaaagatgcattcttatgatgagccaggttcattgtccaggaaagctattaaaactcagtctttgtgatgagtgcagtaagaaccccacttgaattacgtagtgagcaggtgcttcctaaaccaagtttcatgtttgacaagctaggagagaacccagtgttaaatgttttctggcatgttggcctttggtttctcatattatgggacatatgtttagtgcttgtggtatatgcttagcctactcttgtaggatgactgagacctcacacaacatcaaggacatagtctttgcctttgctgagttcagagtgtaattggagtgatgaaacatacatgtgaataaatgcaaagtcacaagtaaagacagttaatgtgattgatgaaggacgtgtggcacaagatggataagaatgagaagtagaagaagtaggtggttttgaactttcgttactcagggaagggaatgtatgtggattggtggagaagagaggggaggaagatggttttaagcactggtaagatggtgcatatttgcaagttttgctcaagggatagaaagggctgagacccagtggggaggaatcagaggggaatcggcaaagagaattagggaaatgagaactgtcagtagaggaagtgagattaggctggccgggagctatttggggtttctgagtactgatgttacatgaaggaatatttgtgagggataaatattgcagtgggtgcatttgagagcaaaaccagattcaggcccagttagggaagggtttcttaaacgtcggcctttcctatgccatcttcactttttaattttttggtggccatatttagatatcagctgtgtcactatatacttaatattttctgtaagttgatttcacttttaaaaacttaaatttagctttgccctatgcaataaacttatcattgtttactgaatgcttttctttaaatttaaccccttaaatcttaaataaatgtagccttaccccaagcactagtacctatgaaatcataggtattctgtgctagttctatttttccaaatgcacagtaaattaaacctgcggccattaaaaaaatgttgcatatgtgtgttacctaatgctgtcttgtgtacctatggttcatgtgctacacttttgggaatacccaaggcactgttacagctttctaactgtgacatgatgaaactgaataaataggagccagctacatttattagatacttactgtgtgcaagcccttgtgatggaggagatgaacatatgatgcagtccttactcttaatagatttggagcaaagcagagagagaatggcacaccaatgagaaagtgagatgtaggcctgacaggtccaatctctgccatgtaaagcagcttttagataagccatctgatatcagctctgccactggtcagctgagtgagctgccactctggaacccaagggtaagctctcctcaaattcagttcacttcaacaagtatttgccagatactatatgacacttttgcagatattaaggaaattaaagtgtcttagggagtgttaaaccagaaaccaaagtatgaagtgggagacagagtggaataaggactgtaagagagatgcaatgacatgtattcggtacttacgggaggaagagtttatagccagctttggggaccagggaaggcttcctagaagatgtgtcatttcagatgaactttaaaagatgggatcatacaaaaggcagtgatggagggtgttcagcagagggaagggcatcatcatgacaacagagagggaaactgaggcacctgtgaggagaagagcaagtctccgttgtttggtggtgatgttgggggcatgaaggtggaaaggaaggttggggtcttatggataccttacatgctaggttgaacatggatttattttcacagatgatcaggagccatggaaggctacactagctgggcgtacataatttaagtcagagggacaaataactgcaagctaaatactcttagggagaaactgcagcaatctgggtgagaaacaatgaatttgtgagtagtcaccatagcaaaggtctgggctaggggggcactggaggagtgaaaaagaaaggtttaaatagtcactgagagggctgaggacccactagccactggcatagtggagtcaatcatttctccgaaattacgaggaggagaggtggggcatctctaaggcgtggagcagtggaggatggtgattgtatggtaggggaaagaagataatgatcgcagttccagtaggtgatggatgaggaggggaaggcgttttacagattattcactgggaaagaacagaggcagtccacactgtagttaattccttttatttttgtctttaagtatactcaaggataaatagccatacaatttctgtttggcttttcatgctggagaggtgcagaggttgcactgaacgtggacgatattaattttgacttgtacaagggtactgtgtcctgggaactggccaataatattctatgaaaagtcatttgagtaactcatttttatacataaaataggtagttccttttcaatttccttatattttgggatacttacatgccaggattcctctatttcaatctcttgttttctacctgaaaagatcttacggttggtggctgtggatgcaattctgcctttacacagaaatgactctcctgggcatacctttaggcaaagagcagatgaacgcataacgagcagctttgagatttggtattcccactgcagaacgaagagaagggtggcccactggaaatttcctcagagaaacgtctaagtctgcatctcccacatccattcattttcatgcatagttctttcatctgttgttttttaatttatctattttatataatgtctatctctgtagtacctgggatgaaatgcgccaatcctgactgcaatgaatagggcaaagcaattcttgggagctgctctgggcaggaagtggaggctgaattcttttaaaggaaaattttttggggatcgtgactcactggccttcatccccatcatcactgggattggttaagtgccaggaaacagctggaagtcgacagacaatttagggtacaaatgaaaggagaagttactgttaaagggatctgtattctctgttatcaaaaccaccaacgctgtctcctagctaataggaaccaaaactgtgccctgagaatgctgccagatgtttctcaataggcacgttacgttttatggtcctggatgctgcacttaaaaatagtgtccaatttcaaactcactattaagtagacactaaacttttggaatctattaatggatctagatctccaacctagtggcaacaaatgtttgaagtgaagtttattgttttaagtgaattttaaatgtgaaatgatgagtatttaacttcaatttttttgcatgatttttccactgtggcaactttccttttaaaatgatagaacctcattataatgtggctgataggaaatctgtttattcatgcatatatttattcatttacaaatatttatttactacctaccaggctctgtgcagtactccgataaactggaacaagagccatattttgtactttgtatgtttctccaagagaaatgttctattgtactacattaattcttagatgcatttttgaattatttacccttctgaaatcagaatgtgtcttactagcaatatgtcataatttaattggcaatttaaattttcaagaggcacataagataatgatgtgttttgtaattgacaatgtcttgatttgatagaagatatttgtacaatactatattggtaccatgctttggccgatgtaatggtcctatttggagttcactactaatgttaagcctctagttttaggcgttgatgttggtccagggacactaggactcaaatgcccagatgtccaggtctaagagagaagaatcagaaggtgaatgcagagcccagtgggttcaagccatgtagacaataatagcagaatggagagacattttccgatgcctcatgtctatgcatcttctctccctttctggcctgccacataaattcattgcagtgcaactctgccagatatcagaatagagcaggaggaaagagaaacagctgcagcatgggagataggactcataccaagagagattaggctcggtgtgtatacctaatgatggtaaagtgaacaaccaggttacagtgatagcagcaacacgcatttatcgagtgtcctatccacttcagaaacactatttttaaatgataacaattctacaagataagtattcattgatcatcaatattatccttgtttcatgtgtaaaactggggctcagagagggtaaaaaacttgtccaaggtcatacagttaggaaatggtagaaccaggattcaggctttgctccatggggcatcaaggtctgctccacttccagtgtgccatgcagtttccccaaatctgagaacatgcatttactttatgtccggttatgtgaggtctcagaagccagacagggccagagtatgaagagttacataaaagagcttcagaatctaatagggttcctgagcaagattctaccaatacctggaataacttcctctgtgtatagcccaggtgcatggactagaccagattgggaggggatggttgcccagcaggcccagagaaggagctggtagcatggtgagttaagggctgaggatcaagaatttgttagtttaattagaccccccaaagagcagaagtgctgttgtagttaagactctggaactcagtgataggatattttaataaagcccatgatctcaagaggaacttgctgaatggatgagctcacagtccatagttgggagctaatgaacaactttaattatgtttctgatactagtggaggtgttctcctgtcaatgaattccttttagattttgaccccatgtagatctcaaggaaataaataaataaataaattagttaattaatttatttattttgagatggagtctagctctgtcgctcatgctggagtacaatggcacgatcccggcccactgcaacctctgcctccctggttcaagcaattctcctgcctcagcctcccgagtagctgggactacaggtgcccgccaccacgcctggctagtttttgtatttttagtagagatggggtttcaccatgttggccaggctggtctcaaactcctgacctcaggtgatctgcctgcctcggcctcccaaaatgctgggattataggtgagccaccatctcaaggaaatttaaaatgtttgggtttgctactgaagagccaagaagaattttgcaaattatgagaaagagcccaagctttcaaatgtccaaggtggctattcatatctgggaactaggaagaattccaagttgttcacctatgcctgtttctaatgccttcccacaagggtgacagagcaaagttgatttctattaatttaggggaaataatctccactgaatggccagaacaataacctttctaatgacacacagaacaacgctactgtcacccttgtcacggctgtacttgtcatcataggtatttattaggtacttaaatacttgtttggctcaagatagctcacaaagagggtcataaagtctcgttttctgtcttttagagtttccagtataagaacaaatagatgagcaaacacatataagaaatacattgaagagaattagaatattcatgaatgtacagtgagaaattcttaacctatacagggtcatagttgacttcatttaaatattttctaagggtagaacgcaacattattagaatacctgagaggggaaggttgggaccgtgcccttgaagtagcatattaaatttaagagaggaaagagaaagctggcaatatttcaagtctggaactgatccttaaggcaatactttgctgctggaatttgtattttaaagaccagccagaatctcttgtggtcctttgcccatgtagccctatgaggacgtttgtatatttggattgcttgaggcctgagtgtcatgggcataggcagagtcattggatcaacccatgtatctgttgcttgacacattgctctggatacattgtacccaagaaatcagcccaagtgggatccagcccaaaagagaattgttgattttcaaaactgaacagtccaggcaaagctcaatctagggctcagatcatgcatccaggactgcatagttcttcatttcttgattcgtcttctttgcattgctctattcttaggcaagttccatcttggaaatcctaaggtggctgccgaaggctgcagaccctcctctgtcttccagatttacatccttcaggagagcgaaagctcagttccctaaggctgaaacaaaagtcttgcaatggcatctttttggtcctgattggcctgtctagggtcagatactcattctttaattatcatggtggtgattgggggaatcgaatgtgctaattggctttgcctgggttgtgtgcttcactcatggaacctaagagagaagcccagtgaagcccaactcaagggctgagagtgggctgtagtggtttccctaaacaaaatcggtactgttgacataatatggcatggtcatggatgctgagagaatgatgtagagaaagggtggatgagaatggaagcaggactaggcacagtggttcacacttgtaacttcagctacttgggaggctgaggcaggaggatcgcttgtggccaggagttagtgaccagcctgagcaacatagtgagaccctatctctaaaaaaatttatttttaaattagccaagtgtggtggtgcatgcctatagtcccagctgcttgggagactgaggtaggaggatcgcttcagcccaggagttcaaagttacggtgagctatgattgcaccactgcacactagcctgggtaaacagagcaagactctgtccataaaaaagaagaaggaggaggagaaggaggctaagaagaaaggaagtgggtatgctagtttggaggtattgaagtccaggcaaagaatcatggtggcttggacaagcagagtgactgctgagatggagagtggtggatgggtttgatttctagtttggagatggaatccacagcatttgctgatgaaatacatgttgaagatggtaaggaaaataattaaaaatgattcctaggcttgtggactgagtaacttgggaggatggtggtagcatttcttgagataggtaagaatggagggtttttattattttaaaatcaactatgctattctagctctgtgggatttgagaagcctgttaatatctgagtgggaatgtcaattggacagttggagacaggagtctggaatttagagggtagagctggaaatatatattcatggatatatgaatccataatgagaaggggtggctatagcagtttttatttttacttttaaagccatttaactagtttattaaattggcgggccttcttgagagtacaaaccataaatcacttcatttatcttcaactcctaccttcactcttgccctgtgaggccaaccctggatgatacaccagaaatacctcacagcttttccaggcactttaaaaatcaaatcaagtaaaatagaaataaaaattgtactttttttttcagatattcaaaagtccagttttacatgaatcaaaacatcaacctctcatccaattcaaagctctctttcagccgggtgaggtagcttgtgcctgtaatcccagcacttatgggaggccgaggcaggccatcgcttgagcccaggagcttgagaccagcctggtgaaaccctgtctctactgaaaatacaaaaactagctgggcgtggtggtgtgtgcctgtagtcccagctactcgggaggctgaggcacaagagtcgcttgaacaagtggggagggctttgcagtgagcagagatcgtgccactgcaccccagcctgggtgacagagccagtccctgtccaaaacaaaaccaaacaaaaaaacctgtaatcccagcactctgggaggccgaggtgggtacatcacctcaggtcggcagttcaagacctgcctggccaaaatggtaaaaccccgtctctactgaaaatacaaaaaattggctgggcattgtggcgggtgcctataatcccagatactcaggatgctgaggcaggagaatcgcttgaacccgggaggcagagtttatattgagccgagatcgcgccattgcactccagcctgggtgacagagggagactccatctcaaacaacaacagcaacaacaacaaaacaaaatcacaaagctctcctttccctgtaggccaggcctggcctgagacactgcagatcagccatgggaaagggaaggcgggggccgtggctgttccttttccctccttgtgcacactcctttcctgctggctttgctgcttttggctccaccacagtcaaggggcagggagaaggtgactagaaagcaagggtgttttacttagctggtgcttcttatggttctttctagtcatgaaatagtctctgtcttgcaggtgtccagcttttgtgagttcttggccaccctgtgaagacccccagactttcctctacagacatggatgatgccctccctggctggtctcttatgacacccccggcctctcagcttctgccttgagtgtaccctgaactttttttctcaagtggatggacttcttggggaaggcttttttctgaaggctttgatgtagcttctgaccccatccagtgcctacttggcccaggagaaaccattaggcatctttgtgctgccatatatggggaaagcacgtgactccactgttgcctaccctcctcagcctgcattacaggccaaacactgcgcacccatgtctgattttcccagggccgtctcattgcacacctccagagggcatcattcacatgtgttctcctagaattgcacagttaatgtggcagccctgagttcagacaaatctctcatgcccctacctgtagcagtgcattctatgaagtatgcagttcagcaggcacccagctggggttccagatgctgagacccccttctgccaacccctctgatctctgagcagttctctttctgctccttcatttgccatagtgctgcaatgctatgtgttcttttctgctaagaaatgctttttctccagcgaattctcttatatggcttagagatcatatgcaagctctgcattgatggatcctcagtcttcagttttgagagatctcagtataaaccccaagacaacaggaaagggctcacttaacattgccttgtaacagagaaaccctctctttgaatgaaagctgtcagggaagctcagtatataaagcaggtgacatggtgctccattggggtggtggggaacgaggggcggggtgctcaaggctggcttctgtgcacagttagaaaactcctgtgcctgagaaagccaaccgtggtttccacgaccaggagtttcccactatttacagttctgcagtgtttggcttcttcatgattttctgctggtgaaagcaatagtttgtacaagacgtgtgggaataaaaatagtccaggtgctgcccttttccgcggcagagggaccacctgtcaggctgccctagtgggcctcttcccacagcacggttctgccacttgaatacctccctgcctgtttcctgacgctgacctagaagcttctggtgaatgctttgcttctgcacaacttgcatggtgggtgccttttttttgtgaatgaaaaggtcttcctctggctctgaatatagcaactgcatgacctgcagaaataattttgttgtttccttgtggccatgttagcttagggctttgtaccttatagggacattggcaagaattttctcaaaaggttttcatctgtaaattttcatctttgcacatagtagagagcttagaacgtcagtctcgttccatctgttataagttttgaggctttgggcaaagtacctaacttccctgtgcctcgatttctccatctgtaacactggagcaagagtagaacctccatcctggtctgcggtgaggcttagtgagggcattcatgtgaaatgtacacagtgcctggcacagagcaagcacccagaacatgttactaattgcattagtttcctcttgctgctataacaagttgcacaaactgcatagcttaaaacaacacaagtttatcatatcattctgcatgttagacttcctaagtgggtcatatggggctaaaatcaaggtgtccacagggctgtttccttctgggggctttagggagaatccttcccttgccttttccagcttctaaaggctgctcatgtttcttggctcatggctgcaccactgtaacctttgcatctgtcctcacatgcctcctctctctggccctcccgctcccccttgtgattacactggacccacccagataatccaggatcatctcctgatctcaagatcttaatcacatcagcaaaatccctttgtcgtgtaaagtagtaaagtaatgtgctcacaggttccagggatcaggacatggacatctttgggggaccgaacattatcctgctgatcctaccaattatttaaaaagttgtcctgtaagtatctacagtgtgcctctgctgtgtgctgggcatacaaggtgaataagacacaatgcttatgccaaaatagatacacaagcacgatgcccttagtaataatcacagtagctgacatttactgagtatttactatgtgccaggcattgtgccaggcacttcaagtgaattatcttgctgaaatctcaccatggcactaagggaaaggtataatttccattttaaggataagaacactgaggcttagagagcttaagtattttttctcaaggccacagagctaaggacatgagctcaggtctatctgattctaagcttgaacaattcatcacagcccccttaaaagatgggtgggtttaccctcaggctctcttcttcactgtgtgtgtagctaaagattggccagcttaagaggagcagatcacacaagcagctatgatgagggccagtgggcagagctcccagaggaggctgatgcaacattgctcccattcctgccatcacccaaagctgcaagtccatggccctggcacttgggcaaatgttgccttgtcttcaagtgaatctaaaaaactgtgtaagggcatgattaattccaccaaactggattctccccaagatcacttacaccacactaatggggccctgcttcagcctgaggaactgtgtgaataaaagagaagaagcccagtgagattcttctttcatgattaatagaaaaaccacctggtgactttaaaaggcaaagaaggaggtacattcagatgagtcagaaagaaaaggcagcatttgaatcctaaaggccatgttactcttgatcttctccaggatttcctttagggaaatggaaatttttacatggagggcagaggtggggtgaaggttggactgtagactgagtggtgttataatgagaccaacccgggtgctgggttgaatcatatattctagatgggaagtttatattctaatgagggagacacacagggaatgagcaaatcagtacagaatacaatctcagctagcactaagttgctttgaggaaaatcaagccaggtggtgggctaggaagagactggaggggagaatggcccttctgcagtggggtggtgaggaaggaagtcctcgctgaggaggcagcattgagcactgagagggagctaccctgtaaggccctgggcaagactgttccaggttgagggaacaacacacgtgcagtccctgagactagagctaacttggacaaatgagaagaccagtgtggctgggcggtattgagggacagatggtaggagatgaaggtggagaagtgggccatggccagaatttggggatctaaggacaggagtttggaggttcctcagggagttgtgggaaccctctggaaggttttcagcgtgcagtggagggatcgaatttacattttggcaggcaggttaggacactgttgtgcagaaacaacaatggctaatgggctggttgaggtgggaatgaaagaagtggtggaatgaaatcaggatgtatttggaagggagagttggctggactggctgtgggtgtcagggcagggtggagccatagactactctggattttctgtccaagccctggatgaatagcagtaccatgaattgagatgcacaagcctaggagaagaggcagatttgggatgtgaatgtgtatgagtgaaaacaaaatttctctttgaatcatgttcaatgtgctacttggacaagcagctaattggacaactaagtgtaaaaattaaatagtgaacaatgagtggaacaaaacgttagagctgtacattttgctttagaaggggcatactttttgctttagaacgtgtggcaatctaatacaaatggccaacaaacatatgaaaaaatgctcaacatcactaatgataagggagatgcaaatcaaaaccacaaagcgatactgccttacccctgcaagaatggccataataaaaaaatcaaaaaataatagatgttggcggggatgtggtgaaaagggaacacttctacactgctgctgggaatacaaccactatggaaaacagtgtggagattccttaaagaactaaaagtagaaccaccatttgatccaacaatcccactcctgggtgcatacctagaggaaaagaagtcattatacgaaaaagatactcatacatgcatgtttctagcaacacaattcacaattgcaaaaatatggaaccagcccaaatgcccatcaatcaatgagtggatgaagaaattgtgatacacacacacacacacacacacacacacacacacaccatggaatactattcagccataaaaaggaatgaaatgatggcatctgcagcaacctggatggaattggagaccaacattctaagtgaagtaactcaggaatggaaaaaccaaacattgtgtgttcttacttataagtgggagctaagctatgaggatgcaaaggcatcctcattggactttggggacttggtgaaaagggtgggggcagtgagggataaaagacagcaaattgggtacagtgtacactgctcgggtgatgggtgcaccaaaatttcacaagtcaccactaaagagcttagtcatgtaaccaaacaccacctcttccccaaaaacctacagaaataataataaaaaagaacttgtggcaatctaattgatgataattgatggtagcatccatgttggggaaggaaggaaacaatgccaaacactatgctagctgcttcacatgtattgtttttcacagggtgtaaggcttgagaagcatctagtgtcctgtgtcagattatgcattctggaggcagattgctaaggttcaagtcctggccctgcctgttagtggcatgttctatgctttgcttgcttatctgtaaaatggagtaataataataccttgcttgtaaagttatttttacatttaaatgagttaatgcatgtaaagcacttggaatagtgcctggtattgtaatgaacaataaatgagcaattttaatgttactattttattttctccgtagggtgcacctcaatagatggaagagtagggcatgtgataaggtttggctgtgttctcatccaaatctcattttgaattgtagctcccataattttcacatgttgtgggtgggaccaggtgggaagtaactgaatcatgggggcggttcccccatactgttctcgtggtagtgaataagtctcatgaaatctaatggttttataaggggttttccctttcacttgattctcattctctcttgcctgctgccaagaaagacgtgcctttcaccttctgccataattgtgaggacttcccagccacatggaactgtgagtccattaagcctctttttctttataaattaattacccagtctcaggtatgtctttatcagcagtgtcaaaacagactaatacaatgtgttataacaagagtgttacttcagaatcttgttttaacttgtgtattagtcagtgtgcaggatgcttgggttctgtcctggtttttgccatgtttccattttatgagcagttcctctatcacaatatagatgaatgcctctatcacaatatagatgcagcaataagttgggattgctgcatagccatcccaacttattggcataaaacaagcattttattatgctcagataatgtgcttcagggattcatgcaggacacagaggcgatggtttgtctctattctgcaacgtctggggcctcacctgggaagatgagcctcacctgggaaatctacaggtgtctgtggggttaggggagggggctgaaatcaactggaggtatcttggctcatgtgactggtggttgattctggctcttggctgagatctcagcgtggctgttggctggaacatctgtatgtgatcactgtgtttctccacatgggttagcttgagcttcctcacagtgtggcagctggatcctaagagtgagcatcccaaaagaaccaggcagaagcggtgtggtctttcattatttagctttggaggtcacatagtgtcacttctgctttagtcacaagcctgtccagattcaaggagagggaacataggttcgatgttctcacggggggaatattaaagtcacatagtaaggagtatatgggataggagagattgttgtagctagttttggtaaatacagtcttccaggaggcttaacctgtgggccacttatgagcctgtctggcttaaaggatccagtacacatctaaatttggacatactctaaaatcaggatctcttttatttattaaagaacctgagtaatcttaacctaagttgtattaaaattcaaagattgactccttagaacagctaagctttcgttcatttaatgggcactgattgaatcttgactctgtgcaagatcctgtgctaatggctgtgggagcatattgagatgccacaagaagttggcatgctaaaaggtgaagacaaatacagatggctttcaattaactagtctctggagagacagaggccactcacaacctctaatgatagttaaaataaaacttattcaggccaggcacagtggctcaggcctataatcccagcactttgggaggctgaggtgggcggatcacttgaggtcaggagttctagactaccccggccaacatggcgaaaccccatctctactaaaaatacagaaattaaccaggcatggtggtgcgcgcctgtaatcccagctacttgggaggctgaggcatgagagtcgcttgaatccgggaggcagaggttgcagtgaactaagatggtgccactgcactccagcctgggccacagagtgagactccacctcaaaaacaaacaaacaaacaaacactatttaaaacaagacacaaagtgagtttaatgcaaacttatttagttagcattgcatttaatgttcaggaacacatgttccattttgtagacttcattaattacaactagcagttatttaagtgcttactagagacattgaatattctaagcaccctgtgagtattatgtatttaatttgcacaatacagtgaagcagttactttatcgtacccattttatagatgagagtgaacagtagagaggttctcattttgatggttaatattgtcaacttgattggatttaaggatgcaaagtattgtttctgggtgtgtctgtgagggtgttgtaggggagattaacatttgagccagtggactggagaggaagacccacccttaatctgggtgggcaccatccccttggctgccagcacggctaaaaaaagcaggcagaagaaggtggaatgagcagactcgctgagtcttccagctttcatctttctcccgtgctggatgcttcctgccctccaacatcagactccaagttgtttagcttttggactcttggacttacaccagtggtttgccaggggctctcagacttttggccacagtgcactgtcggcttccctacgtttgagtttttgggacttgggctgtcttctttgctcctcagcttgcagatggcctattgtgggacaccttgtgatcatgtgagtcaatactccttaataaattccctttcatatgtacatctatcctattagttctgtctttctcgagagccctgactaatgcagtcatggaggctggcgtttgtacccagggtctcccagtccccaggtgcatgctcaatgtgacagggctagttagtgcaaagccggcactagaatccaggttctggattttcttcttggtgttctttcctctagacttgaggttttgaattgtgttcctgaatcttttgggtcctaaaaaagtcttgggacctgctgcaggggttgagaagaagcaaagctcatgtgactctaggcccttactccaaagtccaaccaagtagcatgctttgaggtaaattatattgtgttaaacttaatatatgatacatagtataatgcaatacttaatatatatttaatatatttgtaacatacaaaatacaatatccaagagcagtatggaacaccaaaaggtgttcagacttttttttttgagacagtctcgctctgtcaccaggctggagtgtggtggtgcaatctcagctcactgcaacctctgcctccctggttcaagcaattctcctgcctcagcctcctgagtagctgggactacaggtgcccaccaccatgcctggctaatttttttttgtatttttggtagagacggggtttcaccatgttggccaggatggtctcgatctcttgacctcgtgatccacctgccttggcctcccaaagtactgggattacaggcgtgagccccttccttcaaatggaattttatatctgtgtttacattttctgcttaaagtttgaattttgtttaattcaattgaatttccacttaaaatgtaaacttttgaaacccacacctctgacatattccacattgctgttggatatttttagtttaaagatttggcctgtaagctgtatcggtatcattattctaacttcaggctcaaggtctcagtcactagttaaagtcttttctaccggcaaatctgtattaccatctactgtggaagataacctctaaagtgcccatgtaagcacaaatccataaaactaaaagtcaaagaaaaaagagaaagagtttattccactgtttaaaagttcagtttgatttagatcttatatctcttgggttttcttgactgattttttacataaatgtgtcccagaaagagtgatcatatcgtgatctttgttcccagttttccttttccacatcaagttttcctgatggaaagtgatttaaaaaaacccttaaagtgtgataatcactctcttctttagtagacagtggagtttaatagatgcatacagcagttgtttacttgtgatgaaaagaaatgtgaattttctggtgcaaggacatttctagctcatgtctaaattgcagagagaccacagtttgacatagtgctgaagcaggttgtaagaggtaggggtacaatgtatgtctgcacaggttgtgcactatgcgactgtgaatggtgtcttctggaattgtctatgcggaagcactgtcaggaggtcgtggattccagcctctgttgatttttgtgcatgggagagcttgataccaagcctcaaagtactaggaataagaaggtattacatgctgtaattttcaaggtggtgcctttctgtacctccattgcttttagtttagggcatttcttctgcaatctttggagggttcctaggaataaaaaagtagctagtttgagacagtgtgcaattgtgctgaaatggaggaccatgggggtagatgtagttcccttcatgccagtagctaattggcttagtttgctgatttgttccaggatattccctaaaaataggtgtcttctaagcctcagctttgggccttgaggtatggcatggctatccgctctctgctcctgctgagctaaatgcagtcctgaatgccaaatattgagatttggaattatcaaaggactattagcatcaaattgagaaactcaagctaaatttgcaaattaatacaaaatcatgaactgagcttctcttccagagaacctcttgtaacagaacttgaaggtggcaggatgtcttgatagagcgtggattttagagctggatgcatgctgggcttatatcctggttccagcatttgccttgggcaagttatttacaacctctggttgaggtggttggactagttgatatctatgattcctttttaagtaaataactattagttttttcatacagtataattactatataacaaacatcttcttctttgatttcattcatgcattcaaagtatttattaaatgccctccaatgccggacaccatactaggtactgggtatataagagtgaaccaaatgagcagggtttctgccctcagggagttgataatctagtggggaaggtgttggggatgatggttcatcaatagtaaagaaacaaataatataactacaatcatacttgctgtgatagagaataatggggaggacctatgtattagtgggggtactctagagaaacagaaccaataggatacaaacacacacacacacacacacacaaatgtatcttgtgtatatatatatctatatgagagatatatgtatatatgtacatatgtatgtgtgtgtgtgtatgtgtatatatatatatatatatatggagagagagagagagatttatttattttaagaaattgactcacacaattatggacaggtcccaagatctgcaggtgagtcagcaagctggcgacccaggagagctgatagtttagttccagtgcaagtctgaaggcctgagaaccaggaaagccaatggtataattcccctgaaaagccgatatttcagttcaggtccaaaggcaggaagaattctctcttactcaggggaaggtcagccattttgttctattcaggcctccaaccgataggatgtggaccacctatgtcgtgggagaaatctgctttactcactctgctaacttaaatatgaatcccatcagaaagcaccctcacagaagtacccagaataatgtttgaccaaatatctaagcatcctctgacacagtcaagttgtcacataaaatgaactatcctaggctacttagagtagtcagaagatacctctctgacatggtaacatttaaactgagacccaaagaatgggaaggagccagccgtggaagaatgggggacaggccttccaggcagaaagaaactgagtggtaaccgagtggaaactgaatggaaactggagtccagagggaaaaggggcatgttgtgagatgaaattagagaggggacagaggctttactgtcagaccttggaagccatgataaggggcttgcattttattctagatgcaacgatgagaggcactgagtttgagcaccttggaagccatgataaggggcttgcattttattctagatgcagtgatgagaggcactgaaaagtttgagcaaggaggaatgtgagaggatttatgtttcgaaaagatttttctgactgctctgtgggagtgggtgagagtggaaagtggggagacctgagagaaggctatggctggagcctagtagggagcaggtagcctggatggagggccagggggacagagggaagtggattgtttgcaggtctattttggcggtagaaatgagagaactattggggagggacaggacaagagaacagaaagtaaggctgcctctcaggatcctgcctatttggcttgaacggtttgggtgaacattactatcattcggggaggtgagacttccttttttggttgggtcaactaacaagcgcaattttcacttactaagcatgagacacacctgaggtatccaaatgaaactcaatagtaggcaattgggtgtgtgaagctggagttccaaggacattttgggtctgggtgtatagacctgggagccatcagcatgtaggtagggattacacagggagaggatatagaacaaaaggggtgcagaaaataacccacggaagtccagtgtttaggcagaagaagaagtatctgcagagtggatttaaaaagacccaacgagagagggtggaggaaagccttgagagtgtgatatcacagaggctgtaagcagggagctttttaagaaggagcaagttctcctgtgcagaatattgctgagaggacaagtgatgtgtggccgtgttggtgtcccctgtgtcggtagcagagatcgttagcagagcagtttcagtggagtgacaggagaggaagaccagtagattttatgcagttttaggatgggtatcacccagtgtattagtccattttcacgctgctgataaagacataaccaagaccgggaaggagaggtttaattggacttacagttccgcatggctggggaggccccagaatcatggtgggaggtgaaaggcacttcttacatggcagcagcaagagaaaatgaggaagaagcaaaagtggaaacccctgataaacccatcagatctcatgagacttattcgttatcatgagaatatcatgggaaagactggcccccatgattcaattacctccccctgggttcctcccacaacacatgggaattctgggagatacagttcaagttgagacttgggtgggaacacagccaaatcatatcacccagtttagtacttcactatgtttttggccaattatgttgggtaggggatggttgtgctcctcctgtcccttaccttagagctggcagataaaataccagatatccagttaaatttgaatttcagaaaactttttaaaaaagtataagtatatcccaaatattgcatgggatatacttaccctttaaaaattttgttgctattgtttatctgcaattcaaatttcactgggtgtcctgtatttttgtttcctgaatctggtagcacacattgaattgcaccctttaaaatggctagaatagggaattttatgttatgtgcattgtaacacacacacacacacacacacacacacacacacacacacgtatctggcaattctcccttaactaaactaccatgtagaagctaccatgcgatgcagtctatttctaggtttagccacaagggtcaataagaaaatctgacctcaaaggaaattatgtctggtgatggttaatgcttctactaaattcccttagagcataggatgctgagcccatagtaggacctcatcaaatgctggtttgatagaaattgcatttggggaaaattagcagctgttgataactgaatggaaagaaatgaactaccctggtacctgtggtacaacttaaagaacaccatgaaatgggcctcatgggaggttctcaatgaattcagtggcgtggcacttttgggcatgcttttggaaccaagtacttactccatgtgcctgtgagtttggcacctctcatggcagcccaagtgcaactggtttctgaggggccattaaaaatctcccaatggcagacaactctcagacatgcctgcaaattccaagacagccaggctgatcatctgctactttaattggttataccagtttttatgcctttgtttctcctcctttctgtgaggtggaggaaacataaccacaagactgtttccagtgacctcttcagaggcaatttccaagcaattaagtatgggttgaatccaaagtgtattgatgaattaaattctgttccttggctgaagattctgttccttggctgacacctgaactcaaaggttagattgaactatctaggaaaacggtttttctcttgtgttttcctgcaggctttgctgtttacgaagatcttgcatcaacacttagcattcactcacatggcaagcttgcatgtggtactttcattccacattaatttagggaactctactatgtgccagcattcaatatccaatttgtcttagattttcgaatagtgtcccacaattttataactggggagttccttgaatggaaatatgttcacagtggctgcttaattgtgactaacccatcacatagagactgctttggtaatagatttgattctgagggtctaggagaagggacacttctcatatggggaagacgggattaatccttgaaaatgatactgaagccaacttctgtaccagtatagcagcttagcagacttctatatgatccatgtaagggtctgtttgctctctgagattttgggtgccttctctagcccctgagtgctgggcttcttctgaattccataggggtggaggtgaaggtaccgccagctctcacccaactcatccatccctggacagcagggattctgctcatcaccttggtgcctccgatgcctgaagcacaataggccctcagcaaacatttgttgaattcatgccatgaacattaatcgagccctttttatacactgtgcactgggattgggaccatggaaaatttagagaggaaaaggtccaccttcaaggggcatctagaggaacttatcctctagcaggagaaattgctaatgagaaaaggtattttggggagtggagtgaggtgttggtctagctggcaggttcagcctatgctcagtggctctctggtatggaaaattcctcagaatgttgattcagccaaagatttctctggcagcactgactcttgccttccttcggccacattttattccccaaacctaggtgttactgggaagagactgagctgttttattgaagataattgactttcccagtttttaagtaagtctgttgattcctcgaagacttcactaatcagagttatgaatatttcaaaaacacttcccagtcttcagatgaatggatttgtaggttttctacattgctgtctccctagccccatgaggaataatgtgggtatccttttcccttttaggtttctctcttcctctaacctgcgcccactcccagcctctgatagatgcatttgcagtaaatcacagaaatgttgctgatgtcagcagcactgatatgcattagaggagccacttcagaggaaattactcagagggtgatgctgaaatgcaaagctgtttggtagggtattttgtagaaactgttttctccctttgatggatcttgtttatttttttttgacttagtaggcacagtgaaggaataaccatccaaatgttttttttttttccatttaagttttgtataggaggttttggtgactttgaaatgaaccaggagcactgagcagctacactgacaaatggagatggctgaggctgcttgcaaagcagtgtgttggggtgtggagcctccatgtcagtgacctggggaaaggcaacagtgagggcacacctcattctacagaaatggtttaaaaatatacatatgataccccacttttgatgcacacagactgtgctgtttaaatgctttcgatggaaaatccttttgtaaagtacacgtctatcttgcagagtaggatttctgtatatgatctcaggtttgtttatagggaggtacacttggatgtcttcatgacatttatcatgacagctgtagctgagcagagaaagagggcaggactgccatggggcatcaagggccatttgaagaaggaaatggtggactgagagtgatagcgacctgtgaggctgcctggtttctgtagcagtgttcagcagcctgtgactctgagcagagagaaggaatattatacagggatatttccaggtagctccaggaaaagacaaaaggggaggaagttgagtctgttagctaaagagcagtgttgaatatgggatccaagttgggtggagaagagaaagagaacacagggagggtaggatgacaggagaaagtagaggcagggtatgatgtgggagcgatgagggtagcaagctggaaagagaggatgatctagtcaatgtcttagtgtgccttagggctactataatgaaataccatagactgagtagcttttgcacaacagaaatttatttctcatggttctggaggctgggaagatcaagatatcaaggcagattcagtgtctggcaaggatctggtacctgattgacagacagctgtcttcctgctgtgtcctcactcggtggaaggaccaagagatctctctgggttctcttttataagggcatgaatccaattcatgagggctcagccctcaccatctaatcaccccccaaagcccccacctcctaatcccatcacattgagggttagatttcagtgtgtgaattttgggggacacaaaaattcagaccgtagcagtaatcgcttcaactgagtattgagacagttcttgtggtaacaaggtttagggtgtggccatagggagactcagctgtagtggagctgttggggctgtgccaaggtcacccagatccgttttgttctgtgcacctgtcctttagcttctgggggcttctctctttctggcctgtacctacagcctttttcagaggactctccttggtctaccggagcctattttcaggatgttcctaggagttttttgagatggagtctccctctgtcgcccaggctggagtgcagcggcacaatctcagctcactccaacctccacctcctaggttcaagccattctccagcctcagcctcccaagtagcttagattacaagcatgcaccactatgcctggctaatttttttttttttttttttttttgtatttttagcagagctgggacttcgccatgttggccaggctggtctcaaactcctgacctcaggtgatcccctgcctcggcctcacaaagtgctgggatgacaagcatgagccactgcgcctggccatcctaggagtttgtatcacccactccttcacggtttgtctggagggatctcctaaataaataactcacaaacaaattctcatccgggatctgcttctgggatacctgccctgagttagtggttgagatggaatggagatgatggcaatggtgataaattcaaggaaatgggaggcttgggtcttggctgggttgtgtgtgggatgctgaagtcacttaggagggaaacaggacccagagagaaggctgcaggaaactgggggagcagccaggtctaccactgatggccacagggaagagtaggaagtggaggagccagagggctggggtctcagaggaactgcgggtttgacacaagaatatggggtattggttttccaggacaatgtgaccctgatgttgtgggcgagggagactgaacagcccctaccccagagtcacactgacagcacagtgtcctcagggaaagcccaggtatcaggagaaaaggcgcaggaaggggccctgaagaggctgggggcatgagggagtcttcagatcttcagcaggggcccctgaggcatctttggaatggtttggggtaggggtgaggggaaggttggatcagaggggaggaggctgagagcagaagagagaacaaagctacaccaagtggcctcactggcctcacacttctcagaattggtcccttcagacccggtggtgggtggcttggcagcctggatgtggggtgtggagattggtactactcctggcacacagggggcatgcattggttgaataaacaaatgaatgacacatcaagtttgtagatgccccaccttttcatcattctgaaccattgtcacttccatgtattttatggtctgataaatatggaattaatcgaagtacctctagctatttgttatcaccattattgggtgggacacagcgaacagatttcttaaagctagggaattatgcaataggacatgttacggacttaagccataagatctttttttttttttttttttttttttttttttttagatagagtctcactctgtcacccaggctaaagtgcagtggtgcaatgtcgactcactgcaacctcctcctcccaattctcctgcctcagcctcctgagtagctggaattacagcgtgcgccaccatgcctggctaatttttgtatttttagtagagacagggttttggcatgttggccaggctggtttggaaaggatctttctaataggccaaaaaatatttttcagttttgctttctactgtggatctgtagatccacagtataactacttatggtctatttgcttgtgattgcagatactgaaggagtttgctgggaagggagaagtgtgtgtggaagaagaggggagggctggagaagtgagatgagccctgagcacacgggacattggaggccagggaaagaaccatggcggtgcttgtggagttttaataggtgcaagctgggaatttcagaaggctcacctggctgctgagtggagcctagggcagggtggggggtggggggagacccctccgggagccagtgaggagagataactgcttttgacaagacacctgggaaagacatctggaaggaatggcgttgacaataagatttaaaacccttggccccagggaaaggggatattttgagaactatgactgcttgtattacttttaatcccaagaggaggataaaggtctttcctgtataaagtgcgctagttaatttaaattgtggaggaaaaaacttagggcaagagacagaatatgatattcaggaagcattttggaaaaagacacaaggaaccccagctgtggctgtgtgcacctttagggccttgatcatggaggcaggataaagaagtccatctcgtcaacatggcggagtcagagtctattgggagaatcacgaggtaggcagctctaaatcccaaaagatggtggtccagtcggatatgcctgggctgctctgaccagctcagcacacacaaggaatagctctggtcctgggcaatttgtgccctgggtcggagggtgagagtttattttatcggaacaataaaggcatcccacctgctaccaggagcaaccaaaaatgctcagaagttctggaacaggagtgctgttgaacagggtttcctggcagcccgagatagaaagtggtaaaaacagcaaaatgctgctatggtatagtactgaagtcatcaggcacacactgagacttcctgtgggtcaggccttgtgaatggtgctggagacagagactgggataagatctaccatctctgatgctgacgcccagcccagttctccccttttcctctctagttttttctttctctgtcatgcatccccctccctttgctgtcccttaaatgttgctcccttgagcatcatcttttactctcttctcattttacatctccctctggaccacttcatccagtcctgtggcttcagtaccacttacatactcatcactcttaaatctagggattcagctagattattcccctgagttctggtcccttatgcctcatgttaactggatagctccacctggatgggctacaggagctgcacacctaactctcctgcattttctgtcttgcagagcatgatactgttataagcttataagagtcatcccagacgcctcctttcttcctttgcatccatcactaggacccgcacattttacttccttaacacgccttgtctctgactcctcctctgctgctgcctgagttgaggcctcataatacattccagtaaactcctacccacaccccccacagacgatctctcacttgctgcatgtctcttacgcactgctgccagagtcagcttgctaaacccaggtctgaccccctggctcttctccctgtgttagccttgatggcttcccacgctcattaataagaccaacaagagccacactctctcctctgcttgtctttgcagctttattttggtgtagccatcttcacaccctctagtcctgacacgcagacctgaggtaatttcccaaatgccccaggctgattcatggctgagtgtctttgtatctgttgcccccccattgctgttccgccttcctctccacctccttctgccctctcgcagacacctaatgccctttccacaccagtgggcaccttgtctttgcattctcgtctcctcttcggtggcactgacactctctcttcatgtctttctgtcccccacacctctgtcaaacacagcatctgcacgctttgttgcatttgcttgcatagaacacgtagttttcttcacctcctaataatgtggacagctcacgttgattgaggacttgctttgaacaaggcattgagcaacatgccgtacattttatgttaaatcttcccaatagtgctactgcttctgtccctttccagggaggaggaaggaggcttggagaagggactgtcttttaggagccctgcccagtgtttcctgtggagggtggggccatcgtggaagacagacctatggtaggggtaagctgggtggctgttgaagtccaaccttcccccttcttcctctaaccctgataaccttgttctctggggcctgtctgctagtggagaggcttctgactttttttttttttttgccatacctttggtttataaatacaagaagagatttgggggaaaatcaggggaaactgtcgagcttacaagtcccgagaaggaagtcactgctcctttaagtctcatgtgaaccccttgttctctccccagcttgtggggtgaaagaaaagccctttagtcttttgggtcctcaaatcacagtttatgcagtttggccccagtcagagggaccccaggaaggcagactcagggtaaattctgcctgtcttccaccagagaggggactcaccaagtgtgactcatgccattcaatagaatttttaaaatctcacaagtattttgtacccctgagtaaaagagaggcttgtagctcttcatgaaggaacaagaaaggcccgaactgagtgtttggagcccagtgaagtaaaatactgccctgtctcttgtctgtccactctagcgcttgtacaaaccatgaagaactctctttggactgtttgctttttgagaatgttaacaccttgactctggatttctgcctatgggaaaaaaccacaatagtgccaggggtgcttccatatgcaggattaactctgcagtcaaagtttctgttgggcaggtgtgtgaacttgatatcataaatgctggcccaaagcaaatgggagaatggatgaatgaacaaattcaggaatgaaacaaactgtaaccaggggtctcctagttgtaggttctctgctaaacttcatattgagacacaaaggaagggcatcttataatataatgttgggggatgagcagtcagcttggaggtggggacacgtaaggtgggttttgatgtttgagaaggaattgaccaaaaaaagagtcaagaggtgagaagaatctgggaagcgagacctgtttctctgggacaggtgtgagcgggtctgggtgctgctgggtttggctggggcaaaggttgcttgtgggggcgtggcagtgggtgaggcctgtgagataggcaggcgccaggtcctggaagggagagtcagggagcaaggcatggagcctgcactttactctgaatgttggtggcgccttcagagcattgttagcaggggtccatgtgatcacactgacacctgagagagtgacacaccatgtacatggctggtatatggaggatggatttaagggggacaggactgaaggctgtcgcagtgattcaggtgagagaagatggggttctggactaaggggacaggaaagcacagatgtgagatgaggtggcaggcagttctagctccctcttccccccagtctgccttgttttcctcttctcatggctccatagggtctcagtcatttcatcatagcttgatctcttccatctggaagtgcagcctgaaattttgaagacagcagggagcaatgcttcacccaaagggagagcctcgggtggcgttttgggaccatggcttgctctcttagtgcatacagacttagtgttactgccattcttactgggatcagcttgattgcctttaaggtagggctgtcccatggaaacagggaaaacatgatttggttgtttgggtatctggaaccagaggcagcacagatactgctctaagagctgctgggacaactggaggccggtgtgggtggagcacccgaggtggaatcctgcgctcctcatctttcctgccctcttcctaacaccctccctccccagcggcctgaagtctgcctatgcctatgcaggctgagctgtaacctgggactctttggaagctctgagccatcagtgcaggtggccccggaatgattccagacctagagtaggggtgggaggtcggctgcggggcggggggaggtgagaggaggctgtcctttccctcttgcccgggagtctgcagtcacagttgcactttgcctgggtcagtagcagagtcacgctgctgtgtgacagtggcactgaggcagctgcatttcaggtttccaagagactctgaacccttggaatgccatttgtttcaggtgacatggaggaatggaggcactcgggttaagtgtctgaagatggattcaaggatgcccctgcttgttagcttgtcataggttgctcagtgtcccctctctggcccgtagtttcctcatctatcaatgggggcagataataatcatcaccttacacagaaggtttggcgaagataaaaacaggttcactggctgggtgcagtggctcatacttgtaatcccagcactttaggaggtcgatgctggcaggtcgcttgaggacaggagtttgagaccagcctggacaatgtagtgagaccccatcgctacaaaatattaaaaaattagttgggcatggtggcatatatctgtggtcctagctactggggaggctggggtgggaggatagctcaagccaggaattcgaggttacagtgagctataattgtgccactgcacttcagcctgagtgacagagcaagatcctgtctcaaccaaaacaaagcaaaacaaaaacagcttcatgcacgtgtaagatctttgttaattcttccattaactctgaaggcgggatgcgtcttattaatttatgtagctccagtgccaaatgcagtgccaggcaaactcagttgtttgttgattgaacgaatgaatggatggtgcagtaatatctgtggggcttgagaaagcctgaataatgtcaacttattaagagcttgttcaaccatgaaaaagcagatttccacatgtacccctccatatcacccacatttaggtgaaaatgaaatatgtgccgtattcttttttttgagacagaatttatctcttgtcacccaggctggagtgcaatggcacgatctcggctcactgcaacctccacctacctggttcaagtgattcttctgcctcagcctcccgagtagctgggactacaggtgcatgccaccatgcccggctaatttttgtatttttagtagagctggggcttcaccatgttggccaggttggtctcgaactcccagcctcccaaagtgctgggattacaggtgtgagccactgcgcccagccatgcagatattcttgaggaaacattttaaaatgaaaactagcagaaaggatattacctttcaacatttcctttctcatcaattcttggcagcacttttgctgcccagtactcttctgttggagctgtgaagtgtgataggccattactttatagatccattcattattgatacgttttgtagggaagaactccactgctgtttggaaactgaagtagtcaatctcatagactggaaaatatttttaatgcctatttgaaacaaatgtcgttcctattttttgggataaaagggccctttccccctggaattgctatgtttcctcttttcctgttcctacactctgcagaactgactttgaagtcagatgattccctttttaatctggcttctcgcttttgggccgcttaaccttgacttagccattgaacctgtctgggtctcagtttctttgtctgtgaagtggggctgtgttgggcatgagcatgcgcctacaggcctctaactggagggggtgttggtgatcagggccctggctgctgccctgatctccacagctgggcttgcactgcgggtacgttgctcccgggctgctcccagccagtgtctgtgcgcagcaaggataccacggcaggattgtttctgggagacacaggactcctcagacagctaacttcagctcaagaactccttgatgggcttgctaaacttccttaggctggaagatgcttacctcctccttccttctttccttccttttccaggggtcagacttacttagagtctagtggctgttctagcctccccaactccctatcattttctctcacacatgcgttccccctaataaaatccatgcacatttaatcccttcttggcatctgcttctgggggtcctacctggactcatgcagtgtgataattccttgtagtgaggaccgaatgtagtgatgtaagcagagtgtttgtcagagtgacagcatgagtaagtgcccagtaggccatcagggctcctgtcaccttcaccaccatcagcaccaccatcctcatcaccatctggccaagtttgcttctttgttggttccaggcacgagaactccagtggttgattccaggtcatgaggcaactgtattagggtgagaacaactgtggcttctaaggagaataaatggattaatgaaaatgccatttaaaaatttatccaacttggctggatgcggtggcttacgtctgtaatcccagcactttgggaggctgaggcgggcagatcacctgaggtcaggagctcaagatcagcctggccagcatggtgaaaccccgtctctactaaaaatacaaaaaatcagccgggcatggtggtgcacgcctgtagtcccagctacttgggaggctgaggcaggagagtagcttgaacccgggaggtggaggttgcagtgagccgagattgtgccactgcactccagcctgggcgagagagcaagactccgtctcaaaaaaaaaaaaagaaaaagaaaaagaaaagaatttatccaacttaagcacaatccagatccttttctagccattgagatgtgcagtcttctttgccaaaacaaccaagtccctttttagtgaaatgcacaaaaggttttgtaacattctgagatctgtgccggtactcctgacaactacaaatatactccagccagtagaccagggctgctcatttgctgttcctgagaaccctgtggacgtttagaaaaaaagatggctgctattattcacatttcacagtaagcaaacagagaaactaagtgacagtttcgaggtcatgctgtcactgatggatttgggactgaaactctggtttttgctctggtgctttggaagctcaggcatgggtggattctgttcaaactctgccctaatggacagtctcttcgcaaactggcaccaggacctggcctgaagagacgtttctcaagcccaattctgcccagcctcagggatgctagaagcttgggaagcatccatgatgcaggtcagtgacggagtccagcctccactcacctccatgctcatgctatttattgcatgtcagctgatgaggctttaagctaatgttggttacctggtgctgtggaacatgttccttaagctgactggcaagcccctgaggctgggagggactgtgccttatccccaccataccacacccctttgtgcccattcagcattaaataaatgtttgtttttgagagtgctggtgattccgatggggcttttgtgtgaaggaattatcaccaccaccaccaccaccactggaaaacaacatttgctctatgccaggcactatgccaagaaattgagatccaatgattaaaagatgaactttctgactccaagaagttgataggctagtggggaagatcagcacgctgggcctgcctggaagagcccaggacgacttcatagaggaggtagcttttggctgagactaaagaggatgggagttttccaggcagatgagggtggggaaggggttactggctgagaggacaacacctgcaaaggtgtgaaggtgtgaacagagcactgctgtgtttgaggacctgctttcagtattgctggagtgccaaactgtttgccatttgacgctgctcatccacgttgtctgtgtggtttggatgtgccagcattccttccaccctttattcacttattccaccatcattgattgtctacccaccatgtgccaggtactgtgcagaacactaggggtgcagaggtgaggggtagacagggtgcctgccctcatggagctttcaatctaatgggagtgctggacaagggcacaggctgtatcagcagcacagcacagtgagtgctgggcaagggagatgtattagtctgttttcctgctgctaataaagacatacccaagactgggtaagttataaaggaaagaagtttaatggactcacagttccatatggctagggaggcctcacaatcatggtggagggtaaatgaggagcaaagtcacatcttacatggcagcaggcaagagagcatgtgcaagggaacccacctttataaaaccatcagatcttgtgagacttattcactatcacgagaacagcacggggaaaaacctgcccccatgcttcaattacctcccacggggtcactcccccaagatgtaaggattatgggaatacaatttaaggtgagatttgggtggggacacagccaaaccatatcaggaaacctgaactaatggagggcagattcatttcctggggcttccgtagcaaattgccacacatgtagtggcttaaagcagcactaatttattattgtatggttctggaagtcagaagttcaaaatcagcctcacttggccaaaatcaaagagtaagcagtacaggttccttcgggaggctctaggggaggatccttcccttgccttttccagcttctagagggaccacattcctgggctcatggctgcatcactccaacctgtgtatctgtcctcacatcccttctctctctggccctcctgcttccttcttataagaactcttgtcattatattgagcccaaccatataatccaagatcatcccccatctcaacattcttaatcacatctgcaaagtcccttttgccatgtaagataacattcatatatgtcttggggattaggatgtggacctctttgtgggccattattctacctgcccccaaggcaggaggggagaaggtgctcccagaagtgatatttaatatgagatttctggctcagaagcaggatacacatggaagcagggaggccccttgggaggctgctgggctggtccaggcaagatgtgacagtggcctggatgaggctgctggccacaggggtagggaaaggcccaagggatgaaatacagtgatgaggcagaatgaatgggagatgtgggcagtggtaaaagaaagccaccttaggcaaggctcaccttctcggcatcaacaggagcaagggggaaagtgaatgcagcgtctttagggaaaggttagcaagaacataatgcccaggttgctgattctaacatatagatctttcaatcaagattccagacaattttgcgtttgtgtaaatctgagggaaatttaacatggagtgattttattggattggataatatgccataaaagactgacgttcagctcggtttccaaagacagaaactgattccgagggcctaggaggagaggcagatgtttacaaacttagattcttctaagccatcacctctacagccaggtgttttgaacaggcagtgacatagcctgctctttgacttttccaacagtgattgagcagtttaactccctgctggagtgggactgtttaccccacttaggtaattaggtttatcatctactaataccttcttcacacaacagccagcctgcaccatgacagagactataataagagttggaataataaagggagaacaaaactgaagtgcagtggctgttcgttgttgcacaagacatttctgtgatgcatgatagcattgcgtgtgcgtcataaccccaaacttcctgccatcgcagaaaagcctccagctgaacctatttatttccaaagtaatgaaattgccctacagagaacagggaccttagagaattctatgtgcttcgaaaaccaggaaacagtttttttccaatgacgtcttattggaaaacaatagaagaaaaattctattactagtagatcaggagtggttatgcctaagtcacatcttctattaagatataacaagctcatccttttttcctttgttttgtgacaagaggactttttaagtctctagacattcatctcttctctgctgttggtatcaccagcccttggtgcttggatagagtagttggttatccctctcctatttacttcctctccaagttcaacaacatgtttgtttttaaatctgatgatttgttgtattccttacacattgtttcaacaaggaagctaagggaggaggtgaattataaatggcagagagatagctttcaatttggaccctcgtagaaaaatgtaagtatttcaaactcagtttatactttttttttttttaaactgggacccctggtgcttattttttagaactcaaatgggtacctagcaactgatcaaattccctaactgcaggcttggtgaaccagcgtttcatcctcacatttgaaagctggctcaaagaagacatctgtgctttgtttctgacacgttttgtatttatttataaacaaactctcttcttctttgtcccccaccctgactcctcagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccaggtgagcagggagtgagtccatcttaggccagctggtggggtggatggcagtgttggttttatctttctgggtctctagtcttgccttcagttgagaggctcttggtggtcagggaagttctctccagggaggtgacatgtgagctgagacctccaagaagcgatagtgaggcatgtgacagtgtgggggaaggagggtccatgttctgcatctggttttggatgagtggtcagaggcggcagcaggccaatggactttggattttcaagttcaagtccacctatgtgtgctgattaactccttgattctgaactctgtggaatgctgggatagaacccgaagaaggaaagaattttaaatatgcagatttagaataagcagggatatattaacctgtccaaggtccatgaggatgaggtagagaagaggccaccaggtatgtgggtgaagaggctgtcagtggcctgagacagctgttatagtggatttatggggatgaaataatatggatcacagtagtagtaatcatcaggtttgctgtttttgaatacttactgtgtatcaggcactgtactaaggcctttacataccctggatattaaggaaaaaagattcttaggaaaatggaagcagagaacttgaactgcagcctaaagaagcaaggcaacacttctgggcgacagatgtggacttggcaggggtggactgtggcggtaaggagctataggaaagccagagagtcatctgtggggctgcggtgcgagggactggatcaggagggttgtgaagtctgggaagccagagagaaaagcagttcccacgaggaagaaagggaaatggtggagagccctgttggagggcttcaccttggacgtgaaggaggaaggctgcctctgaggctgaagttccactttctatcccagacaccctcctgaactacaaagagtgggttttggtggaaggcggtgacatttatggaggtgagggagagtctcatctttctgggggctctaaagtttggaaggtggagggatggaaaagacagcttttacaattccttctggctctggaagatgcacattaaattctaatggctgcaacaatccaagatagtgtaggatttaccagtctgcgctgttttcttatttatttatttcttaccataccaatagagtaggggaattctgatgctgcttatgatctggcaccttcatagcaatcatattcttgtcagttagttttaataatgacttgactcttaaataaatagaaatacaaattcttcccttcctgggagtaaatatgatttcatagctatgccctataattcttctcaaaaaaataaaatgttaaaaatccaagggcagcatttcatataagtgtttcataggaagtcagttctccaaatggctttgtcttttttttttttctttttcttttttgagacagggtctcattctgtcacttaggctggagtgcagtggtgtgatcatggctcattgcaggttcaacttcctgatcgaggtatcagctgatccttctgcctcagtctcctgagtagctgggactacaggcatgtgccaccatgcctggctactttttgcatttttttgtagagacaggttttcaccatgttgcccaggctggtcttgaattcctaggctcaagcaatcaacccgccttggcctcctaaagtgctgggattacaggtgtgagtcaccacgcccatcccttttcttctttcatgggaaaatgctaccacatttgtggtgatgagatttttgtactaatcagtgccagatttaaagcctagcatgctatagagaatggaataaacaattctggagtagttttaagtaggagtataattacatttatacacattgttgtgatatgaggtaggatcctttttaattagttgtaagacacgtcataataacctgataggcgttctgaagtgaatctagtattgtgtttgaattttccttcattaggcagtaagatcttgaagaaaaggaatgcactgtgttaccttttcctccacatgtgacctatgctttgctttgcctctaattattgcccattagataaatgtttttagagcaagatatcaaagcaaattgtagaacactggtgatgtcacaagctatctgagcttatccatgcatttgttgattaattcggcatttccgtattgcccattctttaaccctcatctttatgagagagctcagagacctgaatgaaggacagggtcagagagcgtggaggtccttattctgatgctgccattaagactggtgtcctgttttgacctcaaagatttctctgtgaaatgagatatgtgtgtgtatgtgtgcgtttgtgtgaatgtgtttgcacatacacacgtgtgtgcatttaagataattttataacaatttaaaaagctgctctttattaggcatctgttatgagctgggcatcatatacccattatctcatttaatcttatcaacaacactctaagttcatatcacgattcccattttacaggggaggaaacatcagtttccttaaagaggtgagtaactttccaaccaccaaagtggtagagctggtagtcagcgcaaggttggactgactgtacactctctcatccaaatagtctacaggccctttaagtagatcttggtttataataagctccagtctcttttaaacttgtgctttatgttgaatgctgtattagtccattctcactataaagaactatctgagactaagcaatttataaagaaaagaggtttaattgattcacagttccgcaggctgtgcaggaagcatggcttgggaggcttcaggaaacttacaatcatggcagaagacgaaggggaggcaggcatgtcctatatggctggagcaggaggaagagagagcaaagggagggatgctacacacttttaaacaaccatatcttggcctggcgcggtggcttacacctgtaatcccagcactttgggaggccaaggtgggtggatgacctgagatcaggagttcgagaccaacctggccaacatggtgaaaccccatctctacctaaaatacaaaaattagccaggcgtggtggtgtgcacctgtggtcccagctactagggaggctgaggcagaagaattgcttgaacctgggaggcagaggttgcagtgagccgagatcatgccactgcactccagcctaggcatcagagcatgactctctcaaaacaaaaacaaaaacaaaaagccaaacaaacagatttcatgagaactcactcactatcacaagaacagcaagagggaaatctgcccccaccataccccttctcctacactggggattacaattcaacatgagatttgggcagggacataaatccaaaccatatcagacactttccagaattttagcagtcaaaaagcattagatggccaggtgtggtggttcatgctggtaatcccagcagcttggggggccaaggcggatggattgcttgagcccagcagttcgagaccagtctggacaacatggcaaaacccttttgtacaaaaagttacaaaaattagatgggtgtggtggcacacgcctgaagtcccagctacttgggaggctgaggtgggaggatcacctgagcccgggaagtcaaggctgcagtgagccatgattgtgccacagtactccagcctgggaaacagagtgagaccttgtctcagtaagtaaatcattagagttcctggctgcctaacaggaagcatttctgtttcttctccctatgcacattgagcatcagtcctggacctgggatgcttttagatctccatctactatgacttacagattcatccttgtgtttatctacagtctttctcacaatataagttaagcaggtttaactgctgaatctgtgtcaaatcattgcaccaaatcattacattttgcccttcagttcactgataccttcacaaggatgaaagtgtccactcttacagaccagggagctttctcacactttatgcctctgagcagcactgtatgtagcgatcacaagaaacacagtatttaaaaatagtctgttttcacatctggaagggttttcagtgtgctgtgttttaagttggaaagatagtactattgtatctcacccaagtctgaaaggagtgactggagagtagaaagtagatggaaagtatttatttcatcatgtctcttggctggattgagtgaacccctcataaagccaagctggaatgtgtgcttcatattattaataaccaaaatagagtatccagagaagcatgataccctcaaaatgcctggatagcctagaagagccgtagctcttacagccatcgtggggagggattttccaacaagtaagaccacttcatggggtactgtgggactccagaggagagtaatgggccactatccctaaaggtgaagaaagatgggttgctgttatgaaggggacattctcatccattcatttagtcattcattcatctatccatccatccacttgttctcagaattgctgctgaactcctgcatgtatcaggtaacatgccaggtgttggggagagaaagaagaagacgcggccgggttcggtggctcacgcctgtaatcccaccactgtgggaggccgagtcaagcggatcacgatgtcaggagtttgagaccagcctgaccaacatggtgaaaccctgtctctactaaaaatacaaaaattagctgggcgtggtggcaggtgcctgtaatcccagccactcaggaggctgaggcaggagagttgcttgaacctgggaggcggaggttacagtgagctgagatggtgccattgcactccagcctgggcaagagaatgagactccatctcgaaaaaaaaaaaaaaaaagactcaccataagcaagttactcacctcttgtttcttcatcaatagaatgtggcctcagggtgctgagaggattaaatgcagtaattcatgagaaaggctttgaactgtgcttggcacacggtaaatgctcacaaaaggattattattgctgcttctattgctgctactgttctttatattattcagggagctcagattttcaagcagtggttcttaatgggatggggtggggtcaccggggaggggatggttgcctctagggggcatttggcaatgtccggagacatttttggttgttacagctggggaggtgctatagacatctagtgggtagaggccagggttgctgctagacatcctacaatgcacagcatagaccccccctcccacaaagaattatccagttcaacatgctcataggttgagaagcactggaggaagaggcatgtaagccaataattacaatcttttggaatagagctatctgaaagacgtccaaaaaatggagccctagtgaggcaaatagagctcagagaatattttgtggttatttatctccttcagtccccacagctgttctgtgaggataatctttggtgcccacatacaggcgaggaaatgaggcagcaggagctgaaatgatggcttaagttcacctggttagaaatggaggatccagggtttactgccaggcagtctgaccacatatcccaggctctgaaccaccatgcactggaacagaaacacgatatctgggagggattcattgggtaggccatggttggagggtatcccaatggctggcatgtggcccatgggaaaatgctaacaagtttgtggtgacaagaatgttatactaatcagttccagatttgaggcattgaaagtgatcagaatggcttgaactgagaagtatgagagtacgtggaaatgagactgggaagggggtcgtgggagctgggctgaggaggtgcttagaggacctttatgttgtggaatgtcgagtcactgaaagctttaagcgaggcttggaagatggaaattggctgctgaaaaaaccttttagcaatgaggaagttgggttggaggaaggagaaacgggaagaaggaagaccagttagaatgttgcaacatcacaggtgagggatgctgagagatagagaaaaggctatatttaagaaagttgacagagaaaacttgaaaattactcaaacctgactcagcaaagatttctgctatgtgctgcatatccctgcatggcctgtagcccccaggactcgggggttaatctccccacgttaaatcctataccacttaatgagctgagtgaattgggcaaatatcatgttgccccggcctcactgctcttctgtgaaatggagattgcgatcacggtgtctacctgttagacactatggtggtctgaggattaaacaaaagaagctcagtaactttgagctcttgttattgctgctgcttatttgttagggaaggaagaaaaaaagaaaccagaaaactcctaactgatgcgcatcgtggagttctgctgagggaaaagagaagaaggtgtctgaaatgactcttgggcttcaaactctggattttctcatagaaaaattttatttctactgttcaagtgcagagtgcccatcacagaagtcgctcccagagtgctaggctgggctgctcacaccatgatgctctgtctttgtggcttgagctcagggaatcagcacagcaagttgctattccattgagagggtttactgtgggcatctagaatgtcatctttatccttcgtcttactggagactgtcagtctcacatttattaagtagacactagggccggctccactgatctctctccccgctgcttctctggtttgaggcacagtttcagagaacctgagggacccggtgggctcaggcggcctcaaagcagcaggtcacctgaccagtggagtgaccacagattccaaggtgtgaccgagtgaaagggcttatatccccaatgcctgactgcagttaaaccctaatgaggtatgtggatcttctagaggaagggccaggcccctttaataaggacccttctgaacaaagagacaagatgctaatccgaattccactaggaccaagtttgatgtcctagggcaagccgcttaacccgagctggggctcagcagttaagcacatagaggacacaaaagatgcatccgtctctagaatcttacccctgagatgtgagggagtgtgcagatgattgtaaatgggtaacttcctgcagagctggtgtaataataaaatatagctaccacttactgattgtttactttcctctagactctgttctaagtgcttgaatcctctagctcatttaactcttgcaagaagcctacaaagtaggtacttttttttattccttttttttaaaacagggtcttgctctcttacccacactggagtgcagtggtgcaatcatggttcactgtagcctggaactcctaggctcaagcaatcctcctgcctcagcctcctcagaacgtttctgggggtaggttggtccaatcccctcagagtgagcaggttatctcactccctggaaggctggcttctcccctgcctctcttcggtgcttgcctccagcaagttactgaagtcctcagaggcctctccaccgtgaaatggacactgtctgtctgtgggactacaggtggataccaccagacccagctaatttttaattttttttttttttttggtagagacagggtctcactgtgttgctcgtgctggtctgaaactcctggcctcaagcaatcctcccacctcagcctcccaaagtgctgatattacaggtttgaggcaccatgcccagtctgaagtaggttcaatcatcatctcattttatggatgaggaaataaatcccaagaagttaaataacttgtccaagtccagacagccaataagtgattaaacttggatttgagccctgggaagccagactccagagcccacacaactgaacccttgtgccatactgcttacttgcatcaatggtgagtatcccctcactaatatgtagacctcttcataaagcttttactccaaggaaaaggctggagggagaaggaaacatgattcaagaaactgggctgtctggcatggtgctatagcactccacgtggggaatattgtgttttcaaagaaagggtgtgttagaaggggaatgatcatggacgttatatcagatagacttggtccctcaacaccactaaacctaaggcccctcctcatattaaagggatcacagtcctcattaggatgattgtggggagtgagtgaacctagcagagtgcctggcatgtcactggcatcaggaaatgctatttccttctcccacccgtctttcttctctcaagcgaactgagtagacaaagataattatacctggagtacttgcatttctttggcagtagaataaagtaaattaaatgtatttttgaagttgaggtttccatgaacttgatttggcggtcactgtgtcccaagaaagcctttatctttgacgtcctcacatgccgcaattgcttatctccctgttcccagtgcaattgtcttagaagcttctatactgactagtcttggagaaagccataaaacattcctcttttgtgatcctcaaagaataaaatcgtgaggagccttcgctgactgacggggaagtgtagaatgaatgcttcggtttgcagggatgatcattggcagcagtcttttttcaggttatgaattctgatgtttcccagatgtttgaagattttgagtgtcttcaggggagctcgagtggtcccatggctgccatttcttctggtcatagcctcgctgaagggaatagcatttcacgggagtgggtttagggttggatgaggcacccatcgggaaggacatgggatttttcattctaagtgccttgccataaagcaaacgacaggggtctattcctctctctctggagaatgtttctgggggcaggttggtctaatcccctcagagtgagcaggttatctcactccctggtaggctgccttcttccttggctcacttcagtccttgcctccagcaagaggggtctctccaatgcaaaatggtcactgtctgttcatgatagtttttctgtctgaagaaagtcccggggccttcatctgcatggctggggctaggtctggaactgcctggagcatgagccttttggggggtctcttcccacctgctttgtctctctctctctctccccctcaccctgactggtccagtgactctttatgttggtgaacagaaactttaccattggttttcactttatgacgtctatgggcttcccctctctgcccccaagatggcgtctcactctgttgcccagactggagtgcaatggtgagatcttagctcactgcaacctctgcctcctggattcaagtgattctcctgcctcagcctcccaagtagcagggattacaggctacttcaccaccccagctaatttttgtatttttagtagagacagggtgttgccaggttggccagactggtctcaaactcctgacctcaggtgatctgcccacctcagcctcccgaagttttgggattacaggtgtgagccactgtgccggctaaggattttttttttaatcctttccaaatagagtttcagatactttgctcagtactgtgtttgatgagtattatttggcaagatttattattttttcattaaaaaattaaaaatgacctataataattgtatgtatttatgaggtacctcgtgatgtttccatacctacaatgtatgatgatcagatccgggaaattagcatattcatcatctcaaacatttatcatttctttgtgttgggaacgttcaatatcctccttttagctatttgaaactatatactagattattgttaactgtagtccatcctgcagtggtatagaacactagaatttattcctgttatcttgctgtaattatgtcctgtttaacaaatccttccctatcctctgctcccctgactctttccagtcagcattatttattaggcactgattctgtgctggctgggtgctagagagtttacatatattacttagcttcatttgcctctctccattgcaccaagaggcggccactgttgctgccccattttacagagggtaaagttcttgcatctagctagtgaccaaagcaggacttgagtctagctagatctctctgactccagaggccacgctctcttaatcgtactctccttggcttgacacggtgggcttagagagtacataattggatcaagacaaattcctcctgacgaagggaaaacccactcaaacaacatgatgagcaggctcctttgtgacagttagtgcttgccttctaacgcagagctctctctcctgtcctcttcctgtatttgtaacctttctgacatacagagagcctgcatgacaaggctggggtgccagattgttggcctctggcttactgactcattttattggctgtgcgcattgggcctgactctaccatgttttagtggagaaagatttagtctaagatgtgggcagcggcatgtgaggagtgggtattgtgctgtggtcctgggtatgaacctttgatgttgtcatggcaaccaaagctgctattctgcagatgagaggactagatattatgaactgtcaaactgttctctccataaccaaggagatgttggtaatctccttggtaatttgcatgacccataaacatttcccaaggctgtggctctgcccttctgccaagacccgagtcactcacttgctcactcacttactcatttgctcactcacttattcattctttcattcaacaaacttgttgattgcctactgtgctagatgctgggatgtaatggtgaataaaagacagacatggtccctgccttcttggagcttataactaggatgaccaaatgtcccaggttttgtggttctggagtaattgttaatagtgcccctttctctctcagaagtgtcctggggctgggcgtggtggctcatgtctataatctcagcactttgggaggctgaggcaggcggatcacttgagctcaggagtttgagaccagcctgggcaacatggcaaaaccccatctatattaaaaaaaaagtgtcttggtttgaaatataaaatatatagtgaccctacttatagacagtgggagagccaaaccttatgcatgttattacacaaataattgtaactaaaagccagatgaaagttgcaaaggagagggagctagagctatgggacacccaaataggagaactgatttagtaggacaaagattccaggcagagagggctgagtcaaggccctggatgggaggaagcaacatgccatggctgaggacttgagagaagtgagcaaatgtggccaaagggcatttagcaaagggaacttagaaagcaatttggctggagacaggcaggagccaaaccacgcaggtgctgattctgaattttatcttaagagcactgtgaagcttacagttatgttttcagtagcagagtgatataatctggtcaatcagtacattgccattttggttcttcgtataaacccaaagggttttaagttatttgttcattaattcaataactaaacatttatggagtggcaactgtggcactctgctaagtgttttgctctggagttctgaactcaattgtcctcagtggtgccaaaactcaactcttgggggaagcctttatgggccctttatgttgggtcgtgtcctgcttggcaccatttgccccccatttgctagactctcttggatgacctttacttttctctgtcctctttccatgactgtgagctctttgaagttgaatctatgtcttttatcaatatatcccttctgcctggcacagtggctggccaatagaaaatgctaaaggcttgaggaatgaaggaatggtgctttttgtgtctgttctttttttttttttttttttttgagacagagtcttgctctgtctcccaggctggagtgccttggcatgatctcagctcactgcaacctccacctccgcgattcttctgcctcggcctccctagtagctgggactacaggtgtgcaccaccacgcccagctaatttttgtatttttagtagagacggggtttcatcatattggccaggctggtcttgaactcttgaccttgtgatctgcccacctcggcctcccaaagtgctgggattacaggcatgagccactgtgcccagcctttgtatctgtttgaagaccaagagcccttcatttagaactttcacagaaggaaagcaaaaaattcttttgtttctgttttacaagtcttttctttttggtctggttgtcaatagtacttctctggatccgcctcctgtattcaagtgatttttctgtctcagcctcctgagaagctgggactacaggggtgtgccaccacacccagctaagacaaaaactcaccttgttgtcttctttatgcatgagcagattcccttggtatctatagccgtcgaagctttacgtatttccctatttagggacataagaatttttaggaaagcagcgtgttggaaagcacggcacctgagatgttcatggaaatccttgttgtgacttcagagtgcagatctagagcagccctctgtttgtctgccctgggccatcccctatttcaagcagtctttagtccaggaagtttaggtagcagctcaggcagcaggtgagctctggagagtgcaggttcgggttctttgagcccaggggcacaactctgagttgaagtgactcctcctggctgttgctttgaatttagaagagctgccctttcaccagcaaggcagtcacgcaaaagatgcttcaatgtgtgcaagatcaggcctgcagcccccagcctgtgtctacaggcctccgagtcattattattactgtttctatccctggggttattgatttcatcactgtttagtgaaggagatctaaagcttttaagccagaaattaaagaggtaatggaaattggcatgccactggaaaatgaatttgcaaatgagaattcaatgttctaaaaaaactcccataaaaataaaaccaaaacccagaagtgaatgctcctgtgactgcatttttttccaaatgtgcatgggtttgttctcctttagagtgtggctgtatacattatggaataatgagattttgatggtgtctcgttcctacaattgctcttattacttatcacaatacaatgtattcatttatataactaatatttacttagtacctataatgaagcaggtgctatgtttggctctagcgattaaaaaacaataaaaaatgcaagatgcctccaccctgtcctcagggagcttgaggttcagtattaattatatcgctagccaattctggcatggtgcttactgtggacaggaactgctctaaatgcttcacgtgtagtaactcatttaaattttacattgatcctatgaagtggggtaagcaacagaggaacagagaagttaaataacttgcccaagctgaagtgagaggtggaactgtgatccggccaaggcagtccggctctagaatccatggtttttagccatgatgctctactctagtggatagttacagcccagtagctattggttactagattggttctagaagacaaggaagcactcaggtccttagtcacagagcaggagtctctgactcaacctatgggacccccaagaggaccttcattcacctgtgagtcaactgcagtgagtcgtgattacctcctggttgtcctttagagtggcagggctttgtgtcttaacataaggtgttgaagctgggtcacccttttcgatctaaaaccaatgtccatgggttatcattcaggtctgcaattaagagtagcttgtcactttatattgggaacatttatttttccttccttctctatggaaatgggcagaagagatgaaaagcctgctggtgcagcttaactttcctcagtaagtgagtgtttaaccttttgtttttttaaaaatggagatgagacatacaaattatgacttctctatgttgtccttttttttagttggaagaaggtgacatgacagatgagctttagaaaaatgtttagaaggtgaacagagaactattcgtggaagatagaaggctagagttaaaagagaggacttttaaccagtctcagctctgacacttcctaactactataacctcacaggattttgtgaggactaaataggataataaggcggagtctgccacattgcaagtgctggcagctatgattaattttaggagtattctagaactttccctgaagtttctagcattgtctgcacttccttgtttctccccttatcaaactatgctcagggagatttggtgactcattcttaaggaggcacagaaaatgattttttttttttttggcacagaatcttgttctgtaaagggcagtcttgctctgtggaggctggagtaaagtagcacgatcatggcttactgcagcctctgcttcctgggctccaacgatcctcccacctgaacctcccgagtggctaggactacaggcatgcaccaccatacctgtgtaatttttgtattttttgtagagatgggattttgccatgttgcccaggctggccttgaactcctgcgctcaagcaatcctcctgtctcagcctcccaaagtatggggattattggcatgaactaccatgcccagctggaaatgaaatcttaatttgtgattaatattgatcactcaaaagcaacaaagagccctaaggtaaatagctacaataaaagcaagatagcagaagcctctctttttcatgatgttattaatcatctaaatattaaatttcaggctctgttcaatgcaatggcaatggaaggaatagtaaccttccatttagtgcacagtgtaatgaatcagaattcttgtagctgcttttgtagtccagtacagttttttaaaaatagaaattggatagacccatttttaatgggaatgatctcaagtgcagagagagcaaggcatatatcagacactctcctcaggaccagggcaatttttcaacatcagttggcaaatttgttattctgcctgtagagtgtaagtccaaactgagatgaaagagtgacagcttgttagtctgaaagtttattgatcatatcaaagtatacacatctatccctgattccttagtggacttgatactttcctcgtggtttaaaatttgtcttatttcatccttccatgtagtcaaagagagacagaggaaatgcattttccatcataaggcacaatttggaagctacaagagtgcccccaaatatggcctggtctcataagataatatttagatagattagtcgttagtgaatacccaaggggctaatgaattgagtctcagaaatccccattgtaagggattaacttgtagtagcaaggaaagctagcgtgtctaagaccatacgccatgagcaagcatgctagcccatcctgggtttctctctcctcttctccaaacagattctccacttgccctgtcctttctgccagtggccttcactttagatttataactaggctgtaaagttctaatgaaaacttgctgcctggctccctgaggacctgaggaaaggctaatatttgcacataactgggtacttagggcagtaggaaaatacacgtcattgtaatatccaccacagcactgaaggtgcctctttctttacctttttatggtctggtctgctttttatgagggactctgaggtggtgtggcagttaggaaggccacttgattggggtgtgtccactcaggtcagcccaggcttgactgccatattggctgtgtctgggtgggaggtaaaggcacacgtgcgtcagcctgcattctcttcccttcgtcctattgcaggtagctgggtgtcccaggctgggtgtgagccagcctgcccttcccagatgtgggaagctgtgcgtctgagatagagaaaaaagaactcaaggtagagagaagcgcctttgcagagttcaggatggtgaacttcctgttgacaattctaagagcattgtttgctagctttgctgcgcaccagatgtgtactgtacacacagcactttaccattctcagtgtcatgagtcccttgggggcagcagtgttgcccactgtactaggtcctcaccagggctgagttaatctgtactctaggaagtgctccgaaagggttcctgttactaatactcctgaataagaaatgacaaggcacagtgcctgaagtcttatgttcatttttagacaactctgacaacaaccttgtatggaaggtattagtcctcattttatagatgaggaaatcaaggttcagagaagctgaacagcttgcaaggctgaatggttaccgctttatccaagaactttccctgttgcaagagtaatgtatgaggtgctcccactgtcttcctctgcactgaatccaagacatctctgaatcagccacaaaagtgcctcactgggtgtggccccagaaatcctctctgagaccctcccatggttgtttgaaatattgtgaactcaccttgcccttggaagattcacttgtgtggctgtggaatatttatatgtgaaatacttctgaagcaggtgaaagaaaaagtaattgtggcaagcaaattaaatattgtctttccacttcaaacccgaggctcttcggccataaatgtgtgaggaggtggagagatgttgctgccctgctgctggggttttgaatcattaggggcatttttgagtagtaatgaatgtggtctgccagttgcctttctcacagagtttgtggctttcctcccaactgctaatggctggaataggctccctttttttttttttttttttttttctgagacggagtctcgctctgtcccccaggctggagtgcagtggcgcgatctgggctcaccgcaagctcagcctccctggttcatgccattctcctgcctcagcctcccgagtagctgggactacaggcgcccgccaccatcctggctaacacggtgaaaccccgtctctactaaaaataggctcacttttaatacattttagaaaccactttccacattcatgccctcatcctgcctcaatccctggctaaatctccaattcataatccctttgctgactgtgccgttcagggagtaagaacgtggtggacgcagccaccattgtaccctcagatgaagtcctttctcgagagacaaacagtctgttagtaaaatgaccatacatcctgggttgcacctgtcctgtggtcccagcatagctgttaacagagctacctttttatttgcaagttccctgctttggacaatagatcaactggtcatccagctattagcgtccatgcataaagcacgaatctgttgtattcttcagccaatctgagacaaccaagagattactgctgcacctttgtttgtctttctttttggtggcacataaggaaacagagaaacagatgatctcaccgagtgcacagatcataggagaaaagccacagacagttagtggtcccctgtgggtcatcattcatcccagtgcagcactaacgctcatgatggtatcgcacgctgtctggagcagtgattcatgtagctggcgttgcctgatgggaggaaactggtggggaaaacgtggtggggggtcctgtgaggggtccagttacctcctcctcctctctttctaagcgcatcagctacagacccgcctcactttgtgagaggttgcagtttctctcttctgcctgtcaggtagtcctaatgcatggtgtgggggagggaggacaagggagaaagaggggcacagaatcttttagatcctgccctctttcaagtcagctctccacctctttttaaaagaaacaaatcattattattttgttgtttttgttgagttgcttttgtgtttgtctaattttagaaagaagtaaaatgttttcctctcacacctctgggaagataatatatctaaatttattagtttagtttgttcatttatttattgttaacttaaaacattcactcccgtgccatttactgggtagctgagtgggtgctggaaatgccagcttagaggctaaaaaggaaattcaaggaggaatggaattaaaatgtaaagtaatgccctcttatctacagtatcccctcgtatctaattatctgtctacctctattgaattatctgcctgtgtgaattttttgatccttgtaagatctctctgaacttgataatggttgaacttgtaagtgaacaaatgatgctcactgagtctgaaattattaaataacattggttgaacctctaccctgtaacatcttttgagctaaactgttccgagctcagttgtgccatttcatcatctgtgtgctcatacattctaatgggctgccctccattcacttctgcagcctgaatgcaggtaattttttctttttttttttgagacagagtctcactctgttgcccaggctggagtgcagtagcgcgatctcggctcactgcaagctccacctcccaggttcacgccattctcctgcctcagcctcccgagtagctgggactacagcgcccgccaccacgcctggctaatatttttgtatttttagtagagatggggtttcaccatgttaggcaggatggcctcaaactcctgaccttgtgatccacctgccttggcctcccaaagtgctgggattacaggcatgagccaccgtgcccggctgagaaaaatcttaaaagcaaatgcatttaattttaaaatgttttacttgagctcaaacaattaagatcatttgaaaatacttcgaaaattaataaaaattagaactgtaaactcaattagaattattattattgagttaaaaatgatgttgccaattcaaatggtaacgtcagttataacccgagtttgctgattcatttgaattctggttgtttgccagagtttttcagagtcataagatccagatagaaaatcaaacctcattctcagcattggggctttctaaagccttgtcagaaatttggtgactcgtgggagagcttatttttctccttttcattgagtcttgctctcaaggagttagttcagatcatcagtggccctactttgcccataacaagccttatgtataatttccacaaaactgcttccccagggcatttgggtgcattggccattttactgaagatttggcagggagagaggaattgacgtcacagatagaacccagctgaaattggatactagatggagttgctcttcaaagacttgggcattgccgctacggagcctgaatttcccacctgtcagttgacacccctttttgtcgctttatttcttcttgtcctcctttttcagggcttttcccttttctctgatccttccctcttagggtataaaaatcaaccttttcctactttaattaatttattctttaattttattttaacacagagcgactcatctctaatcagcttcaacagccaagtgaagtttggtgtctccatttgcatgttcaaggaagtagtctaattagaaatgatctctcgtgaggtctcttctgcctaaattctgggacaatggctatcctccttcctcatctgtctggaggtgaagatgggagtaggggaggcaacatgcattctaggtaccaaaggtagaggaaaggcaaaaccatccgctttgggccagacagggttgaatcctggcctcttcacttcctggctgggtgacctaggacaagttaattaagtttcctgagcctgtttccccatctctaaggtgggggataatactactttcttgcaagttatggaaaggatagaatggaatcacacacaagttgtagaaaggataaaacagaatgacgcttctagtgcacctggcgaaaggcaggcacttaacaactgttagttcccttttcctttcaactgataaacactttccttgagggttacataggtaaacattaaatatttatgaattgcataattcaagaaaaatgaaacttgaaaaggattcttcagattttttgatgaaacaaatcatcgtccccattgtcttttgtgcaaatctgtgtttttgtttgcagtgctgggtttgcttatgacatttgtgtgcaattctcagcaccgtgagacttgagtgagcctaacctctcttcacagcttgataggagttgtaaatattaggtactgatggtatgatttgaggcaacctaagtgactgaagcctagagccctccctgcggtattatttccaagtgggctcatcagagctgaattgataatgaagatataaacactggtgaaggctttgtggcttggtctgatggtactcatacggcacagtgaaaatggagatgctaccggtggaaaggactcaccatctgtctgccctctagagcagagcagaacatacctctgatgattatgtgaccactgtcaattaggctgatttatgcaaagacagtctgtacacatcccatgcagccagattttaaattctagggtgccaggttttgctagaaacagtggccggctgcggtcttgcataatattccatgttctcttagaggcagaaaagaatagactcacgacttgacagaaggtgcttttttcccctgtatcatccagtcaattgtctatgagtctgccaaatctagctcgcagcatctttttgtacaacccctgagctgaaaatggtttttgcatatttaaaagattatttaaaaaaagaaaaatatacaacagagaaccatatgtggcccaccagggctaaaatatttactatctgaccctttatggaaaaagttgttgatccctggttcagagtgtttgaaataactcagatgaaagaaggcaaaatgtaatgatgattgacttttccagttgtaatctgatttgtgacaaccactgtatgcctgttttaacaaagcttaatgggcattacttaggataaatgtaattacgtttcaatatttgtgtcttgctctccctacatagggttattccaggtttgcccaaggaacagagagtctgtttgttgttctagaagtagctcctgtgtctgtcacctcctctccaaggcttccacctgtcgcttttttatcccagttcacccgtgtgaacagcatgtgtttcggctgccatgacagcacgtcctacctttttccctggcttgaaagaagatggcaggggccagctcaggaagaactgctacggagttttttcaccttctcctgctcgtgatgaggctagggagggatttttagcgtatctttaattgttgccgaagtatgaactcggggaagggggcaactgtgaagcagtgatgcatagactaagtctcctggaagaagcagggcttgaattagacccagaaggatgggcaccgtttgtgggagggcacaggtacataagtacagggaacatgtcatggagtgtcctgcccagagtggggaatttatagcagtgtgagatgaaaatgggtcatcattgtggccagtttgttggaaattttaaggtgtatggaattccaattcagttatcatcaaggagtcattgtagcttatttttaaaaagagcgatgtgtgtgtgtgtggtgtgggggtgggggagagtggaatgacaatcatgaaattggctactgtttggtaaaccctaactgggagccagacatttggctaagggtgttacttggaccatctcatttaatcctcacaacaaccctgtggggaaggtattatctctagtttgcaaatgaggaaactaggctcagagaggttcaaacaacttgcccaaggttctgaagttaataacggccacagccaggatggctcttaactcctgccctgtggaaacaagctcaacgtaaaacattcttacaagacagaaaagagtgaaaaagcaaccaaaatcctgccttgcggaaatgcccactttgggtgaacattcttctagacattttttgtgtgtgtatatgcacagaaacttgtaacattttgcataatctgggccaccccatgcctgcaagctttctataaatgtcaccatattctataccctagcgtttcccccctatttaacactaattttctgattttcacaactgggtgcatagtattttgctttgggatgctaccatcatccacttaaccagttctctctagatcactgcaggttcttgagtaggggaataatgtattggaaccttttttttttttgaagaaaaaaaaaataaacaacttttaaactgagtcttatgctttttccctttctttgcagcatgctcttgatgctgacaatgcgggagtcagtccaataggaaactcttccaacaacagcagccactgggacctcggcagtgcctttttctttgctggaactgtcattacgaccataggtacccgtttgtttgctaatatctcttcctctgcaggtcatcttgagtaagggcgcttagtcagtgttttgtcctcatagcatacactatagtttgaggttcagaggaggcttacgaaacactgtcgtttaaattaatgcagtcattgtggtggctttcaacaaaagccaaagcataatgaagtatctctttttccagaatgaaaggctagcaaacctaatgaaaaggttagaatggaaaatatgagttggtcggttgaactcgggttactcatttgagctcaacttccattttaaaaattgtacttcttattaaagttatatagtaaggaaccaaaatattctacaaaattttttataaaaaacagtaacattctgaccgtctcaccttttcttaccttcccagagactgttgctttcatctgttttgattgttgattttaacactcatccccatgtctttaaatatcatgcttgtgctacttctggaattttcagttttggggattttttttgactttccattgtggaagatgaggagttagttccttcttcctgcctgcctcatcacagaagggctcttttcctgtcctcctgtcttcccaatatttaattagatagaagtgaaacatctgcatgattttgactagataaatgctttctgcagctgatcatagagtgaacagtgatgacctctttcctgtatcagtctttgtcttattttttgtatgtgtgtcttttttttctgacacttggtgagttttgtatttttgtcttaggggttaactttatttatttatttattttattttattttattttattttattttattttattttttgagatggagtttcactcttatcacccaggctggagtgcagtggtgcaatctcggctcactgcaacctccgcctcacgggttcaagtgattctcttgcctcattctcctgagtagctgggattacaggcgcccaccaccatgcctagctaatttttgtatttttagtagagatggggtttcaccacattggccaggctggtctcaaactcctgacctcaggtgatctgcccgcctcagcctcccaaagtgttgggattaccggcgtgagccaccgcacctggcctaggggttaactttataagtataatggcatataataattttagtgttctattcgttaaccagcatgtattcgatccctataacgggtgatgatatctcttttctctctttttccaacacaaagttttggtggacatcatcttttaaatgattaaatttgcttatgtttctcttatatgatttgccagctttaaatgataactcttggcactcagctattacatataaggcagtcagtgaacttagcatctcaatttcctttccctcttccactatccactcttattcatggtgtcattctatataagttgtatctcactttattgtgctttgctttattgtgctttgaagatgttgagttttttttttttaaacaaatttaaggtgtatggcaatcccgcattgaacaagtctattggtgccatttttccaacgtcgtgtgctccactctgtgtctctgccacattttggtaattttcacaatagtttcaacctttttcatttttgattatatctgttaaggagatctgtggtcagtgatctttgatgtcatgattgtcattgttttggggtgccacaaaccatgccctttgaagatggtgaacctaatcaataaatgccgtgtgttctgactgttccaccagctggccattcaggcatcccagatccctgaggcacaatggtattgaaatttggccaattaataaccctgcagtggcttctcagtgttcaagtgaaaggaagagtcagttgcatgtctctcattttaaatgtaaatctagaaataattaagattggtgaggaaggcattttgaactctgaaacaggccaacagctaagtctcttctgccaaacagttagcaaagttgtgagtgcaaaggaaattttgtgttttattttttttgagacaggatctctctgtgtcacccacgcaggagtgcagtggtgtgatcatggttcactgcagccttgattcctgggctcaagggatcctcccacctcagccccctaagtagctcagactactagtgtgcatcaccattcctggctaattttttaaacatttttttctagagatggggtttcactatgttacccaggctggtcttgaacttctgggcccaagtgatccacccaccttggcctcccaaagtgctggaattacaggcatgagccactgttcctggccaggaaaaattcctgaaagaaattaaaagtgatactccagtgagtgagcacatgaatgataagaaagtgaaccagccttattgctgatatggagaaaattgtagtggtctggatagaagatcaaaccagccacaacattcccttaagccaaaatctaattcagagcaagcgggctcttttcagttctataaaggctaagagaggtaaggaggcttcagaagaaaagtttgaagctagcagaggttggtttatgacatttaaggtaagaagaccttttgataacataaaagtgcaggttaaagtggcaagtgctagtggagaagctacagcaaattatccagaaggtctagctaagaaagtggctacactaaacaacagattttcattatagacaaaacagccttatattacaagatgccatctaggactttcatagttacagaagagaagtcaatgcctggcttcaaagcttcaaatgataggctgactcttttgttaggggctatgcagctggtgactttatgttgaagccagtgctcatttaccatccagaaaatcctaaggcccttaaggattctgcttgccttctataaatggaacttcaaagcctggatgacagcacatctgtttacagcatggtttactgaagagtttaacctcactgttgagatctactactcagaaaaaagattcctttcaaaatagttctgttcactgacaatgcacctagtcacccgagagctctgatggaaaggtgcaaggagataaatgttgttttcatgcttgctaataccacatccattcttcagcccatggatggagtaattttgactttgaactcttattatttaagaaatacatttcataaggctgtagctgccatacataatgattcctctgatgagtctgagcaaagtgatttgaacatcttctggaaaggagtcatcattgtagatgccattaagaacatttgtgatgaattggaagaggtcaaaataccaacattaacaagagtttggaagaagttgattccaaggctcatggatgactttgagagcttcaagacttcactagaggatgccactgctgatgtgttggaattagaagtagagtgtgaagatgtgactgaaatgctgcatctcatgataaaacttgaatgaattaggagcttcttcttatggatgaacaaagaaagtgatttcttgagatggaatctgctcctgcctggtaaagatgctgtgaacattgttgaaatgacaacaaagaattcagaatattatatcaacttagttgataaagcagtggcagggtttgagaagattgattccaatttgaaaaaagttctactgtaggtaaaatgctatctaacagcattgcatgttacagagaaattgtgaaaggaagagtcaatggatgtggccaacttctttgttgtcttatttcaagaaattgtcacagccaccccagccttcaacagtcaccgccctgatcagtcagtagtcatcaacatcaaaggaagaccctccgccagcgaaagcattatgacttgttgaaaactcagattattattagaatttttggtaataaagtattttcaagttaaggagtatatatacattttttagacctaatgctattgtacactcaatagactgtagtagagtgtaaacataacttttatatgcactgggaaacaaaaaagaaaatgtgtgactcattttattgtggtggtctgaagtctaactcacaatgtctctgacgtatgcctgtataacctcagggtatgtaatttagattttaatttgttaccctgatatttgcatttgttttagtcgtagctctatagttagatatcattaatgttcatctctagtccttttgctgtggtttatctcatgatcacttacttggctgaaagtcatcttcaagtagttgccttaagaatggctcaggggagcaatattctgtgagatcttgcattgttcacagttgtagcttaacatttgaaggatagttgaaacaaaatgaaatccattttattgactcacattttctttttcttttttttttttgagactgggtcttgctctgttgtccaggctggagtacagtggtatgaacatagctcactgcagtctccaactcctgggcccaagtgatcttttggcttcagcctcctgagtagctgggactacaggcgcataccaccagggctagctaatttttaaaatattttgtagaagccaggtcttgctgtgttgcccagactggtctcagactcctggcctcaaaggatcctcctaccttggcctcccagagtgctaggattacatgtgtgagccaccacgcctggctttacattttctttttaactggtctcacaggtgttgctcttctgtttcccagtttttatgcagctgttgggggaaacctgatgccagcctttttttccccacttttataggtgactttatctttttgttcagtgacttaaaatattatttctctttcatctgataacattactaggttttgactcttttattgcattaaagttttcttgattgacatctttaaacattttctttgctgtgtggttttggttttgttctttgggagattacagctatacatatattgtaacttctttgctcatcttctatgtctctcatttctcttctactttttaactcttaaaatctagttttcattttgttaattttattctccctattcctttagtttgtatgttttccacaatgcctgtgctgccatgagctccttccaattttattttttgtttttgtgatcaatagggaattttttccttttcctgtttctttcctgaatttcatagctcacatttcatcttcacttgttgttccatttttccactgatttcttgaatttctactttttggcttctctgtgaagattcttagagatgattatttcatacttggtcacaatttttgtctgattttggaaacatttttctggtgagcctctttccatccattggtaagttttgctactcttttcacattttttttcttatggaagttttatatttatgctgggtcaacttctttttaaaatacctggccccaggcaaactggatattcctggaccagctttctgccaaatgatttcatggagttggggagaggagagcagggtgagtcagggtaccaccttccagacagcacatcctaactctcttcatttctgtgacagagtgtttctgcaaatagggtccttctgtattatttctgtcctacctccctgttttctgaaccagatcaagttcagggtggcttctgctgctctccctctttatcctatgtttcatgcttggtaaaaacagggacatctcttttgaagttcagagtgagaccctcccctttatacttggatattttcggatactttctgaaatttaccactttagggccctgtcatcattttctgagcttcttctttttattttttgttcatatggcttctgtccaatctccgcttcttttggtagttcttacacatatgctggaatctctggattatatccttcttccagctctgctgaaaatgagtttgaggattttctgcccacatacaattgtgaagtagcactgcaacaaaaatcttcattcagaagcaggagagacacccagcagtcactggtccacagcaatgagggacaggcattgagaggctcccccgccctcctggtgggggaaattccttcattcaaacttgtttatactctctaggaggaactccctgccttattgctctctgaagcccagctatgccttttgagaggttctttcctctgaggcacagttttgacaatcaacttcctataggcgcaaatttcagaggctaacgattggtttagcggcacaggtttttgcttttgttttaagatctagccttcaggacctatgttgtttctaggtgaaatccagaaagtcatatgcaacaagaacattttggatgaaggaaaattgccattgttatttagaaacactcttaatctaattatatgacatgctaggtttacacttgcaaatctgcaaatatattggtgttagctattaaaagtattcaagatgcccatgacaccagtgggtctggggcttagaagccttttctggcactctaggccaggttaggtcagcttaatccacagactcacagcgtccaacaaaggaagctgggtggcctgacaccatttagtatacgggcaaaaagtgttagcaacctgaacaacaccagagggcgttgctgtagtggatccaagaagaccaatgtcaggtttcattgtgttcagcagattgttaacctgggaaaaagtgtcacgcattgtaggaggatctattgtacaccaattaaaattgagaaagtctgggccacttcaagaagtacattttggaaaatgctctctgatacccggtattggattcatgagacattagtgtgtatattgaaggaaactcctaattttcttgtttcatgacatggctaaatgaatgatctgtctgctgcattgaaaaacactatggctacattggaaggtgcattaatggtatttattgtgttagcttgttaggaatccaggaacttggtttattgaacaactatgtttattgatccacataatattatgtgactgaggaatggtggctccatctgcctaatgaagaacgtttgatatgcgatggtttttgcccttttttgtgtgtgtgcttacaccggaatctttgagtttgagcaaatggctcttagcccttggattctgttgcctggattccattcacttactcacccatgtcctcattgtcatatccccagtggttcccttccccatgctttgtccccaggcctcaggtgaacaatcaccttgtctagactaagaaatccagtgcttggccacaattattagttcaaagatggacatatgatctggattaggggcttttgccggagctttggaggaaatgacctctctttcttactaaaggtaagtctggaaagagacaggcctaaggcactgccagtcatttttttccccttgggttgttctgcctagaattcatcaaacactaaagaagcagagtgaagaaaaggagtggtgaatggggtcttgtttacatcatttgagctctggatggtgctacccaggaagtgttaagaaataaatgttaaacccccttctatttactggggtcaatatattttctttcgttgtttaagcgagtgtgcgttgagctttctattacctgcaagtgagaacatcccaatacatgctttgggtcagagctcatgcagggccagtgaatatcctctgacctccacagctagtgactgagcctgctggctgctgcagctgccatctgtcatcatctttgagccactgactcttgatttaaagtcttaggcagagccatcctatttgttcatgtgcacacatcctggctgcctaggagctgtttcctctgtggtgggaggcaggacactgtgtcataccaattatgcacaggaaggggggctttcccaaaaatcagaaggaaggtggatgctgaacaggaaactactgcaaaacaaatgtgcatcaaaaccaaaagtaaaatgcaaagtccacttcagtatcattgtacagtgttaacactagagatagggtccttgttctatttaatttagaaaacacaattttctctctcactctttctttcttttaattgaaaaataatgtattgtaagttgagcaccatttagctggctaaattttaactccagagtggaggatctttatagagtcatacagttagagaattccaaagaagcccttaatacaatgtaagtaagaataatgaggtgcagaaataattgtttttccagttacttagtggtaaattcatttgttgcatgtggtcgcaaggtttataagaaaactcagagcccagcaattcttccagttcttcctgagcaattttccactagttaggagtcaggaaagaggaaccgtgagagctgaggagctgtgtatttcattaattgtgaaatacacaaatattggcctgttcccttgcgatcataaaatttgcaacgtaatattgcagacatttttgcatattactaaagttctttgaaaagtgtattctttgatggtttctattggatccactattcacactataatcacatattcctgggaacttaagctgtttctattttagtaatagtgtaacaccatggtgttaacgttgtgaagtgtggtcttcatctctggttgttgccttggaaaggttaccaagggtttgctctgtcaaaggaaatgaaaggcttgccaaatttctttccagaaaggctctcatgagcagcttaaggttatgtacttttcagacataaaaaatgtgtttattaggtagaatgtgtatagacacactttgtgaataatagaatcttttctgaaaagcagcgctactccttagtatcagagatcccttttatctgaggatatcaaagcacttctttttgaagaaggtttttcttgtgctgagatatatggaaagatttacaagtgtatagcaaacggaataccttcaggcacttctccagaccagtagccacgccagaaggaagagcagactctgctctgtcaatgacagggctgcactgcaccctagtccctttctcagtaactaattcaacgtgagaaagtcccacctgcctttgattattggctcagctggtgggtcccccgtaactagcttttctaagctggatgaatgatgctcacttctatgtgcagatgctttttcacaagctgtcatttgtagaaggacagcgagcgatcaggttcttaccaatatctgtgaaatgcgattagattttagtctgtgaggcattttcagattgagccacctgactctgcccacatcagagagagagcctctggtcaggaccaggtggtagccagtcactgcgtcactagcctggcagcctcatttaagggttgtccctatcaaactatcgaggcacctgttggtacttacccagcactggattggatgtttattttttatttttatttttatttttcagagaaggggtattgctttgttgcctgggctggagtgcagtggtgtgatcatagcttactgtaacctcaaactcctagctcaaatggtcctcgcgcctcagccaaccaagtagctggaactatagttgtgcaccaccatgccgggctaattaaaaaaattttttttttgtagagacaagggctcacaatattgttcaggctggtctcaaattcctggcctcaagtgatcctcccaccttggcctcccaaagtgctgagattatgagtgtgagccccacttgatttagatgggatgtttaacctgtgcctttgaaaagagcaatcaccatggctaacatttactgagttcttactagttaacgtgcattgtgctccacatacattatctcatttaatcctgcataaccacatgaggtgggtactgttattagcctcattttatctatgagaagactgaggcccagagaagttaaataacttgcccggtatttcatagttagtaagcagtggagtccagctagattcaccaggaccagctacataatttgtggcacccagtacaaattgaagtggggtcccttagagcattaaaccaagcacaggacccatctaagcgtgggccctgtgggactgcacagggtgcacatccataaagcagccctgcctgcgcagacagactggtgaccataataagaaagcacactctcaactaaacaagtagggctgcacaacacacagttgggccaagatttgactttggcacgtaaacagcaagtggaagcctttgtgtgcactcctcaggcacaagtcctctttaaatgccagctttctcttcctgaaaaacggggaactcttttctagccagaggtgaacagatctgagctcatcctggtgctgtgcgttcattacagcctccccttggctgtttgcccttgtggagttggttgtcttctgctgaaagtcaccacctgatgctgtgggtgctatgggagaacagtgaagtttctggagggaagataggaatcaaccgcctgttttctcctgggactgagttttcctggagacatattgctcagaaacaattccttcccacagtaaagcacaaggcaaacggggtgcttagtttgcatcatatttcacaggtatttaatcttcacatgtaactcttgctttgcatgtaactcatttaatctttaatagctatgggtaggcactttaatagccttgtcttttgatgaagaaagtgagggagagagattaagaatgtgcctatgacctgagagttggtaaatagaagaatcagaacagaaatctgtgtagtctctagttctagagcctacagacaactgtcacaccttacttcaaagttctacccaagcattctagaaggatgagcagggcagtcagagaggcggggtgtaactagatccccaaatccagaaatgtggtcttcccattgcctcagagcaaagctccaaagtgtaagtgctggaattttcccagagtgacagtgttgagggtcaaacagtctctccttatagttcaccaaaggcatggagcacaaatacactcacacacacgcccatgcatgagatacagcatcactcaagaatgatgactttctgtccactgggcagtgtgtcaccaaagaaagatggctgtgaatatatttaaaggcttgtttgagtattgcatcactcatgctcttacccaagaacttagctttaatattatttttgtgttctagtcaacaaaacactgaacaaataaggaaccaattgtgataatataataataataatactttgcattggtacagtactttacagtccattgatttttttctccctgcattttccttgagtacctctgacactaggatttgcagatgttaagtgggtctaaggagaaccaggtagtgtgaggtggaatttgatccagatctttcatctcctcacttctccctgatgctccgtggtaagccacagtgccttacccaggaggtgggtgggggtggtcatctctgaaagctggaggaagggggtgtagcacttgtcaggattaatgagatgcctgttcatccagttccaagcctccacttgtttgcctatgtctgcaatatatttctttctgagacacttggacaacctatattccccaaagttaggctattgtgagacagtcaagctggggtcttcagtgttttcacaagttacttgaatgtttccaagagtcaccataaacctgcataaagtgaaactgtagaggctcatttatttccttttcaatagggctagcttaatgtcagctcgaccattctagaggggtattcttggaaaaatgattttgtccaagttcctgaaagtacctgaaaaaagttctgagagcttttttgcatatttaaatcaaaatcctggtgagtaaaggaaatacaagatgaggaagcctagcctgaacactcattttagaaatggaagctgtaatttagattattataagaggtttgaatgattcagaacagaagattgcaaaagaaagtatccaggtgactcattcccgaaggcagaaggcaaccgtgagttctgcaggcctgtgggtggctgaatgatggactaaccatcaacgtttttttatcatgttgcattcccaacctgtcaataaccatggacccaataactcactcattgaatggattcagaaacaggccccacatgatttacccagatttgggagaatggttagattactgtctagatactttttaacataagattgtaatatcaattggcacaaaaatgaatattaattaatttagactttcatctccatataaagtgtgctaatgctataggactttttcttccagcaatactttctttagcctcatccatatagggtaagcccagtactcattgtacataagttacttatgtaatggcagtactcttaagattgctgcgggtattttcaaagcactatttgaaatacatattagtagacctgactataaaaagattctcttgtattcaaacatccatcaataaacttttagcatcttattaccctcaatgcaagaggtagttgggcggagaggtaggactcagagatgatgtggagttcccagtaaagagaaaaaaaaaccagatggggcgaaacttcactggcggtggggagagacagcacaaagccttcccttccctattctttcctgtttttagacttcccagggtaaggctgtacaattcatgagtcctttctaaccttgtactagaccacatttcctctttaatatggggtacccattacccttcaagacagccacagtcggtccaggtggagcccatgggtaagactgtgaaaaagaagctcttgtcaaatctaataagtgcagtggtgattccttcccacgcattcaggtctcgctaaactagacatgcccatgatgcttggtgtttcagaaaaaggtggtatcactttttgtcagaaatgaaaatgaaagttctgagtgaccatgaatttcctaaaatgtgttaatatccaagaaaccttaaaaccgtttataaggggagaaggaagagaagcaatggaacaatgttgcgaattgtagagggcctttgaaatgaagttctactccctgaagctcataaggtgggggaatgtacaaacttttaaaaaagtctgtgagttctttggtcagtatgctaatttctctgccactctccctctttttcatatttctcaccagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgagtgagtactgtgtcatatttaaattctaaccactgtgatccagttggctttagcctgacaggatccaggaggcagtatcaggggcattgtctgcttttaatggaataattttaatgttatgattgtattttctgttttggccaatggaagtcaaacatcttgcacctaaactcccttctttgagtagcttcctattttagagtgatatttctgcaatcacaacacaagagggttaagtatggatttgccaacacagattttttgaagaggtgagacaagttcagtttctccttcaagatggaagatggggttcctcattgtgtttgtaatgatgtagaaaactgtaaatccatccattttgttgttggaactcccttactccgttttattttcaagcacagtgtctttaggctaatcctgcttcttccagaagcctgacttctccagacactgctctgtgctttgcacctgtctcctaatggtctctctctctcccatctctcactgctgagtgctccctcagaaatggcatcctgatgtactacttcctactgaactgttgatgattgctattgccttagtgggttttttcctttctggaatatttatctttaaacaagagacaactatctcaactcaaggaatttatttactaaaattaaaattaattaataaattattcctggcattagttgcaggcatgagtggctgagtgattaaaccggggttcccaatgccctttaactcgcactcatttgtatgctttcacagaacacctgttttgctcagatgtaaggtcacttctgccctcttactcaccgctgacctaattctcaagtctttcaaaccttcctcagggaatgctttcttatgatgacttaatatttacaaatgacattctgaggtcttttccaggatctaggaatggtggccaaaggcagatcagctggaagctctaaagctgtgcttttttccccctctaagaactcttaaactttgagttcaaggctgtctctgcaataatggctcatacttctctttagaagaatgcaagggagctttcagatgagcagtttcagaggctttttaaaaagagtagaatgggaggaacgaggcaccatagctgggtgagccattttataatctcactgatcctgggtcagctgcctcagtttactcatccacaaaaggggatagaatttgaatctactttgtcaggttttggtgatgattaaatgaaatgatgtgtggaaaagagcttgtcatatagggcagacatatagagcccagggcttctgtgtttctctccaagagaagccctcatgggcaggctagccactcatccgggtttcatctgaggagctctgtggtgtgtgagttttactggaatgtcccacagcctttgctccttcatgctggctggccggtggcctcattagaccgtgcacctgggctccccagtagtctccatggaaaccatcagtgctcagcttccctgcttttcagatgtttagttcttcctaaaccagacatagcagccctgtctccaagaactcttttgaacttcttggaagcacccttttagctgctgcctcatggccctctgacttagagaaaaaagaatctggtagtttgaacactcagaacaggattcaattggggaaatgactgatctggcatttttatttttatgtagcttctttagagctcagtttccttatttgtagaagaaaggattggactaaaagtttttgaaatcctccttagcagaaaaaattctagttactatatttgaagtgatggaagaggttgcaatcatctggacatctgctactaaatttagggacttagtctcccctaatgaatttccgactacaaatagagtatatggttctccttccccttgaagctgcgtctcaaatggaccatcaacagattctgatacagagccttagaaacctttatgctgattgtccactcagctccttgcagcgccatcaaagatcaagattcttttaggaaggcgagacagttgcatattattgaattggcagtgcacaatgaatgcatttgctgagtattggagggtgctattggaaagggtgaccgaattccagggggaatgtaagcacacttcctaaatatacgaacaactgatcctgcagcagtttgcttgctgcatgtaaagttttggtagaaaatctcagttttctgccattgatttaaactacatttaaaagtccaattacgtttaggtggttatttgagaaatgaaaattgtataagctaacaaagcttggggttgtgaatttttagttctcatgggggaaggtttatgtatttcttctgctcaatgagtgttaagcccttctcttgatctgttatgttttctctcagctcttgggaagagaggatttacggtggagtaaaaataaaatctaaagttggctttctgccgggcatggtggctcacacctgtaatcctagcagtttgggaggctgaggtgggtggatcacctgaggtcagaagttcaagaccatcctggccaagatggtgaaaccctgtcagtactaaaaatacaaaaatttgcagggcacggtggtgcatgcctgtaatcccagctacttgggaggcggaggcattagaattgcttgaacccaggaggtggaggttgcagtgagttgagatcgtgccactgcactccaacctgggtgacagggtgagcccctgtattaatcaatcaatcaataaataaagtaaatataaagttggtcttcaagatgcctgaatcctgaggtgaccctgttttgggtccttccaacacatcccaggtctgatcctcattttaaagaattgctgagggatattggattacttagaaatgcttttggttgcagaataataaaatgcctgactattggagtttttatgacatgaataaataagaattcttctcctctggagttcagaactaactgtgaaatggaggagtcagatggagatcaaattgccagctttattgcttataagctgatcagagaatatagctttagctttgtttccgaaagggcttacagtcactttaccctgaattaggaccttgctgctgcattagtttttctattgctgtgtaacatatgactacaatcatagaagcttaaaacaacacttttaaatggccttcttgcaccaccacttaaaatgtttaattttgctctcagatgatgttcagaaacaaaggaaaggtaaaagtaaaggtgccaaattatttgcagatgtgcataaccaaacccaaatgaaactaaaataagaatgctcacaattttctttttttttttttttaagtggagatgggatttcactgtgttggcaaggctagtctggaactcctggcctcaggtgatctgccctccttggcctcccagagtgctgggattacaggcgtgagccaccacgcccagccacacacatttttttaagccgggtgtacagaccaaataacatattaaactagatgtaaagaaagaaccaaaagtgaattcaccagaaaagacatgccactaagacagaatgtaaattctgtagaaaccagagtactcaatgcagaaggatacttttctaccagaaagtgcttgccaacaaacaaacaaacaaaaacgccttttacagacccaagagggatgcaaagttctttacttaaggcaccttttagccaaatcaaatcacatataaagtcaaaaagaactcgccaaagggagggagtctgagaatctgagaggagagtcacccagacagaagaggcaacagacagaagcagagagcagaaagggctcagtcagtactgcactcagttccagggacctctcattcctctgaggtgcactcactttgatcccacttctgacaccatttatgtcaccctaaataacatacagacagaggctcattgaaagaaaatgatatttactcagggatgggcattgcagtggtaacatacatgccagtttaaactatgtgtgcattcagggaggtaaagcaaaaaaaaaaaaaaaaggtttttaaaggaaaaatgaacaggattacataattgttttgagctaattatccttgaatacaaggatcaataacaagggtgatgccagtccaaggttggacagtcagttgctgggtagatgtcttcgcagaaatgcttttctgcataacgaggtgatgggttttgtgcaaggttgtagtttttgcagtcttttatgatagctcttgtaatcaggcatttgtgcatgagaatccttccttcctggctttccctgactctgtttgtcagagttttaagcacaagtaaccccattttgattctgacaattttcatgctcccaacactcattaacaatgggttaagaatttgaacccttatctcacatagcaagaagcctggaggtacgttgactcaggcttgtgctatcagctccacaatgtcaggtgtatccagatttgttacctctttctgctctgttttccttggcatggtagctcttcatcctcagacttgtcactcacattgcaagatggctgcttcatgaccaaatagcacgttttcacccaacctcatatcaggaaatacaaaaggaactcccttaaaatttatctttttttagagcagttgcatattcacagcaaaatggaggggaagatacagagatatcccatatccccttgcccctacacacatgtgcagtctccctcattatcaacatcccgcaccagactggtacatttgttacaatttatgaacctacattgatgcatcattatcacctagagtccatagtttacattagggttcactcttggtgttgtagagtctatgaatttggacaaatttataatgacatgcgtctaccattatagtatcatacatagtatttcactctcctaaaaatcctctgtaccctgcttgttcatcaatcccgttctcctaacctttgacaatgactcatgtttttattagttttgtcttttccagaatgtcattaatatggtttggctgtgtccccacccaaatctcaacttatatctcccagaattcccatgtgttgtgggagggacccagggggaggtagttgaatcatgggggccagtctttcctgtgctattctcatgatagtgaataagcctcacgagatttgataggcttatcaggggtttctgcttttgcttcttcctcatttttctcttgctgccaccatgtaagaaatacctttcacctcccaccatgactctgaggcctccccagccatgtggaactgtaagtccaattaagcctctttttgttcccagtttcagatatgtctttatcagcagcgtgaaaacggacttatacagttgtgtagttggaatcatactgtatgtagccttttcagactggcttatttcacttaaatatggataaaagtttcctctatgtcttttcatggcttgtagtccatttctgctgggtggtgaataatattccattttctgggtgtaccatagtttatgtatccattcacctactgaaggacatcttgtttgcttctaagttttggtaattacgaataaagctgatataaacctctgtgcacaggttttttggttgaacattagttttcaactcctttagttaaatacaaagatgtgtgatgactggattggatggtaagaatatgcttaggtgtataagaaattgccacactgtcttccaaagtggctatacaattttgtacttccaccagcaatgaatgacagttcctgttgctccacatcctcatcagcatttgctgttgtcggtgttctgaattttctcaattctaagtgtgtagtggtatcttgctttaatttgcatttctctgatgatgtataatgtggagcatcttttcagatgcttacttgccatctgtatatcttctttggtgaagtgtctgttaaagtctttggcctattttttaattgagctatttgtttctttattgttgagatttaatgtataatgtgtaatgtattattattattattattattattattgagacagagtctcactctgtcacccaggctggagtgcagtggtatgatcttggctcactgcaacctctgcctcccaggttcaagtgattcttctgcctcagcctcccaagtagctgggattacaggcatgcaccaccatgcctggctaatttttgtatttttagtagagatggggtttcactttgttggccaagctggtcttgaactcctgacctcaggtgatccacctgcctcggtctcccagagtgctgggattacaggcatgagccactgtgcctggccatattttatatattttgaattatattcctttatcaagtatatcctttgcattttttatctagtatatcctttgcaaatattttctcccaatctgtgggttatcttttcattctcttgatagtgtctttaacagagcagaggttttaattttaatgaagtccagcttatcaactatttctttcatggagcatgtgtttgttgtatctaaaaagtaattggcatactcaaggtcatgtagatttcttcctatgttaccttctaggagttttatacttttgcattttacatgtaggtatgtgatcacttttaagttgatttttgtgaagggtgtgagctttgtgtctgcagccatattttttgcatgtgtatgttcagttgttcctgtgccatttgttgaaaagaccttttttttttttctccatgttgtcgcctttgctcctttgtcaaaggtaagttgactatatttatgtggttctattttgggctctctattctagttcattgacctatttgtctattctttctccaatatcatactgtcttgattactttcgctctatagtaatttttttttttttttttttttttttttttttttttttttttttttttgagacggagtctcgctctgtcgcccaggctggagtgcagtggcacgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatcttctgacctcgtgatccgcccgcctcggcctcccaaagtgctgggattacaggcgtgagccaccgcgcccggccacgctctatagtaattcttaaagccagttagtgtcagtcctccaatttttttcttctttttcaatattgtgttgacatcagctccttttatggaagaaaaatctttcccagaagttaccctgtagatttccccttctgtctcattgaccagaatgagatcacattagcatctgcaagggaggataggaaaggaagtatcggacaaaggacgatagtattgccataatggaccagtgattctcaaagtttggtccctcaaccttaggcatcagtatcccttggaccatcggcatcggcatccactggaaacttgttagaaatgaaaattatttgtggtcgtggtgggggcggtggggctggagctcagcaatctgtgtttaccaagctgtccaagtgattccaatgcttaaggagcagaggaatcatgtttcatctcttggggctgaacacattgctgtgatgaacaaaattagaattctgttagcgaagaagttggagtaagcaaatgataacgtctcacatagatgtcaattaactgctagccactgagatcactcatagagaagatgtcttcactcttccttgtcataaattaggtggctgttgggatccttgaatcaatcaagataagctagcctatcacaaacagcctactcccactcctgccagatctgctgcaacccaggcagcttctcaggctcaggggctagatagggtgggggaaacagctgagcgctgcttgctggctcttcagagcgttgtccctcaggtagagcccattggcccgagctagttaccaggtcccattcgtagctgcaaagggggtttggaatgcattcttttatctccaagaatagtagtggatggtaaaattgttgcgcactggtatagtcatgttcatatgctctaagatgcactcctgggtcccactctagggtgaccagcctttcaggaatttagttccaggtcgtttgtgcatcactcttcggggggaatactactattgtgagactcatagatttcacacctgagaaaatggagcctgtgaggtgacttgcctggatccacacagtgaattggtggtaggacctggattagaaccactaatcctgccttaacctcttccagatgggctgaaaatattaatgtcagattaatctacaccatgaaaccaatgtggagtttagaatattttagtataccatactaattaaagtaaaaataattcttcctgagttcccagggaaatatctgggcagttagcatcccaaatatctgcttatttgggatgaaggagggctgacattggattctgaagcaggttttggaagcaggcggcctctttctcccctgctgtggggtagctgtcttgctgggccaggctgattatcacttgataggatgctgtaggaaaaccagtcaaattctggactgattctcattttcttggctccaagctggactttggcctctggtaggaagtacctgcttctttttttccggctcggatcagcaggctttctggtatttcctgtaaaaccaagggacacctttttttttttttctttttctttttttggctttccccccgccccaaggatatggcagaaatgtttatttgcttatggatccaaatgattctgggtgtcactgacaaataataaaacattaccctagacttacgagtgccaaaattacttggaaaatttagaacaggccacatgtttaagatggaagtgatgacaatctcaaagtgctaatacggttaaattagtggactgatcaaccactttagattccaggaaggggcatgtggcggaagccaaagactcctgcaggcctctgccatgtgcctggcatggatcaaggagaggcttttaagaacacaattggcaggaagcttctgtttctcccaaggcatctttgagctagcattcagcagcaaaagggttaacttaaaataattactatttcaagaggcaggcgcagtggtccacgtctgtaatcacagctctttgggaggccaagacagaaggattacttgagcccgggagttcaagaccagcctgggcaacatagtgagaccccatctctgaaaaaaaaaagaaaatcgagccgggcgtggtggctcatgcctgtaatcccagcactttgggaggcagaggcaggcagatcacttgaggtcagcagtttgagaccagcctggccaacatgatgaaaccctgttcctactaaaaatacaaaaattagcctggcatggtggtgtgtgcttatagttctagctactcgggaggctgaggcaggagaatcacttgaaccggggaggcagaggttgcagtgagctgagattgtgtcactgcactccagcctgggtgacagagtgaaactctgtctcaaaaaaaaaaagattcaaattacttgggtgaggtggtaagtgcctatagtcctagacactcaggaggctgaggaatgaggattgcttgagtctaggaggttgacactgcagtaagctaggatcacatcactgtactctagtttgggcaacagaatgaggccctgtctctaaaaatatttttaagtaaaataaaaaaataaaaattattatttcaaacagatcaaaatccctgttttggaaactgggtattattttcagcattgtaggttcagctacagtttccaatacctattggtaatgaaaatgttcaagggtcttggctgtgcacatcagcattgcacccaaagaggcaggggaggagggcagagtggtaggctgtggctttagtttaagaaatggctgcctttcagtagtgtagaaaagacacaatatcagtgaacttcagtttaccagtgcccatatgtctctggagtatctgcttctatgtcatgcctgccctagtacataccatattataagttcctaacaactaactcagtaggattaatgttacataataatgtgagtttatttatttatttattgagacggagtctcactctgttgcccaggctggagggcagtagcatgatctcgcctcactgcaacctccgcctcttgggttcaagcgactctcctgcctcagcctcctgagtagctgcggctacaggcgcgtgccaccatgcctggctaatttttgtatatttttagtagagacgaggtttcaccatattggccaggctggtctcgaactccttacctcgtgatctgcccaccttggcctcccaaactgccgggattacaggcatgagccaccacgccctgccgtgagtttatttttatcagagagaaggccctggttttaatgtaaacaattgctttcttccttttcctaggcggcaagaaggtaggaagtaattatttgaaaatgcaaataattttaaagctttatcaatcaagtctgttccaaattagtttaaggattttctgtagctttaatgatagggccagaatgtacatttggggtgacctacatatatgacatccacaaaacagactacacaacatttcttaatgacagtccatgacagtttttccatggacggctccttctttcctcccttcatttaacataggattgctcagcctcgatactattgacattttggtctggataattctttgtcataggagttgtcctgtgaattgtgagatgtgtagcagcatccctgggcctctactcgcttgatgccagcatcatcactgcccgcagttatgacagccaaaatgtctccagacattactaaatgtgtcctcaggggcaaaatcgccctagttaatttgaccatagctatactgggatataaggggacaattgccccaaagactaccaggtgcatgccctggtcccctgtccaaatcttccacacgagctctggtgcctccaccaatgatcctaatcagtttttcagtgctagcgccattccgactcagaactctcctccttcagatgggtccttaaagagggctttgcagattttatactccgggaatgagatcatttctcaccaagaaagcaaaaatgcctggagacttgactctgatgagtacacataatgacaaattgttctgctattattcttcactaggcaaaccatctcagcactaactttaactgacccatagggacttatctaatgtatggttcttctttcttggcttacctttcataactggccagtatccctttggtgtttcctgttgtcttctgaggtcattatagaacgttttaatggcctttaaagtgcatcttcactcttttctatgcacagtaaagatatcaaacattgcctaaaatagaactacttaaaatactgcctggatagcgtttatcatttaaacattttccaggtagctttaacagagtctctctctgtctctctgtctctctctctctcttttccccccggcaagctttgatcacaggtaacttctgggaatctgattgttactttggggtgggaagttattcatgaacatctgcatgccagaacctttgtagggagccttggatcggtcatttgtctgagaggattttgttgagataatactgagtattatggcactgtgataccaaagcctagatataagtcactgatatggtttggctgtgtccccacacaaatctcatctgaactgtagttcccataatcctcatgtgttgtgggagggacccagtgggaggtaattgaatcatgggggagattattcccatgctgctcttgtgatagtgagttctcatgagacctgatggttttataaggggctttaacccctttgcttgacactcgttctctctcctgccatcctgtgaataggtgccttccaccatgattgtaagtttcctgaggcttcctcggccatgcggaactgtgagtcaattaaaccccttttctttataaattacccagtctcgagtatttcttcatagcagtgtgagaatggactaatagagtcgctaatctgttttgagggtttattatgccagatactgggctatctgggctttacctagagtaagctgtacagtaagttaccctgccaaagagatcattattgtttcttaattatatgagtttggaatgcttagactggttctgtgacttgtccaaggtcacacagcccataaatgacagaactagacttccaaacttggtctccctgccccagagtgcatgaatagacttagtcattccactatatgccctttcttctttctcttgcaatgtaggcatagcatctgatggctcagaggagccttcacaaaaggtttagtaagacctggggacagataaaaatggctagttgagagaaagatattgggcctgtcttcatctgctttaaaaggattttagttttctgacttcatgctctctctcagtgtgttgaattgcatcatagcctctggttctttatgtatctgctttagttccctaataccagctcattattagttaatatctctttctttgtgttctcttttcttggaggttaatctaagatttaggtgtccccttgctcatgtctgctgctatgtgactaatacaaagatgggtttatattctggtatcactataggacattaaaagtaatgtcaaaaaccacaattacttttgtaccaacctaataaaagaggggcctatactgtaccaatagctgacttgttttgacccacctctgcgagagcagttgccaggcaaagatagtccccactctgttcttccatccactgctctactttgtacaacctgcttaatgttaaaaacaggaggaaatgcacagctcaaagccaagcctcttggtgccctgagatagctggccttgtcctccaaagcattcttctttttctgggctcatcagaatgcctcaatgctctgcttcgatggttttaagagcatagagtggcttggtgtggtgactcaagcctgtaatcccagcactttgggaggctgaggtgggcggatcacctgaggtcaggagttcaagaccagcctgatcaacatggagaaaccccatctctactaaaaatacaaaattagccaggtgtggtggtgcatgcctgtaatcccagctacttgggaggctgaggcaggagaatcacttgaacctgggaggcggaggttgcagtgagccaagatcacaccactgcactccagcctgggcaacacgagtgaaactctgtctcagtaataataataataataataataataataataataataataataaagtaaaataaaaagagcatagagtttgagaccatcaccaccaagattttaattcccactggggatttaactcagtcctaaactcaaggtctgctatgtcaagtagtattaaatatctcttccttttaagagccattttagctctttcctcatatctttcagatttggctggttttccctaaggcttctgaaactcttaaaacatctctgatagaggaaactatctagaaaattttatgggtattcattatcagtgaggtctttctcattgaagagataatcacttcttagaatcccaggggtttcattaagtattaataaaaggttttatatttttgcattttggggctagtgaaagtctagtgatgctttaggtctacaacatggtaaactgtatttaaagattccaggtgcttttgagttatgaatttaatgcaagaattctattagcaatcacatttttactagtattataaaatcagcataataggtgaatgatttcctatgttcatgctttatcaccaattttcacaggttagtttggttcctctggaatgcactgatttaataaaatattaattctttgctctcttcttatagagaactttttaaaaaattatcgtaattttttttttctttttacatttagcctcatgttacttctgtgagccaagcaagcaatgacctactttggtgtagcttctaacaaattaggttcctgaaaattgagaggtgcccttattgaattgagtgtgctcatcacggagctgggtgtgtgatctatgtgttcactgtaggataagttttagatgactggcatgtcagtagtcattgatactttctagatagctttatgactttttgccttagggaagggaaaatgtttagaatacacatcattattgaaaggtgtgccagtgttctgaaccatcacaccccaaagagccagctcccctgggaggtgacagtgtgacaagcatgtgcagccccatgctgagcaggctctgatggctttgcatagtgaagggctgccaacaaactgcactctcctgaactgaatccagcccaggaaatgtgcattcctgttagaagtgcactttgtatttctgggggagaatgcattgctttgtattttctgagaggagctgcatttgtgcatcataagttttgacctaatggttttgcactatgtcttggaagtttactgctgagttttaggctcctgctcatagatagctgtagttctcatcctataggtggtggacccctaggagcctgaggtgtcgttttaaaggatcagtgaatccttttgtgtttcaagcattgccagtggacagaataaacaatatgtctccttaacatgtgtgctgcccttttccaaatgtgtgtagaggggttgtcatcaatgattcatttcagttcattttaaagggtgactcccgaattcatagtatctatagtatcttttttttttctttttttgagatggagttttgctcttgttgcccaggctggagtgcaatggtgcgatcttggctcaccgcaacctctgcctcccgggttcaagtgattcttctgcctcagcctcctgtatcgctgggactacaggcatgtgtcaccatgcccagctaattctgtatttttagtagtgatggggtttctccatgttggtcaggctggtcttgaactcctgacctcaagtgatctgcccgccttggcctcccaaagtgtggggattataggcataagccaccatgcccggcctctctctttctctctctctctctctcgatatatatatatatatatatattctcactatcagttagtaccaaaagttctattgttgtgtggggatcaaggatatttttaaccttcagaagggagtgccatactcaaaagttgagatcactggtctttcaagttagcatcaatttccatgacattctgggctttcttttttctgtggatttaacattttcatcctggccatagtcattgttacaaagattttttttttttttttttgagatgaagtctagctctgttgccaggcttgactgcaatggcacgatctcggctcactgcaacctctgcctctcaggttcaagcaattctcctgcctcagcctcccaagtagctgggattacaggcacctgccactgcgcctggctaatttttgtatttttagtagagacggggtttcaccattttgtccaggctggtctcaaacttctgacctcatgatccacctgcctcggcctcccaaagcactgggattacagccgtgagccaccgcgcctggccagaagttttcttttcctctaagttactcccaggagttggtaggatactttagagcctgcttcaagattttctttatgcctttttttaattgtgttaaagtgtgcacaacataaaatttaccatcctgtttttaagtgtacagttcagtggcattaagtacattcacattgttgtgcaaccatcactaccatcatctccagaacttttccatcttcccaaatgacaactctgagtctgttcaataataactgctcatttcctctcccccagctcctggtgaccaccattctactttctgtgtctatgaatttcaccactccgggaacctcatgtcaatggagtcatatagtgtttgtccttttgtgtctggcctatttcacttagcacagtgtctttaaggcttcatgaatattgcacatgtgtcagaatttccttcctttcaaggctgagtaatatccccctgtctgtatataccacattttgcctatttgtttatctgttgatggacttttgggctgtttccactttttggttgttatgaataatgctgctatgaacatgggtgtataaacatctattcaagtccctgtttttaattattttggacatatacccagcagtggaattgctgagtcacatataattacagatttaatttttctgaggaaccgtgacactgttttctacagtggctgcaccatttcacattcccaccaacaatgcccagggattctgtctttccacttcctcaccaacacttgcttttttctgtttttttttttttttcctttaacttttataggcccaaatgacagcgtttggtaaattgctgtctgactgcctctaagtcctggctgctcccatagctgctgttctatcactctggggactaagtggagaggctgtgccgttagccttgcttccctcttgcaccttccctgtctccctccctgccctaacctacagctgtgtccctgtgagtctttccttcctactcgtcagcttgggccctgtgcgcagagctggtgggaggacgggtggctcagtgccaggccgactagggcctctgcatacggatgacatccagtttccaccagaccttttttctactctgaaatccttttattcacccaatcatgattcacttttctgttcttcactgtggctgttccttcatgctcctcgctaggtcaacttgataaacaattatcgaataacacttttttgtgtgtgttctcaacactatagggatatgtggcaataaacaagggatagtcctttctcttaaggagaaaacagccatgcatcaagaccagtgtccataatattgtgcagaatgataccagggctagggcaggcaggctctgaagtcacaccaccttgggtgaatgatccatgctatgtctacttcttatcagctatgtgacctcaggctgtgcctcagttttcttatttgaaaaaatgaggataataatggttcctgtctgttttggcacttagttgacacttgagagcagtgtctgccacatagcctcaatcaatgctattcactattattgtagaacactgttagctatgggagcccagagagggacttgttaagtctagcttgtatatttcacatcacacaagcacctgccttgtcttgccaatggattgttctgctcaagtaaagcataggggcttaaagctaaatgttactgtgcctttattggcctgtatccctgtaggacctgctcagtgctaagtgctttggaggtgttcagtaaatatttattgattgtgaattgattagagaggagagagacacgaaccaggtctttttccaagcacccaggatgtgtaagcttcacaaatgaagagatgcttgctgatgctgccctctgtcctacccttcctggaaatgggcatggaggtgggtggggctggagaagtggagggggccccagaaagggtagcgacagagagaaagaaacccatgggcaacagggtctgtatctgggacgggacctcagccatcaagcatggccttgggaggagaagatgcactggccgcgatgcagcgagccctttcgaaaggcaaacagcacaagcaagagtgcagacggcaggttcgtcggctcctctggggctcccccaggggatgccgttgccattcggtctgcgtgaaggaggcaggttgtcttcttcgtcgtcggccacacttcactggctgcaagtgttcacgcagatgtgctcatgtgatcttaccacatacgcagattctagtaaaaaaagaagaaaaaatccaagaatgagtgagaatttattttagctacatgctgactgcctctcagcttgcccgtgctcttaccagatcttgaaaacaagggccagtttgtatttttataaaaatgcatcaaagtgttactaaaagatcctaaaggaagactaaagtttcctccgaaaagaagcctggcccttcaaataccaacaagggatcctcggaagatgggttttactgagctcaaacactgtctcttctgtttagatactgtattattacatcatttcccctctcagattgagtgatgtttcctccattatttgttccgttccttggcagaagtgaatttcaccatgaacaacatctgcagtctttctatacgagcctggggaatgcttgaaagaactgatactaaattattattattaatatttgtttgtctacctatccactccccacccccaggtcccctctcactcccgagtagtcacaaatgggtgtatcgggcatctcgtctcagttgtcaggactgtcccttctcattctaaactattttgcagattagcttgagcaattagaatcaggaatagatatcatgtggttaaaataaaagggaatttatctacaatttgaaaatagattacagagaacttccatgtgattttttttaaaaaataaattttgctgtgtactataacagagttggcaccagagctaacaaaaaaaaagcaagtatcaacatttaaaatgcagtacatgacatgtaaatgccatatggtattcttgcaatgttattaccactttctttctggcatccttttcctgacattgctgtatgcttcttgactctgctgctcttcagaaagcctcaattgtcctgagccctttaattctgtatttatattaggtgtctctctcttttatctaccctttggaggcttatcaaccttttccccaaggaagaggaagaagaggacctgtacagatggctgtataaatatgtgacacctgcttccgtgagccactattggaagagtttaagagttgatggtattgtcccctgtctagaagatgagcacacatttgcttctcttctcctttctatttttaaaaaatgatcatgtgcctttaatgatgtttctagaaatgtcttgaattcaaattattttctatttttagggaaataaaaaaggaacccaccaaccaaattttctgaaaagattatatgggtcaaaatgttaaaagtttgtcatagttaatatttcctaaagtaagagccttggtgatcgtgtttggggagaaatctctgcttcaccacgggaatgtcagtggatctctgcgtttgcactgaatgtgccacattctttcatctccagacttttgcgtgtgatatttatggtgtttcaaacaatgtctgtaccctcctcctggtctcagctcaaatgtcagttccttggggagcttttcctgacttctaaatgaggtcaacaccccccccaaataacatcttgtagaccccaagaataacattcatctcactgtattgatggtgggcatccccatcagcctatgagttgtgtgaggtcgggtcccatctgcctgttcaccactgcatcttcaggtgctagcacatggcctggaacccagagagcacttaatccatacttgatgaatcaatgaatgaacattgctagacataaccttatacatcttgatatagaaaatgaccttgaagctggactaggtcccagttacttgagaggctgaggctggaggatcaggccagcttgggcagcatagtgagacatcccctatccctcctactctcctaatcctgcacaatccccctctaaaaaaagataaacagagtgaccttgggctggcgctgtggctcgcgcctgtaatcccagcactttgggaggctgaggcgggcggatcatgaggtcaggagatcgagaccatcctggctaacatggtgaaaccccgtctcctctaaaaaatacaagaaaattagccgggcgcgatggcgggcccctgtagtcccagctgctcgggaggctgaggcaggagaatggcgtgaacctgggaggcggagcttgcagtgagccgaaattgcaccactgcactccggcctgggcgacaaagtgagaatctgtctcaaaaaaaaaaaaaaaaaaaaaagagagtgaccttgaaatcgaaactagtattgtatgcaaataaatggcaatggggaaaaaaagttcttaggctttgaagtacaattattttgaataaaagatgggtctgtagggagctgctccctgctaatgcttattgccaatggtattcatatgcagacacttttacctcatcaggctatacttagaagtgtaattctacagacttatcaagtcaatcttcttaaatacagtatacaatttaccttcacccagtggttctgaaccctgtaatatccaatattcttttatagcatatatttatgaatactcctttactacattgaaatgaatttcagagacagtgcactttgccaatacagataattctgaaaaattcaatgcaaattttctagctataatataaaggagaaataaatggaaagtaatgtttcaataataggtgctctgttatgaaaccctaggagacctgctgaagcagtgagtcttggcatctatacgtagaatgcaatatctccaaatgcagattggttcaggtatgttgtgttgatgactaagatgtcacaaaggactttttctccagtggtgtggttttccaaaatagagaacaactctcagcaaggttccagctaatctatttacattagagtcagattcttaaaaaatttggtcaactttgaaaagatgcaaacaatttgtgtgtgtgtcttcacatgtaaaagggagttaggttcttggctcagataattgtagacatgagtttttctcagtgggacattcaaagctcatgctaaatgtgggatggttctgtgatttgtggcactgattgttgtattgcaggacatctgaacgtctttgacctcctcccagtacatgccaaacgtgcccctccagttgtgacaaccgcaaacaccctaacaagtttagagaccacctcctagggtgttgtaatctaaacagggttataaacagagcttccagggggctcccatgtaactttcaagaatttacatatttaatttctattctcgtgaaaatggccatgttccaatagttaagcctcttcccttgatgtatttcccatgccattaatattcagttctattccacaaatatttattatatgcatatgtgtgtgtacatccatctgactatacctttctatgttatgtacctttactagaattccaaattataaaatcctgtcagtttatctcttgctagatgaatggttttattgtttttatagaatatttgctttaaacagtactctcatattttcttgaggtgctaaaatagaggaggcagctgtagaaaaatgcactacgggccaggcatggtggcttatgcctataatcccagtactttgtgaggccaatgtgggcggatcatgaggtcaagagattgagaccatcctggccaacatagtgaaactccatcttactaaaaatacaaaaattagctgggcatggtggtgcatgcctgtagtcccagctactcgggaggctgaggcaggagaatcacttgaacccgggaggcagaggttgcagtgagccgaggtcacgccattgcactccagcctgggtgacagagtaagactccatctcaaaaaaaaaaaaaaaaaaaagaaaagaaaagaaaagaaaaatgcactgtgccaggcacttagaacattgagatgaaggagcacactgtgtagtagggagacacatggatggatggacagacagtgatgcaggttgagcagttctatggacaggggaccatgcaagggtgaaggaacatggacagcagagagcaagaactggagagggcttcctgcaagaggtaatgtcagaattgtgtgtgaggaatgaacaggagtctgacaagcattaaaaagggcgaagaaccttatcctagcagatggaacagcccttaaaagggcacagaagctaaaaagaaatgagctatgaagccatgagaagatgtagaggaatgctaaatgcatattgctgcgtggaagaagccaatctgaaaaggctacatgcagtatgattccaactacatgacattctagaaaagtctaaactatggagacagttacaaagatccatgattgccaagagcctgggggaagagagggatgaatcggtggagcagagaggatttttaggctagggaaactattgtgtatgatactataatggtggatacatgtcatcagacgtttgtccaaacccataggatgtacagcaccaacagtgaaccctaatgtatactatggattctggatgatattgtcagtataggctcatcacttgtaaccagtgcactactctggcatgggatgttgatagtggggaaggctgtgcatgtttggggcgggggctatatgggagatctctgtacctttctcttaattttgctgtgaagcaaaaatggttctaaaaaaatcaaatcttgaaaaaggcactgaagtataaaatggagcagtattggggcaccaataaaccatccagtctctccagaactgcaaactaactgctactacagcaagagagaggggtcagcaactacctgcctgcagcgggggtaggggggagttgggggaaatggcggggggtggggtccctgacagtttcctcagaagtgggttgacgtattctggaggaggaggaggaggaggcagcatgaggcagcaggcaggatgcatttcttgaactggatcatggccaggtccttacagctctcccactgccacctttggcaaacattcctgggatcctgaaggctcagacaaggcccatccctcttatgttaccatggggattatctcttcctccttttctcttttagttttccctccaaggaagggttgtcactccttttccaaaaggaagaaggaccaagtgaatgattttcaagggcacagtgctgttatttctcgagggaacctctgccatgttcttgagcatgttgctcgttttctccttcccttctcttcttagccctctccctctcgctctctcctacctctcccccttttcctttttctttcatcacaaagactacaaagagtatacatggtcactgtagaggccttggaaaatgcaggggagtgcaaagaagaaagtaaaatcctgtaaatatcctttgtccaaagaaatccaccactaacacgttgataatcgtacttctgaatcttttctctgcatctacatttggccccaatgcctggtgctccactggccccacagtacccctcccacctgctacctaccctgtccaagtttccctgccctcgggtactggcaggggttgtcaccgtgtcctggccacagcctgtgccttccctgtgttactccatcagctccttctggattgctgacctctgctctaaccactgatcgttcatgacaattttgctacccaccttctgcaggtgacagatccttctgcctcagaagggggagtgctactgtcctgctgtcctagagctgagggagacggacaccactctccccggtaacactagattctcaggaatagatacaacaccttccaaactgcagctgacaccagctgtacattgtaacaagacttttaagatttaggaatgtcagagagatattacccacagcagttacatcacatctgcttacagtctggctgttcttggagcccagaattccaggcctgttccagggtgtccaattgagctgtgtccttgacctgcctcgaggcagctgaagccagcttgccctgacctccaggagtagctgttgcaggcaggcagcttagctcaaaatgagagaaactatggctaatttaaacaaaaatgaaaataattttaaaaaggatattggatagctaccaaatccttgggatggttggaaacccaaactgggaaggtaccttgttaaaaacaatgaccaaatcacaccatggaactggtcccggaggaagccactgctgtgtctgcccgggcatatacagggcggtggcccctggatgctgctgcaagaaccatccttgtgactgctcctggagtggggcataccaacattggtaccaccatccctggaatggcttccacagggtccctgtttctttatataacatccaagatatgtctgctcctgcctgccaccccacctcccatggaagctccccgctgatgctttcacttccatcttgatcaagggcaaggtttaccttccatgcccaccccactcagggttccagtccctcaccctctgtcggaggacctaggaggatccaggactcttgagagctgggctgtgcacaggtggtgaatcaccagcagaaagctctgcatctagtctcttcctcttggcctccagactggacgttttgcttcccaccacccaccccccgcaaccggaagactctaggaagatctcgtccctcccactgtacttttgctccaggctgagtggccattccgccttctctctgtctgtgttcctaacccggtcttgcctactgtctggaagaggagaaagtggttctgtaagtctgcctctgagaatctccacacctcttttcagaatggtctggggagtggcgggtgccagtgagacgaaagaggaggacggaggacagaggactcttagatgactacttcaaggtttaaccctgttacatctgcatgggtgtggttcaaagtctgaattatgtctttatggctgggaaagcctgggtcacatgcttgtctcctcatagcaggagaggctgggaaagtcagtaggtggtacattgcagcttctgtactgggaggaggtctctgtctttcaccaaactaaagaaggatgttcaaattattggtgggcaaaaagaatgacaaggatcctctgacgtggacatgccctgtgatcacattagctctgtttggtcacagcatgatagtggagtggcttgggcgacctatggcagtatcattgataatcatttaccatacaccacaggctgagcgtcaccagggttgatccaattccattttctaatctttctcctaacatggggtgaacatcaggaggcctggagatcttcttttgttgcttttagattctcagtttctggtcctctgagaagaactgttcaaactgttcatgcatatctctactaaacactttgcaggagcaatggaatctagaactgcattttaaagagaatactcttgtaaaggaaatagtatctacagagatgcaaccctaccaaagggtggggcactgttgactactttatcttatggagcatgtgtccctggagtcacagccttgggatgcctacatctgctttcatttgcatagctaaacagcccagtctcttcatgaaaggtaatagtctactttattcattacatttagctccatgaaagagtttgcatataacttaattgttttaagaggaaaaaatgtaccaattaaaagccaggacatttattatgcatgttcagcaatcaaaataggcttcagtgtagccttctatttttttttttcttttttgagacgtagtctcactctgttgcccaggatggagtgcagttacatgatctcggctcactgcaagctctgcctcccgggttcaagcgattcccctgcctcagcctcccaagtagctgggattacaggtacctgccaccacacctggctgatttttgtgtttttagtagagacagggtttcaccatattggccaggctggtctcgaactcctgacctcaagtgatccacctacctctcggcctcccaaagtgctgggattacaggcgtgagccactgtgcctggcccagtgtagtccttctaagcaaatccattctaatcaaatgaaggaacagtgctcctctttaataatcataaataagtgatagatgaataaggaaatgaatcatgtatgcatttatttgtccacaacacacaattggagctggcatttcctggaggcatttgtataaaacttagatgagatcacgtcccctaggatgtcaaggtacttgccctgattctgccatgaggcctccaatggaaactttgtcaggagtagaaaacagccaatgtatgtgaagtccaagttcattggcacctccctagcctccttgcagggttgtttctctccatcactaatcccctgttttggatcatttgcaacaactccctttactacgaagagggaatcttgaggtatgagcagtaaatatggagactgtggtaggcaaacagttccacagtgtcatgaggtcccttttacactctctcactctgtggattctttccccttcacaacacgtctgatttatcacaagctgtgattaattatttccttgcatgactgtttaatgcttgtctcaactcctactagctctgtgagactgggggccattttgttttactcaccggtgaagttagctcaatatctgacagagagtaggtacatgataaatactcattgaaaaaaggaatagaaaagttatagagttcagctatattcatagcttgaaaaatatgctaaaggaattttctcatttgtaggtgttcctgtccagttcccttagtgcaggccttcccagtgtagggtttatttctgcatgactttctataaagctgtatttccttcttatctaacttctcgttcctagtctaactagaaagttcatgcatatccctttctcccttctctccattttctttttatctctgaaacaattaggtacacacgtagctgggaagccttcttgtatgcctccagaaaaattctagatccctcaaactattgttctatctcttctttctgtaccccaatttttttctcaattatgctcttaaattatccttctgaaagattttctaattttgtttgcttcttgttgcctttttctcttctagttcacacacctttctctgtaagatttcttaatgcttattttattattatttatagttttatgtggacaagcatccctagatgcttacattaaaagtatttgtctaaaaaaagaaggaaggaaggaaggaaagaagaaaggaaggaaagaaagaaagagagataaatatggaaagaaagagaaaaaaaggaagaaaggaagaaagaaaggaagaagaaagaaagaaaagaagaagaaagaaagagagaaagaaagaaggaaagaagagaaagaaggaaagaagagaaagaaagaaaaagaaagaaagaaagagaaagaaagaaagaaactgtctattgggaagggcgttgtttactgcttatccagcaatacccaggtatttgtataggtgttgacctaaatctatctgaccttgaaggctgtcttcaaatcttctaacaggcaagataaataaggtcacagaaaatgcatacctgtttgtcatttacctttattcctgggcctatagatagttcttctgtctagtagcctctgggctactcatgggagtggggatagggatcatatgacaactttcttctcttttacgtgttctgggtactcttggatactggttccagggaacagctgcatagctaagagatgggtgggaaggacaagaaagagtaaagtgttcctagaggagccagcgaggcaaggggtgttttactgacctagtctgttttatggctacatgagaaccctaacactgctctccccttgccctggctgcttttccaggttcttgtccttcccagacagctctagccagggctcagggttccttaatggctgtcccaatccactcttcttttagcagagcacccttagcaagaaacccactgtaatctcaccctacttttctgcttttacaacatgtcttccttccgggtgaacattcacaagctaaagaagggaactcaccttcccttgaggagagcttgctgaacaccagaggatttcacctctttcccccttcataatggaataatcactgagctttctgctagaataaaaaaatcatgggccgggcacggtggctcacgcctgtaatcccagcactttggcagaccgaggcgggtggatcacttgaggtcaggagttcaagaccagcatggccaacatggcgaaaccccatctctactaaaaatacaatcattagctgggcgtggcggtgcgctcctgtaatctcagctactcgggaggctgaggcaggagaatcgcttgaacctgggaggcggaagttgcagtgagctgagtttgcgccactgcactccagcctgggcgacaaagtgagactctgcctcaaaaaaataaaataaaataaaataaaataaaataaaataaaataaaataaaataaaataaaataaaataagacaaaggagatgataaattaaagcctaacattactatattccctttatactgaagaatatggtttatatctgtggaaagatgagtttcctaatacaacctcagaattagataggagatcacaaggggtaactcccaaaaggaaggggagaggaaggggctgggttaacagttcctgggtcagaataagagttgagtggccatgtgtattgcagcaggtggagctccctatacaaggaaagcactggggcggaaaatgagcatttatcctattagaatggtcttgtgccttcactcctgtgcactgcttagccagggaactgtgcccttacaccttgttagccagtggaagaagagtgagtctaccttttagctgtctgtagcattgttactgtagtattattgtatgcttctgtttatgatggtggagaggccatttgagatggaggcattgttcatcatgctgctgaaatttgagtaggataaatttagaatttggataggtgagcagctgggaggggcatcttttgggattgtcaggagttactcagttgatgtggctcatcagcaggtgtcccattctccttacctttccatgggctttctttcatgcttcaaccaaagagaaggacccttcttcagttaaggatttgtctggatgttttctacatgtggtgtgatcgcttatgagttttcctgcctctgagacctaccttctgaatgcctgactgacaaagatttaaaggtcgtccattacagttggcatgcttttatattccacatgccagagctacaagaatgttattatttcctttcttctctcccaggtgatatatttggtcacctaggtgtcattaggtactaagctttgccttcaatatctaccagggtggggcaccatggacagtgccacaaagaccttttcagacaaaggctcagatcttcctgctggactttgtgtgcaagaggaaggaactttttcttttcttttttccccttctctctctctctctctctctctctctcccttccctccttccttccttctgtttcttccttccttccctccctccttccctcgaactgccatgtcccttgcaactagaatggtccctgacatttaaggttttaaataattatgtgcagaatgaattaaatgccaaatcttgtgttccaatagcgtattatcttcaaatgttaacagcaaccagttttttagaatagaaaacttttgaaaattttaattaaagtcttcctgcagtggaacagttgatttttttttttttttttttttttttttttttttttttttttttagtcggagtctctctctgttgcccaggctggagtgcagtggtgcaatcttggctcgctgcaacctctgcctcccgggttcaagtgattctccctgcctcagtctcctaagtagctgggattacagacatctgccaccatgcccagctaatttttgtattttttagtagagttggggtttccccatgttggccaggcaggtcttgaactcctgacctcagcctcctgaagagctgggattacaggtgtgagccagcatgcctggcctgagtttttattatttgtgaattttatttttttccatcccagatgcacctatattggtagtctagtgataaaaacaatttacccatatataccaacatctttttcaagaactttgcatagtgaaaccagcaaagtactgaactggccagtctgtcataggtgtcttgcaacatgactcagagtcagaagctggatataaacttttttctgtgtgtgtatatatgatccatttgtgtattcggcttttgagtgggactttttcagtaggcttcttgaaggttccacttcactattctcactgatgtgtgcttacagcatctctgccatggagattttaggcagagagtgtttaaaagctctactcatagtttatagaattgctagtgccacaaggccattcattgtgatgatgaaattattagttataagtgaaccttctaaaataaatcttggaagaaaacatgttataagaaaatgaagtcagtcctcttactaggcagttcccatcatctttccattttgagaaattatcctcagttcagatgtattactatggtgatgtgtttgcatttcaacaaaccaaaccaagccgtaaactgagctctgcatgtttagcttctgtcttaggatttttaccgcagtgtctttattcttgagtaaaatccccgacatcctggctagaaatcacaatgaataaataatttcccagccagacaaaacaatctgaattgctaatctcagaattctaagaaattacataaagatgcaaacaatggggattaaagagggggtaaaaattaaatgaaaaaatagcccacaaatgaatggaaatatacatgctctccaaaataacattgtggaagtaaacaaaaacagacagagaattatgcttaatgagaattggacatgtggcttagccctctgaggcctgaaacaagtaaacacttcccgaattgtcagtccatacatccctctctcaaaagagagctcttagaactggctccctctcctcctgtttacgaagcttacttggtctttggaacaattgcacatataattttaacaactaaatgaactctacaggagatgggttttgagtacttaaaaaattcctatagtttgtatcaatcagatacgggagatagttttgcaaaatactgtttgtgtaaagagaagggaagaacatgcgctctagtctaaccaatcaacaaagtgtgaaaacacgatttagacagaagtacaacgaccatcctatcagttctacccaaatatcatatcagaccatctcttccctgataacagttttgttagcctaaggacacattagctcagttagatctgggctctcacagagctttctgctagcggctctgcttactggtaagtaagccatgcaattttgcctagcaaccccaccgtggaaacacagctccattctgtaagtggcagggggatgtggcagggaggcagggagagtgaggtttgtgcctctcagaatccctctgcagctggttcctgacatcgcaaacgttatctgcaattcttggcagtttcggaaggatgatgaaaaatgggacggggaggtggctgagcctggggttttggaagtaggatggaattaattggaaggcaaataaaaaagcttccaagattgtgagctgcgactgtctgagagctcaaaccagagttggcaagaggaaccaaaggagaatgaggacattttttgtcattgacaatgaggtatacaatatatccaggaaaggacaaccagcagcgacctcctgaagctaaacagagattatcttaagccacatatgagggaacattcctcaatggcaaagagaagcattaaatctgggactgtctacgtctaaggaaaaatttgagcatttacattaaaatggcctgttaacaagcattgaatattaaccaggcactgtgctaagtgtttgcacacttgtttaatcttccaaacaatccgatgaggtgggatttcttatctccattttatagaggaaaaaaactaatgcacagagaggttgagaaacttgcctaaggtcactcagctatttagcagtggggttgggatgtgtctcaggcagtctttccctagactctgtgctcttaaacactactatggtttttcagcagcagtgaacagttacagggctaatggggataagaaaactgaagatcaccacacggcacatgagatggtttgtgattccattgtgaaagctgcagtttaaaatgttcaattaaggcaactttttttttttttaaatacctagagggcagcaaaaacatgggtatctagaataacagatattgctaaaaccttacgcccacagcacttctttttatagcaaagtatgggtatacacatattttcatacacctacacacacatacacatgcaagacgcgcatttcttaagtccctaaaataccctgataattaaatgctccaaacattctctgagtgtgacccttggatgtctaggagaagcagcccaggaacacacttgttagccggggcaatgagtagtggtgaaatgtttaccttgctgataaagtctccagtagatgatgcaattaagatgccacgatctagcctttgttatacacctccttgtctgccgtcaaacaaatccaccgctgtccttccccatcttccctcctgcccatctcctgaagtccaggaacgtctccagcttcctacgtacttgcagtcctcttttgccaacctcaacctcatttagattgcaattacattcacatcttaatttatgacttaacaagcatctcacaaacatttaattcactttaacttcactatgcatttgaggaggaatatttgaggaggaatggtactcccattgccagcaattagattgacttaatgatctatggcgaaatctccttttgggctttgaacttttcatacatttctgcaaacaaaactaggctaattaaagtaagttcctggattctcagaggggcttacctgccttcacaaaatcctcctgtaatatccaacatggaaatttatgaaatagacaaaactttccctgcagttttcaggtaatttatcttgttacgacactttcatgtgtggaaaagtcgatattttcatatatagtttcaacaatatcaataaattgtaatttttttttcagatggcttctctgaggagattaggagggtttctatatcaaagcatagatcaaattatttttccctgttcccattttatataccagatgccttcttaggagttagaaaagtacctcctttttacaaggaaggatggcatttctttagcttttcctggacagatcacccggtgaccattttttattctcagtcttccttcacagaagggacagaggactgcccattttcagcaggagttagtctgatttcttctgttagatgcagacgactttgtttgacaactttctttgggttggtgaattgttgaattacttgaaaagctgtttccgttgttaagcactggactgagaattaattacatcagaattctaatctcggctcattagtggcatcattttatgcaagtcccttaacccctcttggcttcagttttgcatgtgtaaaatgaagtatataaagcaaaggtctctctgtgcttggtgcgatgaagaggatgcaggtctcatggtacggatttcctatattgattgccccaaatgtggtgtacgtttgcagaaaattcatctaggcaatgtagaaaggccatacattctggtgttaaacacatcgttcatatatttatgctagtatatgataccagggcctcctgatgacagtctccagcaccaattctgagaattgcgaggatttttcagcttagagtttttcagcttagagtcaattccagtgtcgccttcagcacatccaaagagaatatgaccgatgctaccagtcctgctcctggactccactggtatgattcctttgccccagtatcagtctaattcccattctagatgcttttttcttaatgacccaacaactgactccttcaggagctggcatgagatgagatttgtttgcagagatgtataaaaatttcaaagccccaaaggagatttcaccacagatcattaagtccatctaattgtcgtcctactacccatttagatggggaccctgttatgctaactcctatcctgtctcttgtgagtgatacagtcaacacacatgatgatcacagcaccagctcagacaggtgtgttttaaaacaaaagtgtgttataaatgtacagcctcagcagggaaaatgtgggggcgaagaaacacacaaatacttggctagagtcggtcacaggtgaagatggggatgactgtgttttccgtttcatccaaacattttggcctgactcagataattttttttccagcatattctgtttgacacaagggaaacggtgcaaatccatcaccaccattgtggaaagagctccaaactcattctcacgaatggtggatcagtaatactacatgacaaatggtagcatttttgggaaaccattatatttgcaccagtgagaagtcagaatcagcatttgggctgcagtcatggaaccatgcaagaaacattcaaagcattggctaagcaggatttttttgtttgtttgacctggtgtccacgaacaggcttcagggagcctgagaacctcctagaccacttgaaaaattctgaatgcacttttctaggaaagagttcacagcgttcatcaaatttcctccaagcagccaatgaccagagaaaggttaaaagtcactgacacagtaccgttttctgtgcatctatatcctgaatccagggtgatgccgctgacttgcctatctttctcctttgctcttcctagaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcaggtaagcaccctgggcaggccaggcactggggctctggcgggaaaaataatctgttggctgtgcttttcgcaatcgataaaagatgttgcgggagaagcaaatgaagatgactcagtgtcactactgctgtgaagaggctcatttcaaatccctagtcctatgtaatataaataccataggtttttttctgctatgaaaagaaagccaaccctttccttctcaggatgcttatttcccttatcgtcacacaaattatgcaagactaaagtgaatttctcattaaatcttgaacttctgaattgaattaaacctctctaatccaatgataaaggctgtgttaggaagtggcacataggaaactcagatgagattagcatagaatttggtctgcagtgacctgcaggttcagcttcctgactcccaggtgagagccattgtctctgcaaacgttgtcctgcacatgcccagatacaaagctgaggactttggtgactatggggagctgagaactgcccagagggaatataagctcatggattatgcaggagtgtatatacaagcaatagccttccttgtaaaaataaatgtggatgagctatgtttaaggaagtgaaaaaaaaatcatcaatttcatctagggccagggaaattgcaaatgaaatgagatttagtttcatatgtgcaccagtttcccaaaagtgtggtagaaaggtacggatagaaggaagaggccatccttctctttttctaataggatagttctagatgttcagacaagtgatcagtttctactacaagaagtgaacactttgatcaaacaactctatcatctgtcacaagtttgaaatgtctggatggagtgtgtgtgtgtgtgtgtgtgtgtttcctttaccagttcctggtgaagtggcagcctgacctgagccctaagcagactgtttttttttgtttttgtttttgtttttgttttttttgaacagggtctccctctgttgcccaggctggagtgcagtggtgtgatcatggctcactgcagcctcggacctctggggctcaagtgatcatcccacctcagcctcctgagtagctgggactacagacgtgtgccaccatgcctggctattttttattttcattttttgtatttttcgtagagatgggatttagccatgttgcccaagctggtcttgatctgttgggctcatgtgatcggcctgccaaagtgctgggattacaggtgtgagccactgcacctggccagactgttcttgtttggcgtgtgatcccagcagtgtcttgatttctccatggaatactgtgcacatcaggaggatgggttctggtctctgggagtctggcaaacaggaaattctggaagagattgctgaaggctcatcaataggggcatgcgtgcctccctgttaattttataatacaaataactggcagagtggttttgtagctcttccaattgggcagacaaagactgaattccactttgtagaaataatagggttttttttccccttcctttttattggttaaggactaagaattgcaaagtgactaaatttagttttttttagcttttaactaaaaattgatttttagtcagtgtgactaaaaatcatttacagaaagcctgtagcctgggactctacccattttccccttacgcacagtgctcaaccatggatgtctagttagtggcctcaagctccgaagagagactgtacagagaaactgagaaaagtaagaggaacagttatagatgtattccagttaatcccttggcatcatccgtagccggtccgtgggaaaactcagtggtgtttccaatctaaggcaaacacatgtagtggcagctggaattttgaactatttcacaaacatctttaagtatccaaagcataacctgcagtgggtggtgatttagagctctctgggatagcactgggctgtcctgaggactgtctattataagatacctgtgacagacacagatctctaaccaatggctcagttcagtctgttaatctgaggcacaaatagcagaggcctgggagtgagattttttaagtgatgcttttattatttgttatctaccatggactgagcacttagtacaaactagtactttaccttatctttacttacctagtaagggcacaacctacacagtcccaggcatccacagttttactgcccttgtcagtgattacagagccatatttcctttgtcctgaggtttctgtagaccacggtctcttaaaagtcacagtgctgactgcagttaggccagaccccttccaagctccagttttccgagcttacacagaccaatctggagaatgcatgcctgaaaagactggaagtttatctctatcttttggtaacagtctgcgagtgatagggaaggttgcccaatcattggaaaacgatacattaacaagagttgatggttgctgtgattcgacatagtatgaactctactagaaatgtaatcagatcattgatcctgcaggattgattgctgatttattttgcagctgactcactttaggacagccttacaatatttcgcaactctgtctgggagcacacacagaactccgaatccagataagcagctcataaagggatacttagaagggtgttgactgcctgcttcattgttccttgttcactagcgcaccctagtgaccatctttgctgggtaatagtgacttgcaaaggtaaatatttactcccagatagcccacaggagaaagctacagatttctctggcgtagcacagaaacgaaatgaacctcaaaaaccacttactggtgcgggaactcagatcgtatcctacagctctaatgatgcaggagagagttgtctgaaaggaaaaaccaaaagcagctgcaccaaaccgaagggggcttggcacagagaagttggaattctaacgttaagaagtggcagcagctgtcgagcctcatggtctgctgcgctgtgttgctgattgggtttgagcttgtcgagaggagccacaggtcacatttcttgcccagctgcctttgccgtaagactcagtggcgctagatgtggttacaaccttggtctggtgggaaagtctgtaatcactcatcacctaatacgatagttaccaatccattgctagtatctgtcatcttagaaatggccactgcctgcttccttaggcaatagcgtttcccagagagagattgaggctgatgtccgttatttccaggagcttcctcacttctttaggacggtgggttgggcttgcaacctgttttgcatggctgcctccagcagtgtctgtaggaaggttagaataaataggctaattattcagaataaatgactggtcctttcaatggaacagccagtcaatgcaatcaggcaactggccaatttggtttgatggatttttactgtaatccttatttataaaataaagggattggcctcaaaggtcccttttagttctagtttatggtgactctaattactcagcctaactgaccctttggagtagcactatgtaaacaccattcctcagttagcattaaatcactattgcttgcatcaaaatcccagtaatgccattaaagctaattttactttcacacatccacttgtctcttagtaaatgtatgggtgcttaagatggaaatggttccaagaattccaaaccatagggggtgatatgattatatttgatttttattaaaataaatttagagaagtttaagaaaaaacaatgacaaccaggcctgatctgttgtcctgtagttcagagttattcatccttaacgctcaggtcaagcattagtaggtcaagttggccactggcgttttttatttctggtattaaggttagtggtcaagaatcgagggaagtaaagccttaagttaggcttttttgggtaagggatgggtaccccccttgccctctaaccccggtccaccttgtacacagcaaacctaacagctgagtgttaaacaatgatggatgacgtcttcactacatggaatggaatatgtgttctctgcaaagaccatatgctagatcatggttaaagtaacatttggttgttttcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtaggaccccttcctaaccctatgaatgttcctgagaacagatgagcttgtgtccagaattgcctgtctctgtcctgtgggctggagtgtttctggctcggttttgcagggggagcggggggcgggtcataggcttcctcatgttgaatcagtccttcaaagctaaggagaatagaatacagttatttctggattctttttttggcaggtgagaaaatatggtgattcgtttaccagcccataaatcctggaaaaactagtaaacaacagctgattttaaaaaaatgaaaatgaaaataaataggagaggtagactatggctgagtgtgtgtgtgggggggtgcagcctgtccttccggtctcagggtctgtgcagaaaggcagttgaacgccaagaatctttcctgattcagtaagaaactgaaatcatcgaacattgaccagctacggggaagtgagcccaatgggcctctttcacttatcccctcttggttgtcacatccatagagacaaatatacatccctgaggaagggccgtgcatgtaactttacatgaagggaagtaaaggaagacatatgaaggaaagatagattttgtgattaaaaaataaatattcatgtagctctcttaggaagagaggaaaagaaaggaggaaggccaaggaaggagaaaaaaaagagctaaaagaaaggaagggagataagaaaaaccaaagaaatagagggccagcctctgtttgcttcattctgtataaaaggccccaggagaaagttgctgaatggagagatttcccacatcagtttcctgggcccatatgctaattttcctggtttatataagtaagccaggaaagtaagcaatgcaatttccagaccggttccccagacagctaactgacctgctgaaaatcagctataacaaaagagaagggaacaacatgaatattgactttcctggatgcacaaatttgagttcctcatttgcagagggaagcatgggacttatactgtctgccctgttcattaagagccaagaaatttggtgctgatcctcaggcaaaactccactctaaggaggcctgttctgtgggctttggcagaataggccgtcttcctgcaccctgactgggggaagtgggttaccaggtgccctggagcatcttcttaaaccagggaaagccccacagcacatgaccatagcatggcccagatagggtggccacccatcccagttttcccaggactgagggagttcctaggacacaggactctgttttaaaactgggacagcctcaggcaaactggaacaagttggtcaccctgccaggatagaaaaccagaaaggcagggagggcagaaggcctgctgaacatctgctgtgcccaggactgagtgaggtgcatttccttgtctcaggtgagctatatatggtcactcaagtgtatgttgggggaatgaggccatgcaattgataagagagagctggaagccaggcctgtccaactccacattttaacctctcctgcaggatgccgtccccctctctttaagtcaccatctccaaatctgaggcttcttggggttgcccaccacgtgtgtctccctgagccaccttatttactagccaattagggatgggtgtccaggtggcagaagtactagggcagaaggtagcatttgcacctccccctgggcatgtgctccgtcacctcctggcctccccgtggggacacccgagggctgtgggtgctgggaggccaaggcagggaggcatttgtcagcatattgttgctcttctgtctcttggccaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttaaccaatgacagaagcctgctgagtttggtctttctcacaggggtaggtagtccacatgaactggcgagcagtggtgaaaacatgacatcaactgctgcgtggttaaaggccaatcatgcattttcctcagtgggtgcaatggtgacaataaactgatttggaaatgtccatgtactttggttataacttgttttgataagaggggtagaaataccaaaacaattgccttgcatgatgccagtggcttgctgttctgtctagctgatcctacatttttacaaaagtagacatcctgcatttctgagacacactgaggaggaccatggcatctttccatctcagggctttttgtcccttgggtgtcttagggtagacatagtgataagatccaatctcgctatctccaaacaaaaagaaaatgtaccccttgtacagtaagcttgaaatgtttttattgcttgcagcgtaagtgccattaattccatttaacaatgatacttagaaatatttaaaatatttcattttacttttatgtttgggcattcctttattctgaaaaagtcaccactgctccttgcttgtttctacatctcacatcggttactcactaaaactggaacaccctagactgattgttcccaggcaaacgataagctaacacatcataattatgattggtctgtgaggctagaacatcccgcagaggaaagtcggggaatggctagtcataggttgcatgatgattttaaatgggtttgtatcagaaaggggaaaatacatactcctgtgtatgcctcagtctttatcataattggctggttcacagctagctctttgggccacacgtgaaagcatttggacctggcaacaccaggcagttgctggttatgggtgttctaggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcacttatttggtttccactctgtgttatctggtacgttctttgtagcagtgtgttaaaattccaggccctacggccaaatctggcagaggcttccctctcatttatccagtgccttctgtgggccaggcacaggattaggcactttatgaacgtcagctcattgaaacttcacgacactatgtgggaagtatttgcaaacccattatatacacaaggacacagaggctcagggaagctatgttatttatccaatggcacacagcaagaaagtggtagagctggtattcaaagtctgaccaaagtctgctttcaacttcactacagtgtctgtgtcatgcatccttgtgattgtgtgtgtttgtgtgtatgtgtgtctttctagcttcatggacacagcttacagatgtggggagcagatatggtggaatctccaccaccaagagggcacaaggtctttgtgtaaacatggctcaaagggttgcccctgcagacacctactgtacatttatttggttttggaaat

SEQ ID NO: 13240 - DNA, 20182 bp, Human
gttgtgagcagaggagggacagggtcagtcttgtgcctcagtaagatccctctggtttctctgtgggaggtgagtaggaaggggcaggattggggcaaggagaccagggaaggggctgtggggtgaggacccagagttggggggcgagcaggggcctagactggtggaagagagagacattcaaatggcagaaggatcggactttagaaatgtctggctctggttgggtttgtagggggaaaagttcaagggaagatgcaggagtcagtctgggctttccctccaagactcagtttccttctctgtacaatggggtcagtctgcctcccctggtgctgagatcctggggtaaaatgctcagcaaaatcatctgtaacatcactcctttagccactcagcacatctcatttactcctcctggtggctctatgagggaggtccttttattattcccattttctagatgaggaaactgaggttcgtagtggacaagtcaccagcctgaagttgcacattgtatcgaacattggattcaaatctgggtggcctgactcccaagtctgcttttgcaggtatgggtggagataatcctgagcctggagtcccctcacctctgtctctcccctctccctaggacaagcttctctgagcatctctgtgtccaacagtcagatccaagagaatgtggtgagactcctgcccccacctgatgccctcccctcccacaaaccctcctcagctctctcgtctccttgactcccccttccccatttccatttgcacccctgacctgccctgtcttcaccctgtaggacattgccactgtctaccagatcttccctgacgaagtgctgggctcagggcagtttggagtggtctatggaggtgaggacacttcagagctaacccagagggagccccgggctgggggaagctgctgtggctccagccctttctttctggctccaacccttcctttctgattggtcacatgctcacctcccatgttgattggcttagctagatcctgggtggactgattgcaggttctccttttctcattgggaaaaaccaatggacattcctcctgttattaataggaagggtaaattcggcactctgattggtcacagaggtagattttgattggatagggaaggtagattctgcactctgattgaccacagagctagaacctagattctgattggatagagtagattctgcattcatattggccacagaactagttcctagattctgattggaaaagagggtagattctgcactctggccacagagctagatcctagattctgattgaataggagggtagattctgcattctgattggccacaggtctagatcctagattctgattggattggagggtagattctgcattctgattggccacaggctaaatcctagattctgattgtatggggcgggtggtaaattttacactttgatttgccacagagctagatcctagagttcaataggacagggagggtaacttctacactctaaactctaagactcagtttccttctctgtataatagggtcagtctgcctcccctggtgctggtgtctctcccctgtccccaggactcttatgggtcacacaaaactagatgctagattccgactggttataaatccagtttcccatgttatacattcccttcttcggagctttttgtttgttttttgctttccttctttctgcctttactcccaaggtgcacctcaggtggccttttcacgtatctcctggggccttccaactctgcccaactctggctgtctccatggtggggggcagaggttggcagaggtggagatactcctgccaggactgggtggtcttgctctctcatcccccatctcttctactccctgtgcaggaaaacaccggaagacaggccgggacgtggcagttaaggtcattgacaaactgcgcttccctaccaagcaggagagccagctccggaatgaagtggccattctgcaggtaaccaccaggccgccttccctttctgcttcttcctttcatgggccagctgacccagtgtaggggtggtcagggaaggcttcctgggggagggcatgtgcatgttgagactgaaggggagaaggtgttcttagcagagggaccagcctgtacaaagacctggtgagagggagcatgaggttttctagaaaggaggtactgggagatgaggccagggaggagggcggagccagaccctttggactttctcctgagggtactggagagccacagaaggcttttgagcaagggaggggcaggatcaggtgtgtacgttaggaaaatcccgcaggctgccatctggagggtgggtggaaagggaagtgattgtagccaggaggctgagtggggatctgggtgggagagaggggttaggccaggataggactggagaatgtgagagggggtatggatttaaaagatacagatgtgcagagctctccccatttctccaagctccccctcctccctcctgcaaccctgggcctccaccagaatttcaggatgtaaagatccttctgggccgggcatggtggctcacgcctgtaatcccagcactttgggaggctgaggtgggaggatcacttgaggccagaagtttgagaccagcctggccaacatggcgaaaccccatctctatatttaaatagaaagaaaaaaaagatccttctgggcacctggcaggtggggtggaggtgggcctgttctgtcttggcctgtgggaagcccccttccctctccaagtgccaataccccagggacatccttctccttgtttgtcatcctcctgctcctatacctgacccgttggggtctgagtttgtgggttacctgggccctgaccccgctccccaccctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccaggtgcgtctgccctgcccgctgccacccgcccctccccatcaggtgtcagcttggagaggccctgtatgcctagggggtcaagcagacacttgggggagtcacaatagcagataacagaaaccatcatcaggctgggcgcagtggctcacacccgtaatcccagcactttgggaggcccacgaggtcaggagatcgaaaccatcctggctaacatggtgaaaccctgtctctactagaaatacaaaaaattagccgggcatggtggcaggcgcctgtagtcccagctactcgggaggctgaggcaggagaatggtgtgaacctgggagatggagcttgcagtgagccgagatcgcgccactgcactccagcccgggcgacagagcaagactccatctcaagaaaaaaaaaaaaaaaaaaaaggaaccataatcgtacagaagtaataataaccataatagaaaaaataagccgggcatggtagcacgtgtctgtggtctcagctactcaggaggctgaggcaggaggatcacttgatcccaggagttctgtgctgatcaggtgtcctcattaagtttggcatccatgtggtgacctcccaggagtgggggaccaccaggttgcaaagcagcccaggttggaaatggagcaggtcaaagctctcttactgatcagtagtgggatcacatctgtgaagaggcattgcactccagcctgggcaacatagcgagaccccgcctctaaaaagaaagaaagaaaaaagaaaaataatagtgacaataacaattaaaaataaagagtatgccaggcgcggtggctcacgcctgtaatcccaacactttgggaggccaaggcgggtggatcacctgaggtcaggagtttgagaccagcctggccaacatggtgaaaccctgtctctactaaaaatacaaaaattagctgagcatggtggcaggcacctgtaatcatagctacttgggaggctgaggcaggagaatcccttgagcccaggaggcagaggttacagtgagctgagatcgtgccattgtactccagcctgggggacaagagtgaaacttcgtctcaaaaaaaaaaaaaataataataataataataaagagtaatcataataatagaaaaaaatagactagcggtaatgatagctatttttattataaaaaataaatgatcagtcaggctccctggacctgacttgactcatctagaaaaaaggggagtcaggcatggtggggtacacctgtaatcccagctactcaggaagctaaggccagaggattgcttaagcccaggagtttgagccagcctgggcaacatagcaagagcccatctcaaaaacaggctggctcatgcccgtaatcccagcgctttgggaggccaaggcaagaggatcgcttgaagccaggagttggagaccagcctaggcgacatagtgagatcccacctctacaaaaagtaaaaaaaaaaatagaaaacctagctggatgtggtgcctggtagcacatgtctgtagtcctagctgcttgggaggaagggagtggagaggctctcttgaacctaggtggttgaggctgcagtgagctatgaccgtgccactgcactccagcctgggtgacagagcgagaccgtgtctcaaaaccaaacaatagaaaaaacgggcaagcagccctttttctctcattcattcattcagttggtcaacaaacactccctagtccctgctctgtgcttggtcccttgctggtcagtgttgaggacacagggatgaccaatacagccccattcttagacagtgatagctcaggtgagcagggctaggacaagggaggctgataatggtgatgataaataatgtggtcactaacatttattgagcacttactatgtgccaagcactcttcaaactcatttaatcttcatagtaacctgtgcagtaggtgctattattatcaatccccttttatggttgaagaaactgagggtcagagacatcaaatatcttgtccagggtcacatagctggtgggatttgaacctaggatctttgcttttaactagtgatgtcaaactcatttgtgttacattcaaacagattttccttgtgtgcctgtgtgcctgtgctttttgtttgtttttttgagacagggtctcgctctgtcacccgagctggagtgcagtggtacaatcatggctcactgcagccttgacctcccgggttcaagcaattctcctgcctcagcctcctgagtagctgagacaacaggcatcagccatcacacccagctaatttttataaagacatttttataaagacttgctatgttgcccaggctggtcttcaactcctgggctcaagtgatcctcctgactcggcctcagcctcgcaaagttctgggattacaggtgtgagccactgtgcccggcctctgttctgcgtttctttttttttggtggaggtgcacattagattcttatcacttatattgttcaatggttttatcccagtgtttgcctctttattttatatttagtttttatttaccatagggttttatttattttattttttatttttttttgagacggagtcttgctctattgcccaggctggagtgcagtggcaccatctcggctcactgcaagctccgcctcccaggttcacaccattctcctacctcagcctcccaagtagctgggactacaggtgcccaccaccacgcccggctaattttttgtattttcagtagagacagggtctcactgtgttaaccaggatggtctcgatctcctgacctcgtgatccacccgcctcggcctcccaaagtgctgggattacaggtgtgagccaccgcgcctggcctattttatttttttttttgagacagggtctcattttgtcacccaggctggagtgcagtggtgtaatcatagttcactgcagcctcaaactcctaggctgaagcaattctcctatctcagcctcctgagttaactggaaccacaggcatgagccaccacgtccagctaattttttttttttttttttttaatgtttttgtagagacaaggtctcgccatgttgcccaggctggtcttgaactcctgggctcgagcgatcctcccatctcagtctcctgagttagctggaaccacaggcatgagccattacacctggctaatttttttttatgtttttgtagagacagggtcttgccatgttgggtctcgaactcctgggcttaagtggtcctcttgctgcagcctcccaaagttctgggttacaggcatgagccactgcgtccagccggccatagagtggaacttttacgatgttaaatatccccttgtgtggtttctgtgtttcacatccttcctagaaaggcttccttctggtgggtgccttgccttcttctgagacatctctgtgggtctcagagccatcgttgctgtgttccctttaccctggcccagcacccttatcctctcaggcagtgtgcctgtgtttgtcaggctggcttatggggtggggacagaaacccactgatgcaccctcatccagactttattatttatgtatttttgagacagagtctcgctttgttgcccaggctggagcgcagtgacacgatctcggctcactgcaccctctgccccctgggttcaggtgattctcctacctcagcctcccgagtagctgggattataggtgtgtgccaccatgcctggctaatttttgtaattttagtagagatggggtttcatcatgttgcccaggccagtctcaaactcctgacctcaagtcatctgcctgcctcagcctcctgaagtgctgggattacaggcatgagccatcgtgcccggccacatccagacttcaggtgtggaaaggaatcatggttctcacaggtggctgctttcagcagctgagggggtttctctttctggccttcatctcttcctctctttttgcctgctcgctcttctttctctctctctctctctctgcagatttctgctttctgggctcttgcctgccccacacctaagccctgtgctaagccctttacctcctgagcttatgtaggcctcaccaccatcctaggaggtaggtattgttataaaccccattttatagatgaggaaactgaggctcagggagatagcagtctccctcgaggtcacagccaagtagctttccagccaagatttgagtctggatctatctagcttccaacctgccctctttcttttctttttttttttttttttttgagacgaagtctcactctgtcacccaggctggagtgcaatagtacagtctcagctcactgcaacctctgcctcccaggttcaaacaattgtcccacctcagcctcctgagtagctgggactacaggtgcgtcccagtacaccgggctaatttttgtatttttagtagagacggggtttcactatgttggccaggctagtcttgaacttctgacctcgtgatccacccgcctcagcctcccaaaatgctgggattacaggcgtgagccaccatatccggccaatgttttttttttttgagatggagtctcgctctgttgcccaggctggagtgcagtggcgctatctcagctcactgcaacctctgcctcccaggttcaaatgattctcctgcctcagcctcctgagtagctgggaacacaggcacacgccaccattcctggctgatttttgtatttttagtagagatggggtttcaccatgtcgatcaggctggtcttgaacttttgatctcgtgatctgcccgcctcagcctcccaaagtgctgggattacaggcgtaagccaccgtgcccggcctaacctgccctctttgttcacatgaactgggagaaaatcaactgacaaaatctggaaatgggcggggcgaggtggctcacgcctgtcatcctagaactttgggaggccaaggcagatggatcacctgaggtcaggagttttgagaccagcctggccaacatggtgaaatcccatctttactaataatacaaaaattagccaggtgtggtggcattcacctgtaatcccagctactggggaggctgaggcacaagaattgcttgaacctgggaggtggaatttgtggtgagtcgaggtcatgccgttgcactccagcgtgggcaacagagtgagactccatctcaaaaaaacaatctggagatgacatatacaacacatgcatctttccagcttggtctcccagtctgtagaatgaggaggttggtcaggcatggtgggtcgtgcctattatctcaaggtttgggtagctgaggtgggaagatcatttgaggccaggagttttagaccagcctgggcaacatagcgagatgccatctctacaaaaagatttttttaaaaaagaaaacaatcagaataaacacaagtatttaaactctgagacagatacacaagtatttaaactccgagacagataataattgcagttgtacaacactctatgcttctggtgtacttggcattttgagttacagagaatcaagaaatatgattctcacagatgaatggttacaaatggtaattttttttttaatcagctcaccttatcataggaacagatacagcaggagaagctttatttaagagacacaaacaaatatatttaccaacaagccatcacaaaaataataactaataacaacaacagtaacagctaacatacagtggttagctatcctaagcgttttacatgcatctttagatatgctttaaaccttatagcaacctgtaaggttggtactctttttttttctgagatggcatctcactctgtcgcccaggctggagtgcaatggcgcgatgtcgactcactgcaacctccacctctccagttcaagcgattttcctgcctcagcctcccgagtagctgggactacaggcgcccaccaccacgcctaatttttgtatttttaatagaggcagggttttgctatgttggccaggatggtgtctaactcctgacctcaggtgatccacctgcctcagccttccaaagtgctgagattacaggcatgagtcaccatgcccagccaaagttttttgtaaggatgaaaaatattttttttaaaaatggaatcaggctgggcacagtggctcacgcctataatcccagcactttgggaggccaaggttggtggatcacgaggtcaggagttcaagaccagcctgaccaacatgatgaaaccccgtctctactaaaaatacaaaaattagccgggcatggtggtgtgtgcctgtaatcccagctgctcaggaggctgaggcaggagaatcaggaggccttctcaaaaaaaaaaaaaaaaaggaatcaaagcccgacatggtggtggtggcacatgcctgtagtcctagctatttgggagactgaggctggaggatcacttaaccccaggagtttgaggctgtagaatgatactgcacttcagcctgggtgacagagggagactccatctcttcaaaaaaaaaatgggtgaggtggggtggctcacgcctgttatccaagcactttgggaggctgaggtgggtggatcacttgagtgcaggagtttgagaccagcctgggcaacatggtgagacactgtctctacaaatacaaaaattagtcaggtgtgatggtgtgtgcctataatcccagttactagggaggttgaggtgggaggatggatttagcctgggaggtcgaggtgcagtgagctgtgatcccgcctctgtgctctggcctgagtgacagagcaagactctgtctcaaaaaaaaaaaaaaaaaaaatagaatcacatagttggatcttggaaatgcctgctctgtgagtagcattcaggagtttaccacatgctagaagatcttgggatcttcacagccccactcatctagcccagactttctagtttacatttaactcttatctctcagatgtaaatggttctatgattctgagattctttggtgctccagtgcctcctgtttccctggctggggtgtctgcaggggtgtgtaggaaggcatggatggggccaggcgcagtggctcactcacgcctgtaatcccagcattttgggaggccaaggtgggtggatcacttgagtccaggagtttgagaccagcctggtcaacatggtgaaaccctgtctctactaaaaataaaagaaaaaattatcagagcaagtctgggcccggtggctcacgcctgtaatcccagcactttgggaggccgaggtgggggaatcacgaggtcaggagtttgagaccagcctggccaacatggtgaaaccccatctctactaaaaatagaaaaaattagctgggcatagtggccagcgcctgtaatcccagctactcgggaggctgaggcaggagactcacttgagccctggaggtagaggttgcagtgagccgagatcgtgccactgcactccagcccaggcgacagagtgagactccgcctcaaaaagaaaaaaaaaaattagctgggcatggtggtgcacgcctgtagtcccagctacttgggaggctgaggcaggagaatcacttgaacccaggaggtaggggttgcagtgagctgagatcatgccactgcacttccagcctgggctacagagcgagactctgtctcaaaaaaaaaaaaaaaaaagtatggatgggtttggagggctggctgctgaggttgggatttggctgagtacctatctacctttcttactgggcccatctgctcccctcagatcctggtggctttgagacaccttcacttcaagaacattgtccactgtgacttgaaaccagaaaacgtgttgctggcatcagcagacccatttcctcaggtcagttatgtcccctcctgatttggggaaatccaggcaacactgatggccggggtgggggtggggaaggggattatactaatcaagatgtgggggcgaggcacagtggctcttgcctgtaatcagcattttgagaggctgaggcaggaggatcatttgagcccaagagtttgagaccagcctgggcaacatagcgagacctcatctatacaaaaaatgaaaaaaaaaatagccgggaatggtggcgtgcgcctatagtcctagctgcttaggaggctgagatgggaggattgcttgagcccaggagttggtggctgcagtgagctatgattgtgccactgcactccagcctgaataacagagtgagagctgtctcttaaaaaaaaaaaaaaaagactgggtgcggtggctcacgcctgtaatcccagcactttgggaggccgaggcgggcagttcacgaggtcaggagatcgagaccatcctggctaacacggtgaaaccccttctctactaaaaatacaaaaaaaaattagcggggcgtggtggtgtgcgcctgtagtcccagctacttgggaggctgagttaggagaatggcatgaacccgggaggcggagcttgcagttagccgagatcacgccactgcactccagcctgggtgacagagcgagagagcgagactctgtctcaaaaaaaaaaaaaaaaatatatatatatatatatatatagtttatcccaacatatagcactttattcaacatgtagtcaacataaaaattattaaggccaggggaggtggctcatgcctataatccccgcactttgggaggccaagatgggaagacggcttgagaccaggagttcaagtctgaagtgagctatgattgtgccactgcactccagctggggtgacagagcaagaccctgtctcttaaaaaagaaacaaaactcaatgaaacattctgcttgtttttcatactatgtcttcaaaatctggtgtgtataacagttggggaaatagattgacatgcccaagttgttccaaacatatttaaaagttttctggttgagcgcagcggctcatgcctataatcccagcactttgggaggctgaggcgggcagatcacttgaggtctggagttggataccagtctggctaacatggcgaaaccccgtctctactaaaaatacaaaaattagctgggcatggtggcgggaacctgtaatcccaggttctcaggaggctgaagcaggagaattgcttgaacccaggagggtggaggttgcggtgagccgagatcacaccactgcactccagcctggacgacagaccaagactcgtctcaaaaaaataataataaaataaaaattttaaaaaagatccataggaaagtatagatcttggaaaagagaaagagctataagatctgtagaaagggcagagtacctcaggaaagggtggctgtcacattgagattcaggtcaggggttgaggcgtggctggtttcaaaggtgacagaggcttcaggcttcaaggatttggggctctatcctgcaagcaacagtgagccaaggaagggttttgaacagggaaaggacagtacatgaacagagctgggaaccaaggctgagaggtaggcagcagagcaagaccttgaacccaggtcttgctggctccaaagcctgtccatgaccttagactgcagccattaacaatgagggtatggggccaggtgtggtgtctcatgcctgtaatcccagcactttgggaggctgaggcaggaggaacacctgaggtcaggagtttgggaccagcctggctgatgtggtgaaatgtcgtctctactaaaaatacaaaaattagccaggcatggtggcgggtccctgtgatcccagctattcgggaggctgaggcaggagaattgcttgaacctgggaggcagaggttgcagtgagccaagatcacgctactgcactccagcctgggcgacagagcgagactccgtctcaaaaaaaataaaacaatgaaggaaaggtaggcatacaccatactgtctgccagctaccgcagtcagcacccactcctacctaatccccaggaaagcctgagaggaggctgctatcaacaaccccccaatacagatgacaaaatcaaggcctggagaaattaggtccttgacctgagatcatcgagggtcattctgtgctagacactgctcctaacacgttgcatacatttctctttcagtctaaacaagcaccctttaaggtagggactgttaagatctccattatgtttcatgttttttttgtttgttttttgagacggagtctcgctgtgtcacccaggctggaatgcagtggtgcgatctcggctcactgcaacctctgcctcccaggttcaggcgattctcctgcctcagcctcctgagtagctgggaccgcaggcgtgtgctaatttttgtatttttagtagagatggggtttcatcgtgttggccaggctggtctcgaactcctgacctcaaatgatccatcttccttggcctcccaaagtgctgagattgcaggcatgagccaccacgccccaatcatgtatattttgaggctattaaaaaaaatctgcattattcaaaagaggaaacagcgacccattggaggtggcagaggtatagcagcagctagcatttattgtgcaccaactgaatgccaaatattgtcctgtgggctttggatggtttaattcactaaccatcatggcagtcctctgagataggtgctcttctgctcttcttcctatagatggggaaactgaggcacagaggggggaagtcacctgcccagggttgctcagctagtgagccaaggagcctggattcaaaccagcatccagctttctctggaataccatggagggtggtgtggtggggatgctggggtgggtgcggctccatcacctggtggagcctccatcccttgccctctgcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggaggtgcctggggcccgcctaccccatgggcgggtgggttgtggggtggggctggagaagtgggcggagccatgagaggggggtggacccggaaacagcctggcaccttgggggtggagcccagtgctggggcgggcctactggagggatgtggctacaggaggagccgtcctgtaaaagatgggctgggactcaggcctagactaggttacttgggctggaaaccaagtgccccagaagcgctgaggacacttggaaccttaggggggctgagtgagacttggcttgtctagggtgggaccaggaaagggactggacttgagggtaccaaagggctgcggtgaccaggagaaggggctgagcctcccaaggcattggctgggacctggagcctttgggtttacgaccccaaaagggtcagccttgcaaaaaggaggcaccggtgggtagggttgagaaacaagggcatggctactttgctgtgtactggggccgtgacttgggtgaagatgggcctgaagcctggggtcggttcagtgaccaagggagccagtctagggacgtggccgtggagggtttccgaagaggtccaggaacagggctgaccctgagtcctggaagctgggagtggatgggagtggggaggagaagggagccaggactgaggcagacattgcactctgcattctggggctttggtgttgtggctgggcctgatgaagtggcaccgggcctggtgacttgaacctacttgggaatgggtctgtaactttccctgcttggaaaagttaagtcctaaggcctggagctttgaggctgggtgtgggatggcatgtttagagggccagaggcagggctaagatactggggtgtgtcagaagccaggagaacaagggacctgtgttggagccagggagctcaggaagacagatggagtatgggaaggggggggatcattcattcatttatttataaccatttattcaacaagtacattcatgtatttgtaaccattgattcaacatgttgagtgcccacgatgtgccaggcattgactgttccagctctgggaatactgtgatgacttggacagaaggggtcaggtgcagggtagctcattgagtggtccgcgaagggtggaaaggggaagggtcctctctggagggtgcggcttcatggagcaggtggagcagggtgacacggaggttgctcggtgcaggacaagacaaggtcttggtggtggtctaagagcatgggccctaagcagtgagaatgtggattgacttgagtcctggagtaatattgggggtgctcaacactggcttttttttttttttttgaggtggggtctcgctctttcacccacgctggagtgcagtggcgtgatctcggctcactgcaacctccacctcttgggttcaagggattctcctgcctcagcctcccgagtaactgggattacaggcacacagcaccatgcctggctcatgttttatatttttagtagagacagggtttcgccatgttagccaggctggtcttgaactcctgacctcaagttatttgcccgcttcagcctcccaaagtgctgggattgcaggcataagccatcacaccccgccagcattgtcttttgagacccactcagaagtccctcagtaaaagtgcatcgagtgtgcacaagtgaatttaagtgtggttgcacctgtgtgaggatcacagaatcctgtgggtgttgacgggagcagggtgcctgtgtgcaccaggcctctcctcggatgggttcatacagtgaagccttgtccttcatggcttcccatcaaggagagagcctcggatgagtgctggcttgtcttgaagcttgacattcgctagtcctctttttcacaatgaacaggcctatctctgagccttctgcaggcaatggtgactaactaccatctgatgacattttgttttgttttgttttgttttgagacggagtttcgcttttgtcacccgggctggagtgcagtggcacgatcttggctcactgcaacctctgcctcctgagttcaagcgattctgcctcagcctcctgagtagctgggactacaggcatgcgctaccatgcccagctaattttttgtatttttagtagagacggggtttccgtgttggccaggcttgtctcgaactcctgacctcgggtgatccacccgcctcggcctcccaaagtgttgggattacaggcatgagccaccgcgcccagcctgatgacatagatgctccctgatttgcactggggttagataaacctgataaacccattgcccattgtaaattgaaaatatcataagttggtcaggcgcagtggctgaagcccataatcccagcaccttgggaggccaaggtaggcagattgcttgagcccaggagttcaagaccagcctgggcaatgtatctctacaaaaaatacaaaaattagccggccatagtgacaggtgcttgtagtcccagctggctgctcaggaggctaaggcaggagaatcaattaagctggggaggtggaggcttcagtgagcattgatcacgccactgcacttcagcttgggtaacaatgagaccctgtctcaaaaaaaaaaaaggaagtattgtaggttgaaaatccatttaggccgggcgcagtggctcatgcctgtaatcccaacaatttgggaggccaaggcaggcggattgcttgaggtcaggagttagagaccagcctggccaatatggtgaaaccccatctctactaaaaatacaaaaagttagcaggacatggtgacacacacctgtattcctagctacttgggaggctgaggcaggagaatcacatgaacccgggaggcggaggttgcagtgagccaagatcgtgccattgcactccagcctgggcgacagagcgagactctgtctcaataaataaataagtaaaaataaaaagaatagtacaggtgtaattgtatgtacctgtatatgacaaaaagaaaaaaaaaggtgacataggggaatggggaaattgaagtagagaacaggtgaagagagggagctggtgtgaacatgcatgggcaggaggagacaaatttgtaatgtaatgaggaaatgggtgggtgagtgattggcacaggtgaggcttctgagccacctgagctggtgcagaaggaaggtgttgatggcaggcaggtaggctagggggtgcctattggaggaggagtgacccttgacctgtagggcttgacctgtttctctttcctgtgcagccattgacctcatcaacaacctgctgcaggtgaagatgcgcaaacgctacagcgtggacaaatctctcagccacccctggttacaggtgatgcagggggcagggctggcccattggctggattggaggaaggggtgggagtagatcgcttattggctaggcaggttgtgaaggatgtaggtttccttgggtctggaatgtggctaggcctcccattggctgggtgcaggaagagggggtggagctaaatgtctactggctgggtgggttgcagagggtatggcttcaccttcattggtacccagctctcagtggcaaaccagaggatatccaggcactgctccaatgcagaccccaagctaaccccagttctctcgggcccaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcagcacacggcactctcgaatcattactctgttgtaccaacatggagttcatctggaaggaggactgcctgaaaagaggaaggatggaaggggtggggagagaggactgatgggagaggagtcttggaaggaggacgagctggggtagaaaatatacaggaagagtgccaggagagaagatgagaagggagagggaggagtaatggaggaggagttggaaactggggagagatggaaggaatgtgactggagggtagagaacttggagaaaaagtaatctcatggtttgtgatgactgattttttatttggtggtggtgttactactaatcacaactattaattcaggctgggtgtggtggctcatgcctataatcccagcaatttgggaggccgaggcaggcagatcccttagatctcaggagtttgagagcagcctggccaacgtggtgaaactccctttctacaaaaagttcaaaaattagccaagtgtggtggcttgcacctgtggtcccagctacttggaggttgaggctagaggatcgcttgagcccaggaagcagagattgcagtgagccaagatcacacaccactgcactctagcctgggcaagagagtgagaccctgtctcaaaagtcaaataataaaatgcagttagcccaagtctgatccatactagaaaactgatacgtaacattcagtattttattttatgttgatgtgatgacttctctatctatgaaatagagaagtatatattcactcattcctttgtgtcactgagctgggtgatgctggggacacagtggtgactgagacagccaaggactgccctgccagtagagagacatacctgcccctggacagtgatgacccagaacgggaagggctggactgggggagtttgggaggcttgggcagcctagaatgagctcaggggtcagagagagtggggaatcagaggtgacctcttaggcttcatcttggccttgaaagactgaaggcagagggaatgaactggagggaacacgtatccacctctctctacctttgactccagccctccacctccccagttctccagtaacaccctaacacatggtcctccaccttccacagctgaaggtgaacgatccgagcatggacctgaacaagttttcttcagactttcagaacgctctgacttacgtgctgcaaagacctatctgaaagctgggcatggtggcgggtgactgtattcccagctacttaagcggctgaggtgggaggatcgctggagtccaggagttcgagtccagtttgggcaacacagccttaaaaaacccaggaaaacaggaaagaatttagtagccaatttaggctaatactgggagcttactctgggattttccaatttgatttgtatcaccttgtccatctgatggttccagagctgcagcttttttttttttcctgaggcagggtctctgtttcccaggctggagtgcagtggcatgaacacagctcactgcagccttgaccttctgggctcaagtgatcctcccacctcagcctcctgagtagctagaactacaggcacatgccaccatgcccagctaattttttggattttttgcagaggttttaccatgttgcccaggctggtctcaaactcctgggctcaagcgatctgcctgcctaggcctcccaaagtgctgggattacatgcatgagccactgcgcctggccaaaatgcagctctttgatttgaaaatgctaaacgagcctcagtaaatgaaggtatccaaaggagcagtatacctctgaggcatagttgctaagactattggggaaaggctcttagactccatccccagtgcctatccctctgtt

SEQ ID NO: 13241 - DNA, 47493 bp, Human
tggccaggctggtcttgaacttctgacctcaagtgatctgcctgctttggcctcccaaagtgcttcgattacaggcatgagctaccatacccagcccactttgagtatttgtgatggagtgaatataaaagtactactctgtgtcaggctccctgacaaatgctgtactcatgttgtcgaactctcctctaatcctgtatgatggggataattattatccccactttacagaggttgaaactgaggcttagaagagggtgatcacttgcccaaggtcacagtgtcaggaaggattccgctggactcgaaaccagaattcaaatccactatggcagctccttttcccccaaccccaaaacaaacaatacgaacaaacaaaagaaaaatttactaacccaccaagatgggctctggcacctacagaggcagtagagtggcaatgaaggacataggaattagatgggattcctgatcctggctctgtcaccttcttatgttgttgtgaccttcgtcaaacacctctgcaagtctgtgtctttatctgtaaaatggagatgatactaatatctgccctttagggtgattgttggttgtgctgggggccagtaggagagatggggttggactaacaagaggtttgggagtgggatagataggtttaggagtgtgcttccaggaggggatccagagccttacaggacttagtgctacatgagggcttagaaaggacagactggaagcgtgtacggcgggtggggattggcaaaggggtggaatctggatattagactattcagcctgaggttaagactattcagggtctcctaatcaggagtttgggttttctcctaagggtgctggggccatggaagcctgggagcgagagtgtgccatggttttatcatgtcttagaaagatccctcggccgggcacggtggctcacgcctgtaatcccagcactttgggaggccgaggcgggcggatagcttgaggtcggcagttcgaggccagcctggccaacgtggtgaaacccgtttctactaaaatacaaaaattagccgggcatggtggcgggcgcctgtaatcccagctacttgggaggctgaggcagaagaatcgcttaaaccgggaggcggaggttgcagtgagcctagatggcgccactgcactccagcctgggcgacagagggagactccctctcaaaaaaaaaaaaaaaaaaaaaaaaatgtgaagggtaaactggagggaggcagagtgcatgcaatcaatgctgtgatctcagacaagagaatctgtaaaaacacaaacaggagagtttatttgaagattcaggatttgggaagctgaacacaggaagaaaggagatggtgcaacacacttctaagccttgctcaggacttgaaatccagagtgccttcagttaaaaactcaaacactgaccctcaaggttggaccctttttggcttgagaaaccactaatttttcagagatgggtaactgagaccctagagaggaagggaagatttgttcaaggtcacacaggtagtcgacaatagggctcgacgcccgggtccggctccgcgtagggcatggcgctgccttgcaaaacagccacacccgccagcgacattcacaacccaccccccaaccctagaggacagcggggaaatcccactttcagaaccgagaaactttttacagccttggaacacggtaactttgggaggagaggccacaccaggtctgtttccccgcgcgccccttctctcattccctattggctctctctaccaggggtaccgtctggggaacctctggtcaccttgtcctccgcgcgctctgtggcgaaagggacctgcgcaggcgcgtgaagggcgccttcagggcccgcgctttacgacacttgtgcggcagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaaggtgcgcccgcctggcagggagggtggacagtggcccaggctgaggggtgccgggcccgcgcggaaccatagcaacgcggagctgcagcctgggcgcggggcagacactaccaagtgaccgggcgtggggaggcccaggatggcgctgccaaggagcgacatagggggcttcggagagtgatacctaggagtggcgtgcggagcgggtgctactcagtggagagactgaggagggcgccaccaattgtggggcgagagggggactggaatgagggcgctaccaaacgtgaggcctgtagagggcgctaccaggcagtgacatgtggtgggggagtgattgatggcgctaccaaatggggagtcctggggtgggtgccgccaagtggggggtagagggggcacagccccaatagagaaggcaatcgtgggggtggggaatggatcattagatggggggaacaaggaagtaggagatttgggctgacccgaggaaaaggaatgtgatggtgggggccttgggagtaagggtggggatccttaagaatagtatcacttagaatattgagagtcaagtgtggggcacccattcattcattaattcaacaaatatttattgagtacctgttatgtgccaaggactgtgcttgactttggggatatagcagtgaatgagacagatgtggccctgtccttagcttgtaattttgcaggtgaaccagacatgaaaaaaaaaaaaacaaaaaaaaaccatgtaaataagtaaaatacttaaattgtgatgagtgctttgaaagcaaaccagcagtgtgatgaagtagagaataagggttggaggctactttagatagggtagtgggggaaggccttactgagcaggaggcgtttaagctgaaactcacagagggagaactggagaggagtgttccagggaggtaaagcagcctgtgcaaaggccctgggatggggaatgaaagggtactggcatggctggggctttggctacttagggggagaccaataacaagatgagattaggacagaggccagatcatgcagggtctccgtgagtcattacaaagaccagtttggaattttttttttttttttttttttgagacgggagttttgctctttttgcccaggctagagtgcaatggcgcaatctcggctcactgcaacctccgcctccctggttcaagcgattctcctgcctcagcctcccgagtagctgggattatagacgcacaccaccatgcccagataatttttgtacttttagtagagatggggtttcgccatgttggccaggctggtgtcgaacctctgaccgcaggtgatccgcccatctcggcctctcaaagtgctgggattacaggcatgagccaccacgcccagccctacaagaagacacattaagtaaatgggccagtctggactggagaagaatttgggcgtgatcaaactatggttgggaatggatgagatcatctagtaagagggtctagaggggggacttaggacagaacccaaatggaagagggtgaggctaaggaggagcacttagtgaggtggaaaggaagccaggaaaggtgtcgggaaggctgagagaagggagcgcttctagaacaaggagctggtgcctttagtccgatgctgccaaggcaagcactggccattggctttggctccatggatgctggtagtgatgttgacaggagcagttattggggagtgatgggggtgatgcagccaggaggtgctgaagagtgaatgggaggggaggaagtggagacagcaaatgttaagtgttaggagtattggttctgaaggggagtggagaaatgggggagggtggtaagacgagaacgtgcacaggagttcgagaccaacctggccaacatggtgaaacgacgtctctgctgaaaaaattagttgggtgtggtggcacacacctgtagtcccagctacttgggaggctgaggcaggagaattgcttgatccttggaggcagaggctgcagtgagccaagatcacaccactgcattccagcctgggcaacagactccgtctcaagaaaaaaaaaaagagagaagatgcagtgtcagggaaagatggattttttgtaaggatggaagagagtagagtccaatagagatggagaattgattctgcacaggagaggggggacttgcagcagcaaaaccctggagaaggcggaggtgggaagggtctggagccctggaagagacttggcctccaacgggagcagaagcaaagtgtggagaagctcgatccggtgggagccgtgagagggaggtaggaccagtgagagatgaggccagaggtagaaccttggaagtcagattggggaatatgggtgtcatcctgggggtggtcgatgccatgggaagtttcaagagcggggtgctgtggttcagttagtgttcagaaaagatccctggctgccatgcagagactggactccagggtaagacaggaaggagtctagattagtggacaggtgaggaggggtggtgatcgccagccaggctggagggacagaaatagattcaagaagtgtttcagggaggaagtgagagtggctgcctggagagagggtggacggtactccaggcagggaaaaaaaaaacaaaaacaggtggcaaaggcccaaaggtgagcagagccaggcatggaggccataagtggggccacagcgtaggaggctggaggaggttatgatgagtttgcagggagtagattgcgcagggctgtaggaaggagccagggctttctggggtggggtggcggtggggggtggggctctggggagccctgggaggttctgagtagggaaaggacagggtcaggtttgtgttttaggaacacccctctggaggggcaggacaagaggctgcgaggccaggtggaggctgagccaggaacctgggcaggagaggccagaccagggctgggtggggctggagggtgagaagggagtggctgaatctgagagatgttcaggaggctgacttggcagaataagtgaagtgactaccgggctttgggggctgagggatggagaggagtccaggatgaggctgtctcagccaggtgatggggtggaaggtggaattccctgggatgggagcagcctgcttgggggttgctgctgaggccgcatcagaattctgggccacagcagccattgggaggagcctgttgccccccaggacctgggatccaggctctcaggagtcctggggctgggcaggcagccagaggggcctggcactgagctggcacggaggagaacggccctgctggcccaggccccttgctgtctgtcaggcagtagcaggcacagagccccaggctccagggctgtgggaataacaataaaaaagaataatgacagctcaccttaattgagccttgtggccaggtacgctgtggggtttaatcctccccgggggctgggagatggctaggagtggccctgtttgttttataaaggaagcaaggctcggagaagtgaaaaaaccactcgcccaaggtcagagtgtgtgagcagcagggcccggatatccccttcctcgccacgtgcttggctcccacgttcaggttcctcccagagctgtactggccctgttgaggagaagaggggccccagcagggagaagagaggtcccagggctcagaggactgtcccctcaactgtggctggttgctctgtaagttcaggcctattccagaaatcctgggggcagagcctcgtcccccgtctcatgtctgagtctaagggaagtgtctcaactgtcttcccctctctgtgggcctcagtgccccgcttctgtaaaatggggggtgggggcttatgcttaacccctaaggaggctccaggtataagagcttgtggggaggaagcaggccatggttgagagctcaggctgcctgggttcaaaccctatgtcttcctttacctgcttgatgacgcctgggcaaatgacttaacttctctgggcctctgtttccttgcatctaaaatggggaatgtcttgaggcttaaatatggtcctgtttgtaaagcgcatagaacagggccaggatatggcatgtgggtcgacccgtggagtacaggctcctcccatttcctcttgttcccttcacttcctcccttcatttagtcattcacgcattcacttcttttgcctgcttcttttgctgcagccagttttcttacacaagttcgtaaaatcctcacggccacccagtgaggcagagctcagaaagaggaggctatttgcctgcagcctcgagttagagatctgcagagccgggtggcaggccctgagactccaggatcccctccctgtgccactggagtaacagctgccccatcaggagcgcgggccaggcagcctctggaccacagccaggaggcctgaaggagtcctcgaaggcgctggcattccagggagggtcggtcagatctgggctgcccggttctgcccttgtttgtttttgggaagtcccgggccctgccctcctggggcttacagctctggagggacacactcattactcaacagtgacgatgagagtggacagggctggcacaggagatcccaggggctggagcagcccagtcgggggcctgacccagcctgggagtaaaggagggcttcccggaggaggggacatgtgagcatttgaaagattgccaggagttggcgtggcaaagaggaatgttgttagattgttgctggccacatccccaggacccggcttctcccttctgtaatgtcagtcctcatctctctctgcatccctccttcctttccctctggagccactcatggagcctgggactctcttcttccatctcttcaaccaactgactcccatcctccaggtctcagccccagtgtcccctccgagctgccccaaccctaaacactgggcaccactgtctagggatggatctgtctcctccactggatggtaagccctgggagggcagggctgtgtgtaagaaggactctcggagtgctgttgagaacattaaaatgggagtgagggtggggactctgtgcagggctgctggtagaaggactctaggaaaccctagtccacagggggttcctcagtagcccagggatacccaggtagtaagaggcagagctagggactgggcccaggccacctactcctgcctctgtgcttacccctgtgccacgctcctgcccagaggtcaccatggcatggggcgtgagagtgggagccttttggtcttggcctggctcagaaggcccacttgtcggccaggcgctgtggctcacgcctgtaatcccagcactttgggaggccaaggcaggaggatcacgaggtcaggagatcgagaccatcctggctaacacggtgaaaccccgtctctactaaaaatacaaaaaattagccgggtatagtggcgggcgcctatagtcccagctgctcggggggctaaggctggagaatggtgtgaacctgggaggcggagcttgcagtgagcggagatcgcaccgctgcactccagcctgggcgacagagcgagactccatctcaaaaaaaaaaaaaaaagaaggcccacttgtcacctgctgtgtgaccttgagcaccggcctttcttccctgagcttcagtccccagatttggagacgggggttaatgtagtttccctgggcttgtgagagttcagtgaagggggacctgtgtactaaagccctgcatggctctggtacatcacggcccccagtggggacaagcctctaaggctgtttaagccttggctctcctgcctgtcaaatgggcacgagggagggatcaagcctggctctgcaggtgcagacagggcatttgaccttgagcaagacctccatggcttgtctgtaaaatgagcaccagatggtccttactcccgtggagacatgaggattccacaggtcacgaggtaaagtgcagggtacagctatagctcatctcaaataaaatccgacctctcctccttggccagatgtcacatcctgtcactccacacttagaacatcagtgtccagacctcactgtggctgcccggggcccagggatctgtcccaccagcctccctgcctcatctctcctccccctgcccactccacccagctgcctcagctctcactggccctcagacaaggctcaaccacctctgggcctctgcacctgctcttcttgctatcggagtgctcttccctcagtctgctgctagtgcccagcttggggctggaggggtgggtgggcgggtgtgtggagtcctggagactgtggccgagaggacaagccctgagctaggttggttgggacaggcaggaggggcaggctgaagagatgtctctgggctcagggtagccctcagcttccccatctgtgaacagggagactgggcgtcacccagcccagggcctgtcctcgcagggttggagcactgcctcatgcctcttcttctgtctccgcagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtgagctggggagtgggccaggcctggcacctgagccagacagatactgagggctgggctggcggggacgggtgtgaggagccattcactcctctacttaccactcagccagccagcaagtgcctgtggggccttgggcccaggccagagtacccaggccacagctctgctcagccatctcacattttgtgaccctgagccagttaccccgcctcgccacaccttcctttccatatccgtgaaatgaggagaacaagaggatcagcctcaagggtagcggtgaggaaaagtgagcttttgcctttcacacgagtagaccagtacttggcccggggtcagtgtcctgtgatggttcacctgatggttactgtcattgttagtgctggtgctggacaggagccacacagcctctcttcttctggtggagcttgtctttcaggggcaggcagaaaacccaccactgaataggttagcagaataattgcaggtgaggatctgcactttgaagaaaagaggaagggcagtcgggcacagtggctcacggcagtaatcccagcactttgggaggccagggtgagaggattgcttgagcccaggagtttaagacaagcctgggccacatagggaggagacctcatctctacaaaaaatacaaaaattagccaagcgtggtggcacgcacctttagtcccagctactcaggaggctgaggcaagaggattacttgagctcaggagctcaaggccgcaatgagctatgctctcaccactccactccagcctgggcgacacagtgagaccctgtctcaaaaaaaaaaacaagaagggtgatatgctgccagggacagcagacaggatatgtgtgatatgctgatgagggaggggacctagggcacagtgagaattcgctagtgccctcacccacctaatgaaaatcctgacggtatgaggctctgcagagcgagcacacaccttcacaccaggtgtgctctgcatcttccttcagggaggctggctgaatcattacagcaccctgggacgtgggaactgggattactccccttgcacagatgaggaaacagtccctaaggggtgaagtcacctgcccagtgacccccacctggttagtagcagagctgggatttgaacccaggaggcctggcctcagggccttatctctcccacctcagagttcgctccctgagacggggccgtgcgcttgtcctgcgcatggggatggtgcagcagggggcttggtcagtgtgtgtcgagaggattgttatcctgcccccccacacagacacacttcactcccgccttcccttgcaaccatcacactcggagctgcttgtgtcgtgtagggaggggcaaccagggagctgggagccgcgagtctgcagttggtcgcggggctgagaagcacgagtctgcagtcggtggagccagctcagacactgtcctggctgttggccgctggcctggggtggagggtggacttcaggccaggtgaaggcttgagctaagcatgagtccaggggacacatgttaggatgggggcagagatgtggcggggggttagggcgacacctagaagggtgggggcaggggcagcagagcagaggccttcccagcttgggctcccaagccattcttggccaagcccctccctcattgtctcttcctgtcctaatctagaaaatggtgacaagaggagtggccgcctccggatggctgtggctgtgatgacatggttgagtaaaggtcacgagctgcagggctcagtaatgagtaaccaaggacagtcggtgttgggttggggcagggctccaggtgggaagggggcctggggagacagtggggcagaagagaggagccccaaggacaggtttagggcagggtcttcatctcgtgtggggctgcaggagcatctttccccagggtaaggagcaggggctgcaggcagggtcttcgtcaagtgtggggctgcaagagtgtctttccccagggtaaggagcaggcttttcaagactctggcccagtctagggcccaaccccgcatactcccaaccccgcatactccctgaggctgggctggttggcttcagccatcttgtgggtgtgccacgtctgagctgtgtcccaggcctggcggatggcagggagggttgagggggtggggaattcagagtcttttacagaatacccagcacctaaattgtcatggcccatttccccatgggggctctcccagcagcattggggacccccacatgaacatgagggcttacctgtcatcaggccatccatatgcctgcaggccttcagccttgctcctttctgcgcagttcttcaggctccatgtgccctggggcagttcatcttcccaagactctacctcctgcttgctggatgctagagtttcctcctagaccagaagctcgccagggaagcagagcaaagacgtgaccttggccttgggcgggggagctccccttagcctcggtttcctcagcggtctgctcactctgggcccagcactgctgggagccctttgtgcacctgaattcagcctgaattcagactgaggcctagagaggagatgtccctcctccaaggtcacccagcagggaagtggcagagctgagacttgaacccctagtccatgcttgtaactgtttctgggccacaatcagttgaatagcttcagcacttttgtcttcatcaaacagagaattaaaaacggttcattgtttggaggaagtgtgtataaatattgttttgtggaaatgacttttcatttacacaagtacagatgagtgatggatgtgatataaaaatccctattttacatgtgggctgcaggcagagagtctgcggtcaccagtgcaggggctagatggggcaggctctgggctcaggacgcctaggttcacagccagctcagattgggtagcagctgcatggctcctagtgccttttttctcagccttagtgtcctcatctgttaaaggaggtgagaatataggaataacaaccaaagtgttttttctttgtttttgttttttgttttttgtttgagagagagtcttgctctgtcacccaggctggagtgcagtggcacaaatcttggctcactgcaacctctgcctcttgggttcaagcgatcctcccacctcagcctcccaagtagctgggactacaggcgtgtgccatcaagcccgggtaatttgtgtaatttttgtggagatggggtttcaccatgttgcccaggctggtctcaaactcctaggcttaaggaatttgcccaccttagcctcccaaagggctgggcttacaagcatgagccatggcacccggccccaaagtgttttttctattctctcagtcaacagttacacagaaaatttctgtgaccactggtcacgaaagggagtggaggtctctccctaccggcaaccaagcagtcgattctgcagtggacaccagctgggtgttctcttattgaattaattctgacactatctgtccagagatagcattagattccacaggttgaggacttagtccccacttgtcccttatttctgatgctgatcacaagacctaggttattttgccggtgattctgactgactggctattaattagggtttctgtgacccactccttgggttcaattaatttgctagagaactccctcatggaattcagagaaacacatttaccagcttattataaaggctgctacaaaggatacagatgagatgcgcagagcaacgtgtgggatggagtgcagagcttccgcgccctctcctggagcaccactcttcaggaacctccatgtgttcagctattcagaagctccctggacccagtcctttcgggtttttatggaagcttcattatgtagacatgattaattataccattggtcattggtgatcaacttaaccttcagcccttctcccctcccggaggttggagggtggggctgaaacattccaaccttacaggcccactttggtcattccagtgaccagcccccatcctgaagctacataggggtggctagccattagtcaacacatgagcatgcaaaaagacacatcactttggagattccaaagattttaggagttatgtgccagaaaacagtacatgatgaatatcaaacctgtatttcatagtaccgctggccacccgtggtcttcaaacacagttccctcatatccaaagaatatacaactcaaaaggtattactggccagtttgttactagaactccattaggtcattaataattagttcatcatattatatgattatgtctcccagggtgagaccagtcaggtttgcaggtttctattcagtcttgccaatttccaaaagcaggcgtgatctcagcaaatatatggctcccccctttcaggcattaggtataattgagataagagacaatgtcacccttgttctgagcctctttcaaagtgttaatgtaatactggagatttcttaattcataactcatttattcattcgtttaccctcgtaaatgttcctccgtttcttcatttatacctgttgtcctaaaggaagaaactgaggcaaaattaatataagtagagattttatttgggccaaggttgaggaccagcctgggagcctcaggttatctcgggaagtgctccagagaacagataagctcaagcgtttaaagacaaaaggataaatcggggaggagtgattacaaagggtgtctttcaggaattctcattggtttaaaaaataacattgatcagtaattggctctgcgttattaaattacagggtgtaagtgatggcatccgtgtatggcattgtgaggttgatgtgtagctgtctctggactcttactcttgagtccacagggtcagtggcttcgggggatgagtttttctcaagatggggagtgggacatgactgctccctcattccagttcctctctaggctcaatcatttaaagggggtttgcattactcaaggaaaagtttcttttctttctcatttttcccttttggtcaaaatctttctttttaaaagcattgatcagagtctgagtgtcagggtgtccctcgtcactaggaaggctcactttaggacaggcctgttctatgttggggagggggaaggagatggctcagtgaggaattttcagtgtgtccaaaagctgaagtaggatggcctcacagagtggcaaaaagaagacctgaatcaagtcactgatttatacagctgcgtctctgtgtccaatcatctctagtcttcagaataccatgattttcattttctcggaagtaaaacaagaagattagtaatttaaatagtagaaatataatgcacataaggattataatgaaaacaagaatgtatatgccagaatgaaaaaaagagccttttccaattagggagccagctaaaaacatgaggaaaatgaaacccagcttctgctttggggacttactgtagccaagatagaattcaagattcagtacaaactgtaggcaagtaataaaaacccaaaaacagtggtcagggctagaatctaaacacagatgtgcaactgaagcatcatttttcctttccagtcccccagttttaccaaagacactaataatagcaagaccaatttattctcaaaataagttttagtgttatactttatttgcataaagtacagcaagattagtgactgaccatatagactccttttaagttggctttcccggaaaatgaggaatttcggattagactttttttttttttttttttttgaggcggagttttcctcttgttgcccaggcaggagtgcaatggcgcaaactcggctcactgcaacttctgcctcctgggttcaagtgattctcctgcttcagcctcctgagtagctgggattacaggcacctgccacacacctggctaatttttgtatttttactagagacggggtttcaccacgttggccaggctggtcttgaactcctgacctcaggtgatccacctgcctcggcctcacagagtgctgggattacaggcctgagccactgcacccggcctgtaagatactttttgagaagaattaaagtaaaacaataattgcctgtgtatgacagaggacttagaacagccatggttaaagactcaattgaccaggaaatttggctatttctgcagcatataatttaacataataatcataattaataactgataacatatacgaggacatagtttcttttttagaaatctgtacaattttggaacatatattaatgagacccatacaaatataacaaaaaagatcagcaccatttcctacgtgacaatacttcccatatggtttttaacatcccagataagcctaatatgtctctcttggtcttccggggtccctgacatccagaagttagttcgaggtcaaaaagacttaattttagaatttgaaattagatttttctttgaaattagatttttctttttttttttttcttttttggagacaaagtctcactgtgttgcccaggctggagtgcattggcacaatcttggctcactgcaaccacggcctcctgggctcaattgattcttgtgcctcagcctcccaagtagctgggattacaggcatgtgccaccacaccccgctaatttttttgtattttttgtagagacagggttttgctatgttggccaaggtggtcttgaactagcctcaagtgatcagcttcagcctcccaaagtgccaggattacatgtgttagccaccacgcccagccctgaaatttggttttgtaaaccctacaaatgcatcaaaggtttgaaacacttaatcaaaataggatcacacatcactgtgaaataatatagtcattcatttagccaaagtgttaattagaagatttcaaaaagcaaaaacctttactctttggtagagaggagactcagtttcccaaataatcaaaagacctaataaagacagcataagagcaacagaatctttctctccctctccccttttttgttttttctgtgttgtttgtttgtttgttttttgggatttttgttttgttttgtgttttgcaatttacccaaaagataagtgaaagaaaatttttttttttttttttttgagacggagtctcactctgtcgcccaggctggagtgcagtggtgcaatctccactcgctgcaagctccacctcccggattcaccccattctcctgcctcagcctcctgagtagctgtgactacaggtgcctgctaccacgcccagcgtattttttgtatttttatgagagacggggtttcactgtgttagccaggatggtctcaatctcttgacctcatgatccgcccgcctcggcctcccaaagtgctgggattacaggcgtgagccactgcgcctggctgaaaaatcttttattatcttttactaatactacaccagccgggcatggtggctcactcctgtaatcccagcactttgggagactgaggcaggcggatcatgaggtcaagagatcgagaccatcctgaccaacacggtgaaaccctgtctctactaaaaattaaaaaaaaaaaaaaaaaaaaaaaaaattagccgggcttggtggcatgtgcctgtagtcccacctactcgggaggctgagacaggaaaatcacttgaatccgggaggtggaggctgcagtgaggcaagatcgtgccattgcactctagcctggcgacagagccagactccgtctcaaaaaaaaaaaaaaatactataccaaaattttgctcaaaagagaaaaacaaattcttcctttgcatcaatgtattatttatggtaaagctaattttaataaaaccttataaacaaatctatccaatctcaatcagctttgaccatacaaaataagatttccatgaatcttttgtaatttacaaatttttccattcttttttctccctactttccatatctattcagtttatctcattttttctttcttttattccttcaatttaatacaacctttacctctaaactaagtaaaattgcttttcctttaacaaaaccacatcctctgtcttgtgtataaccttccttaccaaaaccacatcttagacgttctgtgtacagaattgtttctcttggttatcacatattagaattttaactcttagtgaccgtaattcatagcaaaaacctaagaagcaagcaatttttaactgttagtcatgtagcagtaatttatgatgccatctttataatttttagaaatatagggtttctaatggaacaatttttcaatggaacaggacatttttcctaacagatctcagtatcttttgtttctctaaaataagaagtcagaagccatatttagtagttactgtcttagcatcatctcttatttggaaatgatctagatattcaatgaatatttgtcattaatttagcttagtaaaaccctaagggcataattaccaaaagatttgagaaacctttttaagtaggcatattataaaacataattattattaaaagttcatttataaagttgattctatttatatgtatttaatttattcatttttagtgattgttgggaaaatttcgtgagacagacaaatccaaccatcatctcaagttaaattttctattaaccattttttattattgtacgttaggcaagtatcatagaagtaagaaccttaaagttagatacatacatattttgctggtaactcagaaaacatagtttttatttatttatttttattttttatttttattttttttgagatggggtctcactctgtcgcccaggctggagtgcagtggcgcgatctcggctcactgcaagctccgccgcccaggttcatgccattcccctgcctcagcctcccgagtacctgggactacaggcgcccgccaccacacccggctaattttttgtatttttagtagagatggggtttcaccgtgttagccaggatggtctcgatctcctgacctcgtgatccgcctgccttggcctcccaaagtgctgggattacaggcatgagccactgccccgggccgccgacatagtttttattaaaaccatcccggctaaaacggtgaaaccccgtctctactaaaaatacaaacaattagctgggcatggtggcgggcgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaaaaaaaaaaacaattttaaactagttttatttgccaaaagatttactgatttactcaggtcatgtgaacttggaaaatctttgggcttactttctttatttttttctttttcagacggagtctcactctgtcgccaggctggagagcagtggcgcgatctcggctcactgcaatctctgcctcccagtttcaagcgattctcctgcctcagcctccaagtagctgggattgcaggcacgcaccaccacatccacctaattttttcatacttttagtagagatggggtttcaccatgttggccagatggtctcgatctcctgaccttgtgatctgcccccgctcagcctcccaaagtgctgggattacaggcatgagccactgcacctggcctcggtttaccttctaatttgtgagtgctcgtttgtctttaattttgtatcatgtagataatatacaaaaacatgtatagacataacatatatgtagacacaacatatagcacacatgtacacatgtatgtatcgacaagttacagagatcaaggagctctatgtaaaagagaatagagctttagacctgagaggagcctgtttacccacaatgcttggggctccatgaggataaacagaggttcactcatgtgataccaaaggtggcaagaggaaggagggacagacagcggtacatcaaagaacaggacttagaggagccagtcaaggagatcttgttttccataaagcaattaagttttacattatccttggcaaaaatcatgtcaacaagaagaaagagggattgtgtataattaggagcagtttgagaagagaggaaatcagagagaacagaggcatcaaaaaatatatatatacgtgtgtgtgtgtatgtgtgtgcatacatatgtagccaaatatcagcttttaatcaagtcagcttttgactatagagctctttaaaaacttttaatcaggttttagccaggcagatagtaaacattcggccagatgcagtggctcacccctgtaatcccagtattttgggagaccgaggcaggaagatcacttgaggccagaatcctgggcaacatggcaagacctcttctctagtctcaaaaaaatgtttttaaacagatagcaaacctatctgttccttggctttccctttctgaaattcacatcaaggagtttgctttgggaggtgggtcatatttgtttattagaggtctagggtaatcattatttaaagctatttgtcttttgtaaatcttgcagcaaagttcagcagacagttggagcatttaaagggttttctgggggagtttcctaaaaaaaaaataattgtacctttcaaatctcttatgagattgcagccaggacaaataggaagtaggtctccattcgatttgtctggttctaaatcctgccttttccaattgtgtgcacaaatacattaatttaggaatttcaagaccctcatttgggccattgcactttggggtatctcacgccgctgggtccatttacctaggtatttgcaggatggcgctccataggtattagacataaatccagctggtgtttcggggccggggcgggggggctgtcctttaaggcaaagctcagtttcaatgagcagtttcctataattttatttatttatttatttgagatggagtcttgctctgtcacccagcctggggtgcagtggcgcaatctcagctccctgcaacctccgcctcctgggttcaagcaactctcttgcctcggtctcccaagtagctgggattacaggcatgagccaccacgcccagctactttttgtgtttttagtggaaacggggtttcatgatgttggccaggcaggttttgaactcctgacctcaagtaatctgcccacctcggcctcccaaagtgctgggattacaagcgtgagccaccatgcccagctaatgtttgtgtttttagtagaggcggggtttcacgatgttggctaggctggtttcaaatgcctgacctcaagtgatccacctgtctcagcctcccaaagtgctgggattacaggcgtgagccacacacccagcctcctataattttagaatttccttctcaaaagtgaccaaggccaggacagtatattgggtcgaggtgtgccgctttgtgggtgtcactcttccaggtgtcaccagtgaatcgtgaggcatgttcttatgtgtcttggaatctcttatcaccttgtggcagcagagtgcttcaggtatcagagtgaccagtcccttattcatacctttccagctgagcaagagtccttactggtcttcttcctaatgggaggccctttaagactccaacacgtcatgcatggaaaaacgtccccatacctctgcaaagtctctggttgcctaaagaatccagtgggtcaaagggggcaattttctcttctctttgaggcaagatgacttaccctcatgcagcttagtcagaagcagctgcaatttaaaaagcatgctgtctaatttcagcccagaagtgcagccaccagtgccagaatgccagtactgtgacccgggcctcctgctgtgaagcagcggtggagaaggcagttttctttttttccccctgaaactcgaatcccttgctcatagacaaagatggaaaccttcattctagaaaaagagagatagaaccactcaaataaagtctagacctcatctgacaagagagggggtccagattcaggagcactcacccttttgcccccagtgaacctgtggaattggaggaacacagtgggtttgttctggtactgagcatcgagtccaggggcacccagtgtctgagtgggtagctctgaaccctgctcacagggccaaaaaacattgacataaccgaagaaactgaggcaaaattaacatagacagagtttatttgggccagggttgagagaattgcagccctggaaacactttaagttaccttgggaagagcactggagaacaagggagaggcttgtggtttttgttttttttttagagacagaatcttactctgtcacccaggctagagtgcagtggcaccatcattgctcactgcagcctcaaactcctgggctcaagtgatcctcccacctcagcctcccaagtagctgggactgcaagtgcatgccaccgtgcctggctaatttttttctttatcgtagagatggggtcttgctgtgttccccaggctgatctcgaactcctggacttctgcctcagcctcccgaagtgccaggattacaggtgtgaggcaccatgcatggcctgcttgagcttttaaagaaaaaaaggacaaatgagaagaggggtgattataaaaggggttttgcaggaaatatcattggtttacagaaataacattgattaataattgcccatccattgtggaactagagggtgtgagttacggtgtctgtggttggtggcagtctagagtccacgtagcacgtggcttcaggcgatgagtacttctcttaagtgagaagtgggatatgactgctgtcctattccagtgcctctctgggcctgatcatttaaaggggctcaccatataacttttctttctcatacccacccttttcgaagggacattggaattggccactgtgctggatctaggtcgtaggcagcaaagtaatctagcacatgcctcctcttagatcacttccattcagatagggtgtggttacataggtgcgggactagtgggctatttttatcagcaggctatataactgcattcactgttagccccagtttcaccagatggtgtgaaagcacaacccactcccatccggcccttgggaattctgacagaaggtttaaaaacatagttacggtttcttaggaattatccctgcttccagcacttggtgctggtagatagagccttggtgctaggaccattacatcaggtaggagaaagaaagagagaaataaaatttataatcactgtaccagcgtatttctcccttggctagaactgcagagtcacaccaacatcttccccagattctgcatgtaatgttgctgcttggggagtttgagaagatgctgacagtttgaagcagggatcagaaggtggcccaccaggagtgagctggagatgcccggtctctcttggtttaacatagaggacggggaatcaaaggcttagggaaattgtaatgcttgagtggatttgtaacttaaaacccactcacccacactggagggtccagagaacacacctttcaccaatactttgagaagcagatttatgagggggccccggcatccctggttgctcctctctgcaagctggaccttacggtgggaaccgcagtcactcagttggaaaacttacatgcagtgggaacaattagatcctggagaggcagggaccaagtgtcagcactcagctgctgaaggcaagatgtctgtcatggacacagaagcaaatccacaattagaataatctgactgttgcgccccagtcagaataagggcttatgggggcctggtgaggaatggagttttagctcaggtccgactctcagtgggttgagtgggtccctggacccctcctgtggtcatttcccccgttccagctgcacaattggaataaatgtactcagcagctggcggaaaatccccacgtttgttccctaagctgtggagtaagggccattatggtgggaaaggctaaatggaagccatagagctgcctctacctaggaaaattgtaaatcaaaacagcagcacatccctggagagattgtagagattagtgccaccatcagagacttgaaagctgcaggggtggagagccttaccacacccccacttcactctcctgtttggcctatgcagaagacggctgcatcctggagaatggcaggggattatcgtaagcttcaccaggtggtgaccccagttgcagctgctgtaccatgcggtttcattgcttgagcaggtgaacgcatctcctggacctgccatgcagctactcgtggcgagtgtcctttctccatccctgtccgtaagacccaccagaagcagtttgctttcagttggcaaggccagtgccacacccttgctgcctgcctcagggacatatcagtccttcagccctgggttacagtttccttcacagggatcttttctttttaaaaaattaatgaaatttttattaatttgttacctttttattttaatagctttgggggtacccgtggttttagtggcatggatgaactgtataacagggatgaactgtatagtggcagagtctgagatcttagtgtacccgtcacccgagtactgtacagtgcacccagtacatagattttacccctcacccctcccactctcccccttctaggtctccagtttccattataccactctgtatgccttgcatacccatagcttagcttccacttacaagtgagaacatagagtgttttattttccattagtgagttatttcacttagaataatggcctccaactccatccaagtctacaaaagacattattttgctcctgtttacgggtaaagtagtattccttcatggggatcttgatcacccttcccttctgcaagctatcacactggtccacgacactgatggcattttactaattggacctagtgagcatgaagcagctactctgtacttattggtaagacagtgtggagtgaggcaattctcctaataaacaccctctcatatatatccacatgcataggtatagtcatgcattgcttaacaaggggtagtttttgagaagtgtgttgttaggtgatttcattgtgtgagcatcatagagtgtgcttacacaaacctcgatgttacagcttactgcatacacacctaggttatgtggcatggccgagtgctcctaggctacacgcctgtacagcatgttactttagtgaatgctgtggcaactgtagcaaaacagtaagtatttatgcatctgaacgtagaaaagggatggtaaagtcatggcttacacctgtaatcccagcactttgggaggccgaggcgggtggatcacgaggtcaggagatcaagaccatcctggccaacacggtgaaacaccgtctctactaaatatacaaaaaattagccgggcgtggtggcaggtgcctgtagtcctagccactctgggggctgaggcaggagaatggcgtgaacccgggaggcagagcttgcagtgagcggacattgcgccactgcaccccagcctgggtgacagggcgagactctgtctcaaaaaaaaaaaaaaaggccaggcatggtggctcacgcctgtaatcccagcactttaggagtctgaggcgggcagatcacgaggtcaggagttcaggaccagcctggccaagatggtgaaaccccatctctactaaaaatacaaaaattagccaggcgtggtggcatgctcctgtaatcccagctactcgggaggctgaggcaggagaattgcttgaacccgggaggcggaggttacagtgagccgagatcaagccattgcactccagcctgggcagcagagcgagactccgtctgaaaaaaaaaaaaaaaaaaagataaaatctagtacacctgtttagggcacttaccatgaatagagcttgcaggactggaagtttcactgggtgagtcagtgcgtgagtggtgagtgaatgtaaggctaggacagtaatgtgtatgtctgtaggcttcataaacactgtacactagattatattaaatttatttttaaaagtttttggttcttcaataataaattaaccttagcttactgtaacttactttataaactttttaattttttaaaactttctcactttgttgtaataacacttagcttaaaacacacatatacacctgtacaaaaatattttctttatatccttattctgtaagcttttttctgttgaaaaaatatttcttttgctttttaaacttttttgttaaaaacgaagacacaaacgcagacattagcctaggcctacgcagggtcaggagatcagtatcactgtctcccacctccacaccgtgtcccactggaaggtcctctggggctgtcacacgcatggagctgtcatctagggtgacagtgccttctggatacccctgaaggacctgcgtgaggcccttgagaaggtgtggttcttttcagaaaaatgtccatggtggttcgcttggcttcttttttcgtcatggatttgtgtgagtaatggcgttgtgctgagacattcccatggctgtgctgtcaccaggcaataggactatttcagtgtgtttatcttctgggaccacacttgtatatgtgggccactgctgactgaacatcattatacagctcatgactgtgtgtatgtctctctcttttttttttgagatgggtcttgctctgtcgcccatgctggagtgcagtggcgggatctcggctcactgcaagctccgcctcccgggttcataccattctcctgcttcagcctctctagtacctgggactacaggtgcccgccactgcgtccagctaattttttatatttttagtagagatggggtttcactatgttagccaggatggtcttgatctcctgacctcatgatccgcccacctcggcctcccaaagtgctgggattacaggcgtgagccaccacgtccagcctgtgtgtgtgtgtctctctcattagttctgtctctctggagaaccctgactctcatgatggatctgtccctcacggggtccttttccggaagacaccacctatgttctttcctgtctatgcttggaacttgggtgcaaacctaggccggatctgggggactccctctgtgctccctggcccttcctgggatctcctgatttttgttctgtggctttgggttccttacatcagagtccagcacagtcagttagaaatgcgtgttgccttgcaagcggatactagtgcctgtacacctacagcatggatctgtgaaagtaacaggaatagtcacaaccactatttcatccagcgctcgccagggcccagggtgtgaccttcatgcagtaatataactcatttcatcttcacggctaccctgcgcagtggagactctctttgtccctggtttataggtgaggaaaccaaggcccagagggtagctcactccactgaggttgcacagccaggaggtggcagctttgtcccagagtcaggccataagcagggcaggcgcagcgggtccgagtttctcggcacagcactcacccttagctcaggcagtgcaccttggtggtctctctgacttactatacagagaatgctgggtatgacttgccaaactcattcaccagaaactaacccactagggtaaaaacccttatgtcaggcttcaggctgtcactagcagcgggatttcctgccctggaaacctgacttcccccagctgcctgcatgcctcaggcaggcacggctcccttctgggctgctgctcattgtctgcatgttggagatattcagaatgccctgttacaccttgtactgtgggtccactccatgtgggatcttgatgctgctctataatccctcacccttagttttaaaacccaagcagttctgaagaacagttgttctggtaagtttgggcagctcgttcagtggcaaaacctgacctgaactactaagaagctgctgatggtcttgattactctccagtggcatgtctggaggttttgctgcagaaatggccgtgtatgtgcttgtgattactaggtactgccctggacctgctgggggtgtcctatgatagagcatgtacacaaaatcatgtgggtttttttgtattgttttgttttggtttttttttgagacagaatctcactgtgttacccaggctggagtgtgatggcacaatcatgactcactgcagccttacctgggctcaagcaatcctcccacctcagccccccaaagtagctgggactacaggcatgcaccaccacacctggctagtttttttgttgttgttgttatttttttctagagatagggactcactatgttgtccaggctggtcttgaactcctgagctcaagtgatcctcccacctcagcctcccacagtggtgggattataggtgtgagccaccacacccggccatctaccaaatcaccttactaaaatccaaaaaattcccaatccccaaatacacgcagcccccagggcttcttcggggattgtgaacctgtgttaccatttcaccagctccagacatcattacccatgagtactcgctgacgaagataatgcttttagaaacaacttgtttacttagcactgtggattcacctgcagttgtaagaagtaatgcagaaatcccagttttccctaaaggtatatctggcataactacataaatatcacagtcagaatactgaccttgatacaatccaactgccactttaaaaaaaaagttcagtgtgaagttctgacccggtgggccttcaggagctgagtcccttctggtctggactgaatgaccttcctcaggagcaggagcccagcagggcatcttcactgtcccagctagaccttgcgtgtcgcagcagctacagtagcagcaggccttgggatgagcacttgcctgctgctgcctggcattaagttctcacgacaatcctccagggggtgctggcaccacccctactttctagaaactgagggaggcttgagatgtgaggccgcctgtcctggcaggcctggattcagacccaggaggcctagtcccagagcccaggctcataaccactgccccacgctgcctccctggagggcatgcagtgtgccccagggacgagaggcccaggcagggaggggaggtggtggaaggggagcccatcccagcgtgcatagcggaaatcaggagcctgggctttggcgcagtttcgcctgggagagaagggaatcctggcttcctgggtgggtgacttcacctccccgggccttggttttcttgtctgtcagatgaggattgtgaaaacactgccatgtagaggtgcatggaggataaatgagcaagtgaattgcttacacaatattaggcacatagtaagtgctctagaagtgagctgtgtattattattgttgccgctgccactgttggtattcccactccctttctcctccctgcgctgtcattgtttgccttcatctgccttcccagcccgcccacccctggagaacaggagactggcggggaggaaatgctcagtcactcattcatttctttggagaaaggggggaagggaaattcattgactgctgcacgcacagctatggctgagcctcagccctgccctcacagggccaccttccagcggggtggacagaccggttccgaaccagcagggctcacggctggaacaagggagcccaggggcctttgggagcccagagggggtgcctgacccagcctctggggcttcctagaggagggatcagtggggctgagacctggaggaggagctggaggtgcaaatgaggtgctctgggcagaggcagcctgcataaaggcctggagccagcatgccggggacatgagtggtctggctgggaggtatagaggggtgggaggagccgcatgggccaggccacatgctggtttggatgccagccgggtgtgggcacataaccactcctcattgggaaggatgccaggggctgcctggcactgtcttcctcccctgccttacacccacccacagcccaggtggagctgcctggcagggtgccctgggcctgcccagacagggaggaggccgtggcctgctgggcctgggctcttctcaccccgcttggcgcacacacctgtttccagcatggatgagcctcaccccctgcttctgtcacaccaacctgcaggggtcagtgggtgtctctgtggaggtttctgagtcacgctgccaggctttccaccagaggccacccctgctccttgagggccggccctgggacctcccagtctgtcctctggcacaggagatacgggggtctgctcctggggaggctaaggatggtgggcaggtcagacggggggtctacgtgactaaacaggtgaagtcacttgcccaaagtcacatggcaagtaagtagcagagccaggatctgaatccagcccccaaatccagtctgcttttcaggttagaagatcagagtttgcaggaatcggggtaaataaggttgcggggatagggctcctttcactgggaacttgctatgtcccaaagctgaacgccccatgcctattgtgtatgatctggtcatcagcgcagcagccccagaagggggaccgtgaagagcagtgggcgcccacgtggagtttcctttcacctggcaccactgtgcagggttcacaagcattcacccatgcagctctcccagtggccctcttgagggagatatatatggttctcagtcccacctcagagagaaactgagccacagagaggcagactcacctgcctgaggtcacccagctcatgacttgcagagctgggatttgaacccggtctcagggatctgtgaccctcagttcctctcttcagtggacaaaacagggaaatcttttgtcctgggcctccccagagtgtgagggagggaagtaacagcactcggtgctgctgcccgcctgcccctgctgcatgccgggccccctgtgttacttattccttcccacagccctggcaggggagccctgtgtcacctccctgttagagattaggtaacctgggcttggggagtccatgtcgtccagcaagtcattggccctttgtgtgagtctgggctgttctgtgaccgtagacccagccgggcccttcctctcatgctccgccaccttggtagtcacgatagtagcatcaggacctgtgcttgggatgctgctcaccccacagggattctcacagggcacctgaagctgagcccgcagtcctcagacaggcagttgtttgattttagcgcgctcatagctaagattgatgaagtgcacccatgcgggcagctttgctgtgcccagttttggggtgcagaaaccaaggctcggcagttaaatacgtctagggttgcaccatcagcacctggcgcccaggcggtctgacttccactttcatggaacccagggctgggcagcctgggggcaaccgctgtgcccccacctcagcctcagtgtgcacgccccttccctcccacccaggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgagtgagtcaggcctggatgctccacgctccagcccagaacattccacacgggccttctccattccctgggggtggggttgggctcaggggtggccccttgttctgtccccaggctggtgtctgtcgctcctctgcctgtgttccagggcgctccatccacagcccaaagctgggcctcacgcttcccagtgagcgagattggagagccatggtccccctgccatttcacgggcccttcctccgggtagtagcacagtccccacaggctgtgtctgattcacctctaggtgctgagaagatccaagggattgttgtggatcatcccacagatgattattgagcatctcctatgtgcccggcactgtcctaggcactaggggtacagctatgaacaaaacccttcctgtccacatggagccgatattctaggagggagataagatgatgaataagtcatgaaatgaatagtgctaagtgccataaaactgaatagagtaaaggggggtgggtgaaggaagacagggaggtcaggaagaggcctctgggccagacctgacccaggaggggactcttcactcactctgtcccgctctcgacctgtgtgtccacacccaagttttccccatccctgggagcgagacccccttctccctcatagtggctgtggtcactgactctcgtgtcccgttgttcacaccctagccattgaggatgagtacagcggacccaagcttgaagacggcaaagtgacaatcagtttcatgaaggagctcatgcagtggtacaaggaccagaagaaactgcaccggaaatgtgcctaccaggtaatgcatctgtcaggtactgggcacccgggaaccctgggatggcatcacagcactgccagccgcgggcactgagcaaaacgacaggagaagggcggccatgacagccaacaccaaacaggagtcgtgtgccggacactgtgccgagggcttaccacatgatctcatctcgtcccacagcagtttggggaggtggcaggcagtgccatttgacagatgcagggacaaagggccagagaggtcaggtgactggcccagggtgaaaggtgaggaagcagtagagtctgttgctttgagttctcatcccaggctcttgggcgtctgtggctgctggttgttgcaggttgtttgggacctgctggttgctcctagtcctgagaccaccccctccccgacctaggagggcagctggccacagggtgttaactggttgagtgagactcaggctctggtatcccatctggacaaggccccctgccctgacctctcagggctacagggaccttaccatagttttggggaactgctgagatccaccacctcctgggttggttatgaggatgcgggacttcttgtgagtcaggttgacaggcaggtgactcttacaggagtgtgcaggcaatatgggaagccgccatttgataggtcctagagagccaagtggcctgggttcaaatctctaccttcccacatactagctgtgtgcctgtgggcagatggcttcacctctctgtgccttgatttcctcctctgtgcagtggagataatcatactgtctccaccaagggctgttgtaaggagtaactgcgtgtaatccacatcagtgcttcgaatagtgcctagcacatggttagtgctctgtatgggttagctgttgatcatgttgttaaaggtgagacaggaggaggaatgtccacattcctggttgtttttaattgaagtataattaatgcacaataaaatacacaaatctgaagtgtcctgttagatgagtttttagagttttatgtgcccactgcccaaacaagttacagaacatttccatcaaccagaaagctccctttgacccctttctagtcagccctcactcccatcccaggggcaaccactgatctgatttttcaccactgtaaattaattctgcctggttttgaatttcatttcaatgtcatatgggcttacagcgtttagtgtctcttctttcatgtggcacaatgtgtgtgggattcatacatggatgttgtgtatatcggtagctcaagtcctccattgtctgaacagcccatgacttgtttatgcagtcttcttttgagagacatttgggttatttctactttgtagcttttataagtataagctgctatgaacttcttggacaagtctttttgtgaacatgttttcattgttcatgttgaatttctctattgattgtcttttgtttcattgatttttcattcattattctctatgcatgcttgaggtttaatttgctttcttctggcttctgaagatggacattaatgctgttaattttacatcttttcttccacacaaagcatttaaaactaaatttccttccaggcagtaagttagctgcgtcccgtgaattttaatacgtcgtattttcattatcattgagttagaattgttttctaattttctttatggtttctgattttatccatagattattgagaagggtattgtttaactcccaaatatttggggacttctagatgttactgttactgatttctaatttggtcagacaacacactctggatgattccattggggctatttttagatctgtcttggcaaacatgcagtatgtactggaaaatagtgtgtattttgcagtcgttagtcatagggctctataaatgtcaattagttcaagatggttgagactgctgttaaaaatcttttatagcctattttttctaattgctcaatcatttattgagggggctgttaaaagctccgactatacttgtagatttgcctatttctccctataattctcagttttttgcttcctgtattttgaaatttttattaggcacacatttaggattgttatgctttcttgatgaattgactcattataatgaagtgacttcagtactttttggcttgaaatccctgttttctattaaaatagttaaaccagatttttacagttaatatttgcatgctataacttttctacccttttgtatttaacccattggtatctttatatttaaaatgtttttcttataaacagcatatacttgggtcttgcctttttatccagttggacaatctttaccttttttttttttgaggtggaatttcgctcttgttgcccaggttggagtgcaatggtgtgatcttggctcactgcaacttctgcctcctggattcaagcaattctcctgcctcagcctccagagtagctaggattacaggcacacgccactatacccaactaatttttgtttcgttttgttttttgagacggagtctcattctgtcaccagggtagagtgcagtggcgcaatctcagctcactgcaacctctgtgtcccagattcaagtgattctcctgcctcagcctcccgagtagctgggactacaggtgtgcgccaccatgcccagctaacttctgtatttttagtagagatgggattgtaccatgttggccaggatggcctcgatctcttgacctcgtgatccacctgcctcagcctcccaaagtgctggaattacaggcatgagccaccatgcctggcctgatttttgtatttttaatagagacagtgtttcaccatgttggtcaagttggtctcaaactcctgacctcagataatccacccacctcggcctcctaaagtgctggaattacaggtgtcagccaccattcccagccaatctttaccttttaattggagtgtttagttcatttatgtttaactatcagcaatcatatgattgcatttcaatctactgtctagatgtctcttttctatatgtcccatttgtttttttcccccttgtttctccttctttgactttcttttgtgtgaatcaggaatcttttagcatttcatctgttttattgaattttttgttatacttttgaatgtgtgtggcgaggggtggagtgttacatggttgctctagagcagcccttctcagctgaggctctatagagagaattaagccctaactcccttaggcatccattatatccgcagtgaattaactcctctcctgtgaatctgtgtgctctccttgggagaactgagcagatatcactgaaaatattttttgtggggcttaatcatttcccggaaccctggatgaaaaaggctgctccaaagattacaatgtgtaactttaacttgtcctattctactttcaaataataatatgatacttaatggacaatataagaatcttatggcctggggcagtggctcatgcctgtaatcccagcagtttcggaggccgaggcaggtgaatcacttggggtcaggagttccagactagcctggtcaacatggcaaaaaccccatctctacaaccctgtctctactaaaaatacaaaaattagccaggcatggtggcacacacttctaatcccagctgctcgagaggctgaggcagaagaatcacttgaacccaggaggtggaggttgcagtgagccaaggtcgtgccactgcactccagcctgggcaacagagcgagactccatctcaaaagaaaaaaaaaaaaagaatcttacaatattgtgattgcttttattttctcccagcctttgtgctcttgtcatgcttatgcatctgctataaatacattgttgtcatttccttaaatagacactagtcttctaaagaaatacacgtatgaatacacagaaaatgtcttttatatttaccctttctcttactccttgtttcttcttccatatgtgagtttctatctggtatcatgccccttctgcctgagtacttttagcatttcttacagtgcacgtctgctgtagactaattctctcagctttggtctgcctgaaaatgtttttattttgtcttcatttttaggggtgtctttgctggatgtagagttctaggttgacattgtttctttcaaggctttaaatgtgtttttttcccattgccttttgacctccattgtttctgtgagaactcagcaatcattcatatctttgttctatatagtctgcttttttcttcactggttttaagatgttgtctttggtttttagtagtttgactatgatgggctttgatgtgctttttttgagtctgtgggttaatatctttcattagttttggaaagttcttagccattatttcttatatttcttcccatttctgctctcctctccgtctggaaagctaataacatgctctttgatactatttgatactattccttagatcttaatgacctgaatttttttaattcttttcacgatttttcctctatgtatttcagttcagataatttcagttgtccttatgttcactgattctttgtaactgctgtcaagcccaacaaatgaattatttatttcttacattgtattttttattggtagcattttcatttagttgtgttttttttaatagacttttcatctctgtgtctcatgtgttcatgcatgttgtccaccttttccaccaagtcctttcacacatttaccatggttatcttaacgtctctgtctgatagttccatcatctggttcatctctgagtctgctctgttaccagttcttcatgtgttttacaattttattgtatgccagctattttgtataaaagaacattagagactgaggtaaataaagtttttcctcagaaaatggcacacttaggctgggcaccatggctcaggcctgtaatcctagcactttgggaggccaaggtgggcagatcgcttgagcccagtagttcaagaccagcctgggcaacttgtagaaaccccacctctacaaaaaaaatacaaaaattagccaggcatggtggttggcacctgtagtcctagctacttgggaggctgagtggggaggatcacctgaacctgggaggttgaggctgcagtgaactgtgttcgagccactgcactccagcctgggtgacagagtgagaccctgtcttaaaacaaataaacaaataagaaaatggcacacatttctcctgttgagccacaagagggaggggctgtgtgaacctcatctgtagtttaggggcagcttttattggagtttctttaccaccggctttaaatgtgttcagagtagaattaggactttcccttcagcagagcttgggatcttagccctggcagaattccagggatgtctttatgttttaaagtcgccagcttttggaactgtgggaggcctctggtattcagccctgccgccagactgtggggccactggggtgctctccgctctccagtctcgcccccacttctgtacctcaggaggtttctctgcacctcactccctcgcgcccaaccttccatgaagcccgtgtgagggagttggcagggggcagaggcgggctgtgctggggctccctggagtcctcatctgtcacgccagtccccacacggtcatgaacttccactcatttcccctcacgcagggcatcccgccctgctgcctcgcaccagggtgaaagctgtgggctccttccccaaggaagggctcgtcctgtctgcattttgattaatttaggtccctttgcattgccagctctcagatggctttacctttgattttgttgcttgtttggcttgttttcatctttagggcgagacagtcttttgtaacttttctaccttctgactagaagtggatgccgcctgcattttcttaacacctttttccccagcttattttggaaatcgtcagacctacagagagctgaaagaacagtacagttaacatctgtccacccttcacacagattcaccacttgtgaacattttaatgcattaactttatgtgtctgtctacttatttatgcatttgtatgtgtatacttttttcttttttttcccctaacccatttgagagtaagttgcagccatcataacctggatctcccaaaaacaaagatgtcctcttgtgtgaccacagttgaattgtcctaccttagaaattcatcattgatgtgataatactgactaaggtagacagtccacaggccatccggaaaatctggaaacattgacaaatatgcatgtcattgtcaaggtcatatccaatctgtgaaaaataaatcatctgcatttctagacatctattagtattttaattctccccagctctccccaaaacatcctttttagctgcttttaaaaaattcagcgtccgttgaaagcaccagtgttgcctatgacctgcctttttacctctttttacctagaaagtctcacttcttttttgggagactcttttatgacagtgacattgcgctgtgtccaggccagttcttttataaaatgttctacgatctggattcatgcatgtatttccacttgatgctgagtattttaagataattcaagaatcaggttttcgtacaaaacaatcgcaatgcttcggcactgcacaggccacagaagcctgcggctgcctccggccccgcctgctcccgctcccccaggcctgccctgccctttttcttctctccctgcttctccctcgccctcagcccagcagcgtctcatgggcagtccaggctttcggggccaggttgggcagcagcccctgcagccggtcccactgagtctgccctgccttccagattctggtacaggtcaaagaggtcctctccaagctgagcacgctcgtggaaaccacactcaaagaggtgcgcgttgtggggcagtgcggggagggccagcgggggtgggctctctggctggggaggggccacagagctcaggaactcacggatccacctccctctctccctcacaccccacccctgtgcctttcctcctgaatatcccatttctctcctggcctcttggtcttcgtttgtgttccctgcttgtgtctcttgcatgattcttcttggtctactgtgaactcttacccttcccctcacctctgccccctccccacgtctctctctcggcccctccctctccggtggcctcttttctttcagacagagaagattacagtatgtggggacacccatggccagttctatgacctcctcaacatattcgagctcaacggtttaccctcggagaccaacccctatgtatccttctcagcagagccaccctctccccacctccacccccagccgcagcctcaggtctgcacagagtgggaggagcccttgccaggaaaagacgtgaccttggaaaggagaggcctggccatgctggggcaccaaggtgtgggtggagctgcaggctggccatgcaccccaggctccaggctcggacaggcctgggccagcacccacctgctgtgtgacctaagctggtagctcagtctctctgggtcttggcttgtcttcgtctgcctcaggatcacatttgaatggcacctggcactggccacacttgggttccatcctggctttgccacttcccagctgtgtgaccgaagcaggttacttcactgcttggtgtcacagtttccccatttgcaaagagggataataatatgtgcaaccttgttactcagcagttactgagaggacaggttaagaacagggcctggcccacacctgatgctatctaagtatttccccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctcagcggccaagctctggctggagccacggtgaggaaaggattagaaacccagatcccttgagccctgccaagtcctcactccctgggaggtgctgacaggaggcttgaggccaggcaggagcagcccatctggcccatcttctgccaccacccccaaccccaccgcaccgcacccttcccctccacgcttgccatgttttcctcagcaggacagatatttaatggtgactttgtggaccgaggctccttctctgtagaagtgatcctcacccttttcggcttcaagctcctgtacccagatcactttcacctccttcgaggtgagctgggaagtgacaaggtttgggttcattgtggggtcctgagtggggcactcactctgcaaggataatagttgcagctgtatttattttgtggactcggagatcatgcacagggcgaccttttaagattgagtatgtagtgcactgcacaaaagcatcacaccaaaggacgcgtttacatcatagatagtgtagaaatggatgtttactctgaccatttttcagcagatggcaaacaagggtgtgaggatgggccccttattctaatttgcacaagggcatgaaacaggctcctgggtggccctaaatctggcactaaagctgagtgactgagtgaacagaccagggctcgagggtgggagtaaggagactgttgacgaggcagttgtgccccctcagattcaggcttggtgtcagatttgggttctcttgattgaagtagagcccggagctgagtgtgctggttcacacctgtaatcccagcactttggaaggcccaggtaggaggatcacttcagcccaggagtttgagaccagcctgggcaacacagtgagactttgtctccagtaaacattttttaaaaaggccaggcgcagtggctcatgcctgtaatcccagcattttgggaggccaaggcaggtggatcatctgaggtcaagagttcgaaaccagcctgtccaatgtggtgaaaccccgtctctactaaaaatacaaaaattagccgggcatggtggtacacgcctgtaatcccagctgcctgggaggctgaggcaggagaatcgcttgaacccaggaggcacatgttgcaatgagccgagattgcgccactgcactccagcctagtcgatagagtgagactcagtctaaaaaaaaaaaaaaaagccaggcatggtggcaccgtgcacccgtagtcccagcttcttgggtggccaaagtggaaggattgcttgagcccaggagtgtaaggctgcagtgagccatgatcacaccgctgcactccagcgtgggcaacagagcaagaccctgtctctttgaaaaaaaaaaaaaagtaagaaacttgaagtagagcccagagtatttgctggaggaacagacacaggtgtgagacaaagagggaacgaaaggggccctctagggttttggccggagtatctggagggctatggctgccagtgacgaagacgggaacatgtagagcagggtgtggccaggagctgaggagctcccctttggatgtggctgagactcaggagacatgggatgtgggtggggttccaaggggtgttgaaaatgtaggtttcttggtgtccagatgagattagacaagaggagctcactgggatgtgagggccacacaggggaggccctgcccatggcggggccggggtgagttgggaggtgagtgataggctggggcgaagcctgcatgcccgtgtccctgggctcacagggttcacgcagcagtgtccagcacagggtcaaagctcaggaagcccgactgtgggcctcgttgcaggaggcaacaagtgctcaggccgagaagtcagacaagcagagtctgagcagatgcgagactgggcagccttctccttgcccccaagctctggaagggaagaaggaggccgggtgcttgtgtctgagacagaaggatggagctcagggtggggtgggctggggcacatgttctgtagatgggcctactttttggttttgagacggtcttgctttgctctgttgcccaggctggagtgcagtagcatgagcatagctcactgcagcctctgcttcgtgggctcaagtgatcctctggcctcagcctcccaagtagctggcactataggcacgcaccaccatgcccagctaatttttaaaattgttttatagagaggtctcagtatattgcccaggctggtctcaaattgctgggctcaagcagttctgccttggcttcccaaagtgctggaattataggcgtgagccatggtgcctagccatggacctactttttgtcaagattccccccttggtacctccagtctggaaggcaccgcagtggcaagtgcgaggcccatgggggcaagggacgcatgcacagttctgggccttgagggtgccaggctggaggacactgatgtacctggaggctgagctttctcttctgtccccgtgttggccaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctggtgaggacggcgcgagccctgagtgtgggttccccacccagccacacctgggcagatgtgctggtgaaggaagttggggcctgtgggtgggtggcaccttccctcacagcggcatcccccatctccccagatcatgcacggaggcctgttcagtgaagacggtgtcaccctggatgacatccggaaaattgagcggaatcgacaacccccagattcaggtgagcagcgcggggccaggtgtctccagcagaaaggggcagcctgggctgagctctcccctgcaacccagccctgcctcggaggatgggctttgtgcccttggcaagaaacagcgggtctgagcctcagtttcctcacctgcgacttgggccagtgcacctccttcatggggctgtgatggcaagcacggtcgtgaccatggtgcggggtgaaggcacggtgaccgccgagcacacctgtccttatttatttgtgagttcagctgtggaaccctggaaggaggggaggtcttggggctcctgtgctagtgacgggcacacttcagagagttcacccacaggtgcacacgcacgtgcacactgtgagtgctgcagaggacatggattgggtgggctggtgctgggtgctcaggaaggcctctccagggaggcgaggtttgagctgacactgcgggaagcagaggcatctgccgtgcacagagcctggcgagcatattccaggcttgaggaggggtcctaaggcagggagaagttggcgagtgggcagggctgtgctttgagggctgacattggacatggggttcactgggcccaaatcctatggcgctttacaggccccagtgaggaactttgttcctagggcagtgcggagccaccaaaggctttgagtgggagaggggcctgatctgaatagtgacattgaaagctctatctggcttcggggccacaggggattgaatggggtctggagggcagatcagcagagagggtgggggtggctcagaatcacagtcacctgtcctgaatgtccatgtccatgctggatgtcccctgcccaacacccacccaggctgggctgtggggtcagcacctggccgggccaggaggtggcctgtgagtgaccacccccggggaggtggacgagtccctaatgtttccctcgctccccaccagggcccatgtgtgacctgctctggtcagatccacagccacaggtgagtctagggtggggtgcagggccggcgggtgtgggctgtggcagcaggtggaggcagacagtcaccctgaacccctgtctctcccttctgcccaccctcagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactggtatgtctttgcctttccagcccagggcctctaccaagccacgggtttttgtcttggtttttgttttgcctttttatgatggaacatttcaaagacaggcaagagcagataaaagaacatgatgaacacccccgtatgtgtcacccacccatgcagcaccagtggggccagcctgtgagcgctgaccagctgccctgtgttacagcaagcccctggcacttcacctttctcccactgattgcccagcacttttcagaaggaaagggatctttttcttaaccacaatatcgtgtttacacttttgagtgctggctgggcatggtggctcacgcctataatcccagcactttgggaggccgaggtgggcggatcacctgaggtcaggagtttgagaccagcctggccaacatggtgaaaccccatctctactaaaaatacaaaaattagcagggcgtggtggcacacacccgtaatcccagctactcaggaggctgagtcaggagaattgttcgaacccgggaggtagaggttgcagtgagctgagattgcaccactgcactccagcctggggaagagtaagactccatctcaaaacacacgcacacgggcaagagtaagactccatctcaaaacacacacacacacacacacacacacacacacacacacacacacacacacacacacacacacacacacacacacacacacacacacacacacacacacagtgttgatcccttgcccccacccgaatcctgccaagttctctttctcctggtctctcctaagtgtcttttccagctgacttcttccagacaggacctaaacaaggaccacattttcagtctctttgcctgtgagttccctgtctctccccacccgcatcatttatttgttgaagaataggttgctgcctgctgtacgagtcacctgtgtcctggactaggctgactgcatccccgtggtgccgtgtgacatgttcctctgttccctgcatctctgggtgggcaaagctagaagcgtggtcagattcctagtggggtctggcgagcatccacctccatgagctatgccctgccccttcctgctcctgcttcctgcactcccaccctcttttccccatccccatcctcctgcccctcccattctttcccctggattcgtctttcccatctctgtctctctgtccatctgtgtctgttgtggctctgtccctccctctccctctgtcccttcttgcccagcccttccttctcttaacccaccagccccacccagccctgaccacactgtccactctgctcctgtccctgcagcgaccagatggggaacaaagcctcctacatccacctccagggctctgacctacggcctcagttccaccagttcacagcagtggtgagtcacccctcagggcccctgccccttccatcccggcctggggacaaggaggctgagaccctggtaaggggcgggggtaggttctgccggtgggtgctcaggggctctgttctgacttctgtccatcccacctgccctggtcccacagcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtcagcttgtctctggatggtggagccgaaggagctgcccgggttgggttacgcctgctcaggagatccggagggtggggaggccgcaaagtcccgctggccgggcccacccagctctgggctgaccgcccaagtggcctctgcctctgcccagcaccgtgggctcctggggagagttctgccccctgggtggggcgatgaggccagcactgagtggagcggagcggaagctgaggcatagcctcatcctttgctggctccagcaacaagcatgacagtgccgctccctgctccctgctcagggtaggcccagcagtggttcttgacatcacacgatgaggcgcgcatctcccgtcatccagggagaccagaggacccttgtctcactcccagttggctcttagtcacaggtaacgttggattccattcaggctgccctgccaggccttgaccctccagagagattgtgttttcaagtttgagctcctctggactcagctttctccagtggtatgtggcactgggggatggtctacagcaaatgactcctgcagggccgagtccgggagtgtttggccctttggagacctcccaggcagacatgaggcgtccgcggtcctgattgcgcgtaggcgctggggaggtgttctctaaggcccatcagccttacagtaagtgcaccgccttctggggtcaggtgcgccacggtccagaagccaagtacacatggcttcaggaaaacaggcacgaggcccaggttgccagtgccattcatttctcctgggaaagacaaaaacagccaccatgactgtcgggagggtgcttcagacctgatgggagtcagccaggcgggcagctgtgaggctctcagactcactgggtgtcggggttccctgccgctgcagttcaggaggtctcccaggacccggtatggtcattatcctcacagtgagggcctattatagcaagaatatggggatgagaatgagaggagggaagaggcaggcgcaagcgtcccactgccctctcccgtggagctgtgtggacagcgcttattttccccgcatggatgcgacagcgtgctggagtgtggccacctagggaagctcacccgggcctctgcatccaaggttttcttcaggggttggtcatggggactgctcaccccgcgtggctgaccgtagcctccagagagacccacggcccccaccctaaatcacatccttagcatagactgtccactgtggcccagggccccagataaagagacgctcctatgaggtaggacacaccgagggctctccggtgacctcccaggagccagccttttcttccgtcagggctgcagccatgctgcacagctgcataacaaacaccctaacccccccccaccccctcagcttcaacaacgaatgccttgctgtcttcctcagttctgtgattggctgggcttggccgtgcagggcgcacctgagggctgaggcatttgtggtcgggggcatttggggctggaggcatctgaagactcgcccggctggactccgtgggggctcactcccgtgacggcagttgctgtgggctgttagctgggctggcactggaacgcctgcgtgtggcttccatgtggcctgagcttctctcaccgtggcagctgggtccctcaagggagcattaaatgtttatatttaagtcaaccaactgcattccagctgtagctcttgcctcagcaatgtc

SEQ ID NO: 13242 - DNA, 151261 bp, Human
  misc_feature (1)...(151261): n = A,T,C or G
cggacacgcacgagacgcccgggccacggaggcgcggggctggcccagggtccccgccaggccgagctctagggctgccggcccggcccggtgacccccgcgctcccctccgtccgctaaggccccgcggcgccgcgcatgcgccccgccgccgcccccgcccccaccgcgcccgcgcccgcgcccaacgcccccaccgcggcccgcgggccatggaacctgccaaggccggcgcggttcgagcgctccggtgcgcgcgttcaggcgcctttcccccgtgagcccggcggcgctcggaccgggccgcccgccgccgggcagctccgcccgcctctagcgccggctgggcgcgcccccgccccggtgcccgcgcgtgcgcgcccccgccgccgcgtgtgagtgtgagtgtgagtgtgagtgggtgtgggtgcgagccgggccgccgacgatgccgcggggccgccccccgaagcccagggagagcaaggcgcgcggcgactccggtaaggcccgcggccgcgccctcgcgccccgccggcggccggtgcggggcccgcgccctgccagtccccggatgcggcgcggggggcgccgggagcggcggggcgggggcgggggccgcgcagacccgggccgccgccgccgccgactggccgggcgggccgcagcgcgggcggaatgatacgggcgagtcgccgcccggcccctccgcgcgctgggcctactttcctgggccgggcggcggctgaggcgggaggcgggaggcgggtgagggagcaggcggccgcctcctgcgcgcgccctgcccccgctggccctgccgcggcccgcgctgaacttgagggaaagtggccgccccgtgttccgtcccggggccggagggccgcggggcgcgctggggaggcggcctggccagagcccgggcctgcggataccgcgccccgggctcctcccggacggcgcccccgcccgaccctgcgcggcgccggctgccccggggacgttgggctcggcccacagggaggccgtggagcgcggggtcgtgcacacagtaggcgccagcgttgtccgggaagcgcagggtcgtgcacacagtgtgctccagtgttatctggggcgcgctgtggggcgtgcatacagtaggcgccattgtgatccgggaacttgaaccctgagcctctgcagacgctgtgggtagtgcatacagtaggcgccattgtgatccggggggctggaaccctgggcatctggagagcgctgtgggtcgtgcaaacagtaggcaccattgtgatccgggtagcttgaacctggagcttctggagagcgctgtgggtcgtgcatacagtaggcatcagtgttatgtggggagcgctagatcgtgcacacagtaggcgtcaggaagtgttttccccagtaatttattctccatggtactttgctaaagtcatgaaataactcagattttgttttccaaggaaggagaaaggcccagaatttaagagcaggcagacacacaaccgggcacccccagaccctggcccttccagcagtcaggaattgacttgccttccaaagccccagcccggagcttgaggaacggactttcctgcgcagggggatcggggcgcactcgccggtgccgcggttcccaggtcgagggcagtggggtagggggcgccgcgctttttctcgcgggcgccgtggttcccgtgcggccttggacgcgagtctccccctgcaggcctggtccctggtcctggtcacccgtgcaactggagcggcgctccgcgtttggaaagggttttgaagggggttctaagggggagtgggcgcctaggactccctatgggagtcggtgggttataccttgactgccgttgatttttatttaactgtttagcttagtgactcaagtgttccccttttcttggggatgagtaaactgaggctcattaaagagcttgtgaccaaacaacacaggtgccccagagaaaggtcgggcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccaggtatgcagatttgtagttggataacagcagtgctcagaattttgattaatggttgatggtgtctggcctttaaggaagtctttgttgcctctcccgcttttgagttttggccttgaccttatttcgttagtttaattgttttgttagtatgccatctgccaaaaataatgtaaggtgcagtgtctcagttacttggaagaaggcttaggatagagaaagaatgtaaaatttccacggccacaggcggggcacccattcccccagtatccccatctcaccgatggtatccctgtccacctggtgtttcaccctcaggcctcaagaattattctatttcttttatcccccaacacacttcctaatttagtgttgcagcttctacctcgggaatgtatttccagtgggccctcctctttccatctccagagataccctctgacccagcctccctctccgggctggagagctgcaggagcccccttcctgggccctgctagtcctgggctcctgtaaataaatctgtcacttgtcagcgtggatgaacttgttaaatgtaaatcagatggctacaccctgattaaaagcgtgcattggcttcctcatccctttaacagaaacccattcctccaggatcctgttgatcgggccttgtctgactcttctctctttccttgctctggcatgcagtcttttgtgttccttgatgccacattagtttttgtcttagggcatttgccatttcctagtctgagaagcactttttgctagtcttgtggctccaagtgatttagcgtcttcagagaggccttcctcaaacctgcttaaaagttacctttcccttctgaacaccagtcctcctgtagcaaagtggttctcaaactgtggttcctggacccctgggggttccctgagatgttttcaggcttctgtaaggtaaatatcatagactaagactgttaggctttttcactctgttaatttttgcactaattgtacaaaagcagttgttggcacaactgctgacatcttagcacgaatctaggtggtggtggcggtgcctaagagtgaggctgtattaccttcatgtatcacagtcaagaagaacaggttgcaccagagaaaatgcagaatagatatgacaatccaactgtcttctgttaatcgagacattacaaagatttgtaaaaatgaaaaccattcttaactatttttggggaagacatatttttcataaaaataattatgttaatgtgtagtagacattttaaataagtaaatattttaaaaattgcttagttttaatttctaataggacaaacatcaatagatataacttacataaactagaaggcttctagggcctctttttttttgttttgttttaaatagagatggggtttcacaatgttgcccaggctggtcttgaactcctgggctcaagtgattctcccacgtcagtctcccagagttttgggattacaggcatgagccactgcttccagctgagggctgcatttaagaatgtatcaaggggtcctgaaaccaaaatgagggacattgctctatcacttactgtgttaatcacatttctcgtaagtgaagtggttttattttctttgttgccctattatgaatttcattcctaagaaaactctgcaagggatgtagggatttttacagataggggaatgaagctcagagcggatacctgatttttttttctttttgagttggagtctctattgcccaggctggagtgcagtggcgcgatcttgtctcactgcaacctccgcctcccgggttcaagcaattttcctgcctcagcctcccgagtaactggtattacaggcgtgagcccccatggctagctattttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagactcagtctcaaaaaaaaaaaaaaagcatgcattttagtgttctgccttgataaatataaaacccttcatgtacactaattcctgtattcaacaactatttttttgtttttgtttttgttttttttgagacagagttttgctcgttgcccaggctgcagtgcaatggcacgatcttggctcaccacaacctccatctcctgggttcaagcgattctcctgcctcagcctcctgagtagctggcattacaggcatgcgccactatgcccagctaattttgtatttttagtagagatggggtttctccgtgttggtcaggctagtctcgaactcctgacctcgggtgatcctcccacctcgccctcccaaagtgctgggattataggcgtgagccacagtgcccggcctgttgttgagacggagttttgccctttttgcccaggctggagtgcagtggcttgatctcgggctcactgcaacctctgcctcctgggttcaagtgattctcctgcctcagcctcctgagtagatgggactacaggtgcatgccaccatgccccggctaatctttttgtatttttagtagagatggggtttcaccctgttagctaggatggtctcgaactcctgacctcgtgatccccccacgtggcctcccaaagtgctgagattacaggcatgagccaccgttcctggctgaacaactatttttagagcacttcctgtgataggtgagccctgtgctagggtctagaatacaaagctgaacaagagacatgatctctaggtatccttataaaggtagaaagtgttcatggtgacagattgggcacctgaagtctaggcttcctggagaaaatgttgttaaaattcaagcctaaagagatgagtaagaagaggcccactgaaagaatatttgttgaagtagtcaggacgtgagaagtgagtctcacaggcatcgatggggcagcattcattcagcacttgatgtgtccctggcactatcctggggatagaaggatgagtgagatatgctttttttctttatcataattattttagcaataatgtgaccttgagggaaaccacattttggaatcttgtatgatttccatctgttttctccaatggaatagtgcaaaatttttctttttagcttgcccctttagttggcctcctgctgtttctttttccttttggagggatatttgtaatacttagttcatttccagagagcggagacaggcagaccatgagcccaatggataaacaagtcttttcctgattaggttaccagttcaggaattttcagttttcttggatgaattcaagagcccaaggggaggcaccaccagtgtaagctaggggtagtagggctttacttttttttttttttttgagacaaggtctcgttctctcacccaggctggagtgcagtggcatgatcttggctcactgcaacctccgcctcccaggttcaagtgattctcccacctcagcctcctgggtaggtgggattacaggtgcatgccaccatgcctggctaattttttgtatttttactagggatggggttttgccatgttggccaggctgttcttgaacttctgacctcaggtgatccacctgccttggcctcccaaagtgctgggattacaggcgtgagcccctacgcctgccagactttatcctttgaagcggcaggaggcagccagagctgtaatcccctcaggcttctggtaacagtgcagtccttacttgcttcagggagacagcttctgcttaaaacagtaactttctaacaatatcaggtgtctatccaaggatgaaaccctccactctccataattgaactttttaggtaggccgaaatttggagtatgtgtttatttattttggagacggagtctcgctctgttgcccaggctggtatgcagtggcgtgatctgggctcactgcaacctccgccttctgggttcaaacaattctccagtctcagcctcctgagttgctgagaccacaggcacatgccaccatgcccagctaattttttgtattttagtagagacggggtttcaccatgttgcccaggctggtcttgaactcctgagccaggcaatctgccccgcttggcctcccagtgttaggattacatgtgtgagccaccgtggagtctttagtaatttgaaggaagtgtgattagataacctctaaagattttataatcctggcattaagtagtgacatcacatgggtttaaaaccttggtctttcatgcaaaacgagcttgggaaaagctatagtgtaaaccgtaattccttattagataaagtcaattccacactttcggaatgctttttatatttcaagcctttatgttgtctgtgtgtacagagatagtgcgtctctgctttcaagaaagtagcagtgtttttcaagctatgttttgtcatagaacttttcttcacatgaagtatcatggcaaggcctggagcgtggctctcacccttggcaactcacgcattatggaatctcctgggggaggttttttttttttttggacggagtctcgctctgtcgcccaggctggagtgcagtgctatgatctcggctcactgtaatctctgcctcccggactcaagccatcctctcacttcggcctcctgagtacctggcactacaccctcgtgctactacgcccggctaatttttgtattttttgtagagatggggtttcgccatgttactcaagctggtctcaacttcctggactcaagctatcccctgccttagcctcccaaagtgttgggattacaggcatgagccatggcacccagccggtttatgattgctaagagaagccagaaatgtgtatatttatttgaaacctctttgttgttaggtttaagtaactattttaatcacaaaaaacatctgcctagaaaagtgcacaggttttaggtgaggagcttcatgagttttcctgtcaagccagcatccagtgtgttcgtgcccctcgcagtcacaggccttccccgcactgtcctggcttctgatacgacatgttagctttacctgtttttgttttgctttttcttttttgagacggagtctcgccctgttgccaggctggagttcagtggtgcgatctccactcactgcaacctccgtctcccgggttcaagtgattatcctgcctcagccacctgagtagctgggattacaggcacgcgccaccacgcctggctaattttttgtgtgttagtagagatgggggttcaccatgttggccaggctggtcttgatctcctgaccttgtgatccacccacctcggcctcccaaagtgctgggattacaggtgtgagccacggtgcctggccagctttacctgtttttgaactaaattgaatttatagtatgaacccgtatttttttctggcttgattcattcaatatttatttttatgagatttttcctgttgctatgcagcagaactgtgtttattttgataagtatatagtattacattatatgaacctaccataaattactcttctcctcttgatatttgggttatttccagtttttggctcttttgaataagtgttgctacaaacttttatgtatttatgggccgtagtggatacagccagccagtcgcccagtgacagtcctggcttcctctcctaccagcaggggatgagcgtgcatttgttccgcaggctcggtagcacttattattgcctctccccggagattcaatctttcagcttccctgggccacattggaagaactgtcttgggccatacataaaatacgctaacactaatgatagctggtggagttaaaaaaaaaaatctcaaaaaaagtctcataatgttttaggcaagtttacgaatttgtgttgggccatattcaaagccgtcctgggctgcatgtggactgtggattggacaagatgggcctgtccctttattgtttagctgttttggtatgtatagtggtatctcattttgatttttattttgagttctatactaatacagtttttatgtttgtcagccatttgttctcttttgctaagctcctgttgaagacttggcctgtttttctactgggacatatattaaaattaatactttcttttctagagcagtttcatgcttacccaaaattgagcagataatatggagcagatagtatggagacaccttctgtctctcctcacagtttctcctattggtaacatcttgcattggtgtagtaaatttagccaatgttgatacattgttattaactaaagcccatcattcgcattaggatatattttctatgttgtgtatcccatgggtttggacaaatgcatatttgccgtatagtgtcatacagaatagtttcactgccctttcctccgcctgttcatccatcccttccctgaccaatggcaagcactgatatttttattgtccttatagttttgccttccccagaatgtcacatagctggaagcattcagtatgcaacctttcagattggctttgagtaagacatgcattcctccatgtcttttcaaggcttgataggtatttcattttgttgctgaataatattctactgtatggatgtatcacatttatccatttacattttgaaggacatcttggttgcttccagtttttagcaatatgagtaaagttgctataaatatttgtgtgcaggtttgtgttggatgtaagttctcaagtcattgggggtaaatctcggggactgtgactgctgggttgtatgggaaaactatgtttagttttttctaacaggctgcgaagctgttttccaaagtggttgtaccattttgtattctcaccaggaatgaatgagagtttctgttgtacatcctaaccagcatttgggattaattagttttttggattttagccattctgttaggcgtgtactggatatctcattttaatttgcaatttccatcgtatgtttaatttttaacatacgatgttgagcatcttctcataggctcatttgccatctgtgtatcttctttggtgaagggctgtatgccgttttattactgatttataggaggtctttatatactctggatgagttttttatagtctcctattcactcttttaaagataccttctaatcaattaaacaagttcttaataacaatttgtcagtcctttagtacttttcggatctatttaaataatatttgaaaataagtaatattttcctatgttttcatctagaggctttattgttttacatctttattttatttttttgagacagggtctcgctctgtcacccaggctcaagtgcagtagtgtgatcttggctcactgcaacatctgcttcctgggttcaagcgattcttgtacctcagcctcctgagtagctcagattacaggtgcgcaccaccgcacttggctaattttttgtattttcagtagggatggggtttcaccatgttggccaggctggcctccaactcctcgcctcaggtggtccgcccaccttgacctcccaaagtgctggaattacaggtgtgagctgctgtgcccagctatacgtctcacctttagattgacacttcatctgaatgtgatttgaagagggaaaggtcaggatttttttttttttttacacatatagatacccaattaatctgtagtatttgttggaaataccatttttgtcttttttttacatggttgcaaatcaggtgaagaattgttctgtacttactcttttccactgtttttttttttgttgttgttcctggctagtcagtttcacactgtcttaattatgctattctgagtcttggtatctggtatgggaaatataagtcctccatttagtttttaatttttgcgatcatcttgacaattgttggtacttttcaatttcatgtagatttttgaatcagcatataagttttcctaaaaaaacttgctgggatcttgatcaaattatattgactctatagataatgtgggtggaactaatgtctttacaatcttgagtctttgaatctaaacatgatctctcctatcatttctttcctcgttatcgtctctcggtaatgttttgggacttcaagatacaggacttatacaaatattgttaaatttactcctagatatttgatatttcctgaaactattgttgatggtattttaaaaatttcattttctatatgttgcttgttcatagaaatacaattggtttttaaaaattggtattgtatccaaagtcttttacatatttattatttgtaatagtttagctgtagattcttttggaattttctctgtaatcatatttgtaaatatcaacaggtttatttcttcatttccaatctttatcactttcgttactgttttttctagctcattgtactggctaggatctcttctataacggtgaataaatgcggtgaataagggacattcttgacttgttcccaactgcaggaggaaaattatattattaactagggtgcttgttgtgggtttcttttggggggtggaggtagatattataagattacataagttttatttctattttgctaagttttttatcatgaatgggtcttgaattttatcatgtttactttgtattttttgtggtgatcatgtgatttttcttttatattttgttaatagggtgaaaaacattgatttttctaatggtaagccaaacttgtatccctgggatacaggcaaacttgttgcgatattattcttttttgtatatctggatttgatttgtacatactttatgctttttatatctgtgtttatgagccacattggactacaattttatttttttatattgccattctcaagttttgatactagtattttgctggcttcataaaataggttgggaagtcttcctttattttcttttctctgtaagagtttataataaggttgacattatatggtttttaaatctgtggtagaattccctgttagaatcatctgggctttgagatttctgtggggaaattttatatttttaatttttaaaataattttaaaaatagacatgaggtcttgtcatgttgtccaggcttgtcttgaactcctaggttcaggcagtcctctcacctcggcctcccaaactgctgggattacaggcatgagccaccatgacttggccttttggggaaaattttaaattgcagattcagtttctttagtatatataagacaactgaagtttaaaattttactttgtgtcagttttggtaagttttgtttgtaagaaccatctaatattttaaaatttattaacagaacattattcataagtatctcattatctttttatgactgcaggctctgtagtaatggcccttctctcttccctgatggtggagattgtgctttttcttatttttttcttagtcatggcagggtttatgaattttaacaatcttctcaaagatccaagtttggactttcaattcaatttatagatgtttgttttatattccactagtttcttctctttatcattttcctgcttctactttccttagggttttttttttttttcatttcaagttttaatgaaagcttgtatataaaattactttattcctgcatctgctcaattgtttcttccttatatttgcccttttacttttctacttggcgagatttggctttccgttcaaggagcattttgcggtctttgtccagttttagcctagtgataaccaccttgctggggtgaatgcctgtgtgcacagttggggtgaatgcctgtatgcacagttgtgccattatccttttcccgttgcacccattcaatgtagaggacatatttcttcctgtaaacccagactactttgccagtttgctgacctttatagtgtcctcatacaacctgaacatcatcctttcggatgggcatggatcgaacattgtacttgtctcttagctctttggaaagaagggaagacaaaatcttcctgcgaatgtgggaaggtgcattgaaatgccttttgtggttgttactttggtcagaagtcacaaagggattgaacttcatttgggctgctcccgcttcactgatggtcacaaaagggaagagaactacatatacgccgcttccggttctgtacctacattttattttctgtttttttttttttttctcagcttcttgatatggatactgaactaattttcagcctttcttactttctaatatctacatttaaggttgtaggtattaaggctattggcaattctacagttttaactgcatccacaaaattttgatgtggtttattcttgtcttcactaagttcaagattattttctgatttctattgtgagttctcataagttattgcaaaagatgtggctaaattttgaaattaccttcattgttactgatttctagtttacttgggttgttgtcagagaacttaccttgagttatttaattatttgaaaacttcttgggtcttttcatgttatgtggttatatttggtaaatgttccatgtgcacttgaaaagaacatatatctatttttttctgtcagttactcagaaaagtattaaatattaaattctatgattgtgaatttgtctattcttctgtcaatctttatattttgagctacatttttaaccatacaaattgaaagatcttatattttcctggtatagtaactcttatcattatgaaatgagtcatactttatatctagtaatgacttttgccttaaagcctcctttgtttgatgttggtacacctgcaccatgactgctttggttagtgttctatagtatttatttctcaattcttttactttgtctttctatccttatatgtaagttatatctcttgcaagcagcctatagttaacttttctaagtatggcctgatgatctttgtctttaattgatatgctgattttaagtacatttaaggccgttttgagacatagttttctacttgattcatcattttatattcccctttctttcttgccttcttttggctcaataaagcatttttaaatgtcatttatacctctccatccattagcctgctatttatacattcttttttttttgagattaagtcttgctctgttgcctagactggagtgcattggcacaatcttggcccactgcaacctccacctcctgggttcaagcgattctcctgcctcagcctcccaagtagctgggattacaggcgcccaccaccacacccagctaatttttgtatttttagtagagacggggtttcaccatgttggccaggctggtctcgaacttctgacctcgtgatctgcccacctcggcctcccaaagtgctgaaattacaggtgtgagccaccacgcctggcctatacagtctttataatttttttttctttgaggcagtgtctcactctttcagttgcccaggctggagtgcagtggtgcgagcatagctcactgcagccccaaacccccgggcgcaagtgattctcctgcctcagtctcccaagtagctgggactacaggtgcccaccaccatgcctggctaaatttttatgttttattttttaaagacaggatcttgctatgttgcccttaaacgcctggcctcaaattatcctcctgccttagcatcccaagtagctgggactgcaggtgtgagctaccatgcctggcccttttctccttcttgatagtgccctttgattcacaaaggttttattttcatttatttatttattattattattattttttgagacagagttttgctctgtcgcccaggctagagtgcagtggtgcgatctcggctcactgcaagctctgcttcccgggttcatgccattctcctgcctcagcctcccgagtggctggagctacaggcgcccgccaccacgcctggctaattttttgtatttttagtagaggcggggtttcaccgtgttagccaggatagtctcgatctcctgacctcttgatccatctgccttggcctcccaaagtgcggggattacaggcgtgagccaccgcgcccggcctatttatttgtttttttgagacacagtcttgctctgatgcccaggctggagttcagtggtgcagtcttggctcactgcaacctttgacttccaggttcaagcaattctcgtgcctcagcctctggagtagctgggattgcaagcgtgtgccaccacccctggctaatttttgtatttttagtagagatggggttttgccatgttggccaggctggtcttgaactcctggcctcaagtgatccgcaccccctccccccccccccgccccgcaagcctcccaaagtgctggaattacaggcatgtgctgccatgcccagccttcacaaaagttttaaattttaatagagtggaatttgtgtttgtttcctcctggttatttgtagcttttcgtgtcaaatttaagacactgttgccaaatccgtagtcacgaagcttgtcccttatgtttttcttctaggagatttatagttttagttgttaaattgaagtctttgatctgatttaatttttgtatatggtatgaagtgaaggtctgaattcctttttttctttttctttttcttttttttttttttttttttgagacagagtttcactcttgttgcccaggctggagtgcagtggtggaatcttggctcactgcaacctctgcctgccaggttcaagcaattctcctgcctcagatttctgagtagctgggattaaaagcgtgtgccaccacgcctggctaattttttgttattttagtagagacagggtttcaccatgttggccaggctggtctcgaactcctaatgtcagtcaatccgcccgcctagcctcccaaagtgctgggattacaggcgtgacccaccgcgcctggctttgaattcagtttttaacctttgtatatccacttcggctagaactgtttattgcctcattgaatggtactggcattcttgttaaaaatcaatggatgataaatatatgtgtttacttctgaactctcactagtgtctctgtccttttgccaatatcatactgttttgatgtgtcaatgatactttatgtcaagacacattaaaatggatagatagccattagaattagttatttgtgtatcacttaacgtcacctcacaaattgttggtggtacatgtcatatttagaagacattgcacatttttaggaaatacatacctttgcattgttgggcagcaaactaggctcaaatactcatcatcacatttatcagcttgaaaatgcttggcagagaacattcagtggaggggttaaaacatatggagtgaagtacattgatcttgggcacagaagtcagaaagagacaactgtctttattgtgttaattttcataaagttactatttaggagaacaaccagtctttctatcccatgactaagacaaagggccttatcagctttagggagattatggttaagtaaacattagagctttttactgtagaaaataatgcatagtgcatgtaaacctttaatgcctttatctctcagagacttcactgtggtgggaggagtgctgtgacctgtggaaagtcgtggaaatttcagggattgcagtcgtgatggctgtgattccagatggagtcatagtttacagtgtagtgcaggagttggcaagtattctttatgtcaagggtcaggtggtaaatgttttaggctttgtaggttgtacggcctctgtcgtgactactcagatctgctatatgcctgagtttcagcaaacctttgtgtaccaaaaaaggctaggccacagttacttgacccccaatctagaggaaaagacaggaagagaaaagaaagttatgtattatagcactttacttttgagtaaactatattgatatataacacacagagaagaacagaaattgtggttggctcaatgaatttttctcaaagagaactcacttatgtagtcagcacctagattaagaaagaagacattaagtggcaccctaagaaatcttcactgtgctccatcccagtaaggaccctccttgttgcgactagccactttgctgatttctaacaacgtaggttagttttgcctatttgtttaactttttaaataaaatgaaaccatacagattgttttcttacgtctggcttcttttggtaaaaatgtgagatttgtccgtgtttttatgtagagcagaagtttgctcattctcactgtttgatagtattccatcataaaatctcctccaacatatttgccccttctgttgttggagggcatctgtgttgctttttgttgctgctgttgtaaattgtgctactgtgaatgtttaaacatggcgtttgggtgcacatacgtacacatttctgttggagatgtacctaggagtggaactgctggattataagttatgcatgtatttagctttagttgatgctgctaaatagctttcaagagtggctatagcaattttcatgccctctggcaatatatgagatttccagttactttcttttctcatcaatctgtggtattgtctgtctttttagttgtagccatctgatgggtgtgcatcttaaaaagtattttaaaagttatttcatatttattatataacttggatcttaacaaccctgtgagtaggtaggacagaaatcattatctttatctttgggtgaagaatcaggctgagagagtttatttggcttgctggagactcacagctcttggcaggaatgagactcaccctcaagtcgtctgactccaagtgctgtatttatcagtgtcttcccagtctctgctgtgtatctgtattttgatatacagatatccacctttcaagatgcatgttttattgaacatggggacagaatctcagaatgggctctccacagttctctgtggcgctctttagctctatttatctaaaagttaatatgtgtgttgttttgatgttcacacaaattgtatgtttgtagaggtgaaaacagaataatggcagcaaacaaaacaagaaattatgctatatatagaaaattagttttttgcactgtcaatggaagcactctactttgcaatatgctgctggatcattttcagaaaggccctgttactttcagatcctgagcctagaattcttagagttctggttaaaggtaaggctatagacacttgaggtgttattttgttataatttaatatgctgtggtttttttaaatttgggtaatgtgtgtgtagtgcatgaatatacatttacccaagtttacagtctttctttagaaatacaaatttacaggtagtaaagcaagtatttcaaagggggtcgatgtttctttaaaaaatgagggagaccggccgggtgcggtggctcacgcctgtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgcttttgagtgacaggtgagagctccttcttggaagaaagcaggtgcctgtggctggtgctgttacccagtccgagcatttggctttctgagggactctgcaaagaaaataatgcagacttatttcagctggctcctgggaacaaccacatggcccaggtatgtgtgtataaaataagaatagtcaaagggtacttaacaagctggaaaaagattaaatctaacgtaggcagttttgaggtggagagcatgagccggtgaggctgaaatgtgggaatcagataaactggttttgggagcttcagacaactgggaagaggttaaaaaaaaaagctattagggcctatctatttccaaatatttaatgtgtatttgttaggtacacattacatgccaggctttgtgaagcaaaaagggctccaggatccagacacttcagagtttcacctgataaagtccagctgtgttaaaacctgaacgctgacaaatgtggcaggagcagtagaaacagggaagaaagtagaagggagttttaaataaaagaagaggccgggcacagtggctcacgcctgtaatcccagcactttgggaggcagaggtgggcggatcacgaggtcaggagttcgagaccatcctgactaacacagtgaaaccccgtctctactaaaaatacaaaaattagcccggcatggtggcgtgcgcctgtagtcccagctactcaggaggctgaggcaggagaatcacttgaacctgggaagtggaggttgcagtgagccaagattgcaccactgcactccagcctgggctacagagggagactccgtctcaaaaaaaataaaaaaaaccaaaaaaaaaatgttaagaaaagaccgggcgcagtggctcacgcctgtaatcccatcacagggaaaaaggtagaagggagttttaaataaaagtaaagaagaggctgggtgcagtggttcacgcctgtaatatgagcacaaggaagaaggtagaagggagttttaaattaaagaagaggccgggtgcagtgtctcacgcctgtaatcccagcactttgggaggctgaggcggcgtcaggagttcgagaccagcctaaccaatgtggcgaaaccctgtctctatgaaaaatgcaaaaattagccaggcatggtggcacatgcctgtaatcccagctactctagagactgatgcaggagaattgcttgaacctgggaggtggaggttgcagtgagtggagatcacaccagtgaactctagcctgagtgacagagtgagactccatctcaaaaaaaaaaaaaaaggaaaagtagagaaagggtggtagagatgacctaaagcggtagcaatttggagtggcctgatgcctgtcaggtgttccaggcatacttctaacgacagcatctggtctcaggatgagagggtgggagcagtgtgggtgcctggccagggggctgttgtcttagaggaatagggggtgacggagtagggttctgagggtggtgcacactgacagcagagtgaggaagatcaaccatatgttagaacgatttttattcaaaatgtaaaaacaaaaacataaaaagcttgggggttaggtcagttattttagaaagtactcagaagctgaaactgttatatctctcattttaatatgaaatacatcattaagatttatggataactgagattttaaatgcacactgcttacgagtttgtcataagaggccaatttgagttaaatccatggaatgctataaatgcaataagttttgttggaactcggcatccagtagacattttgtataaatcaatgtagggtctctaggtggggaataaaagacctttgccattaagatttagctggttagcctgattgctgggcctgatcggggaagaagagccatttttaagatagcttatctggtgccaagtcatgacagaccaggcctgaatacagtcatggaatagcaggattatggagtgatgggtagggcattgaataaagagatggccgtggtcctaagttattggcaggcccttgtcctagtagctacaggaaacattgtcttatttattccgcacaactgtgagataggctttcttatttttggggtggtaaacagctattattctatttagaatatttatgtaaagccttaaactgattttgaaactagtctctacttaaggcaaacaaagctgctcattttctgatcattgtgcaatcagtttttgtttaattttgatagtttaaagttcttggtagcagaaagggtgaataattaaagcaaacagtggtcatatttttatgtgtgaggtggctgtgtgggtaaactgccttggaattctacatatgcaccccctgtgtatagtgaactcttacagtgacctaccctctgtcttcttagggggcagaaacaggtagctgaaaagtactgttctagatcttagatttgataacagttaaatgcaggcagctttgtgcatattttggtatgtgtgtttgtgcatgagtggcagagaatacctattctgacttgggaggcattaggaatgtctgctgctaaaaacctcaagtccttcttttagctgtctttaaaaaaaatgcagctggggctgggcacggtggctcatgcctgtaatcccagcactttgggaggcagagatgggtggatcacgaggtcaggagctcgagaccagcctgaccaacatggtgaaaccctgtctctactaaaaatacaaaaattagccaggcgtggtggcgcacacctgtaatcccatctacttgggaggctgaggcaggagaatcaattgaacccgggaggtgaaggttgcagtgagcagagatcgcaccattgcactacagcctgtgcaacagagtgagactccatcttaaaaaaaaaaaaaaattagctatcccccagaaggccatcccatgaagaggcggtcattcatttgatcacatgtttctttgatcactggtcccctaatggatttgatgacctctgtggctgcagagacccctgcacaatggaggtgtgtggagacgtgtgcatatgtgcaggtgtgggtatgctgttccagcagggtccacagtctcctgcagcctagctggggctcctttcagttaaaagcccttatctaaggatgcattaattaaggactgtctctttttaaaaaatagagacagtctcgctatattgcccagactggtctcaaactactggcctcaagcagttcttctgcctccaccttccaaagtgctggcattacagacatgagccaccatgcccagccaggatgcattaatttgatagacctcgttctgaacaacagatactctggggaccagaaatttgaatgaacttgaaggcatgatggaccaaaggtgttatttgaggcctgggacactgcccagaaagggctgactttgagcagaaggaaagcaagcgaagtgggggcagtggaggccaccacgtcctggcaggaaggtgtcagggtggaaggtgcttccacagagcgaagggaactggctccctgtacaaaggtgtgcccctaggtagagcaagagtctagaccgccattgggtttcaaaattatgctcagtgtggaaactaaaccatgttgttgtttttaaacaattttccagtcatactttaatttgaattactgttttaagtttgtgtctgaaccaaattaattctgtgttatatcactgtttggaagaagagacttaccgaaataattattattttttgagtttgttaacgtgcagagtcttgcttcttaagataactctttttctggaaaattcttaattcataagtaaagcaacaacatttttctttttttttttttgagacggagcctccctctgttgcccaggctgaagtgcagtggtgcaatctcggatcactgcaacctctgcctcctgggttcaagcgattctcctgcctcagcctcccttgtagctgggattacaggcgtgcgccatcaagcccggctaatttttgtatttttcgcagagggggtatcactatgttggccaggctggtctcaaactcctgacctctggtgatccacccaccctgggctcccagagtgttggaattacaggcatgagccactgtgcccggcctcgacatcatttttcaattttaaatgtatagtccgtatctcctagggttttatctatcaatttcagttaattccttctcatttttgggcaacatattaagtagtttcaacatagaggctgtgaaaattgttttatcatcctgagatagctttttaattttgcatttcagaaattaagttgagctcttttattaatgtactcagcctttaggttaaaacacttgtaactgtgttctgaaaacccaattttcaacagacattttatttgtctcttcctaacctcgaagctgtttcttaccatactacacagttttccaagggaattgtatatcaattgctagggtcccaacaatcattttattttatttatttttatttatttattttttttttaggcagagtctcactctttcacccaggctggagtgcagtggcgcgatctcagctcactgcaagctcggcctcccaggttcacgcctttctcctgtgtcagcctcccgagtagctggggctacaggcgcccaccaccacgcccggctgattttttctgtgtgtctttagtagagacagggtttcaccgtgttagccaggatggtcttgatctcctgacttcgtgttccacccgccttggcctcctgcctcccaaagtgctgggactacaggcgtgagcccctccgcccggccccagcaatcatttgatttgggcctgggaagtcataaaacatttgctgttagttttagtgtagaaattttggaagtatggtctttgaacaggatgtgaatatagttaagaataaatagaataaaaattatgcatatctttttcttagtagactcactttttatgtatgaagttgcagtcttttgaattgcattgtatttcttgaagccggaatttgccttttctcaaggttctgcggaataatgtttgcagctgttgctgacttcctccaccctgtctctgtgcccctcccatgtgggcttcacctacctcctgtcttttggaatctccaggtccttgctacaaggcagattcaactttcagccaggagacttttggcagaaatgggaactgcaggctgttttctcaaaacaaagatttcaaggtctatagaacatttcaagtgcctgtgtttatcacacaaactcttgagaacaaggggctttcttgagctacttggttcttcagcttaccctgtactctactcccaagtttctgaagtctaatatttttggatcaaatttgatacaaatagctgtgtgtaacatatttctggtcttcacatagcaaagtatattacgtatttatgtccaaattataacacttgaagtatatttatttttaaaaattgtagagatttagggcatctttattttacggcatttttgacaagttttgtgattattctgtgatatgttatttgtcatatatagtcttatttgaaaatacttttaagttaaaagcactttacctgggtgggtttatagaagctctttgtaaaaattgaggattgtctgaggcattgcagtcttgtcttcctgaacctcctaagccatgtctatatatgagagagcaaaggttttatttttaagagacagggtcttgctctgtggcccagactggggtgcagtggtgggatcatcggtcactacgccccgaaactcttggactcaagagatccttccacctcagcctcccgaataggtaggactacaaatacgtgccgccatgcctagctaattttttagtagagatggggtctcactgtgttgctcaggctggtcttgaactccagacctcaggcaattctcctgccttgtcttccccaagtgctgaaataaaaggcacgagccactgtgcgtggcagtttttcttttttacttaatcttgttttgcagcagttttgagacattgagtttgtgaattagcatttaaaggctttaatatttctactagagttttgtttactgagtggtttaagatactggagttttgtttactgagtgatttaagaaacaatgtggattattgatgaaatcttaaagtgatttggaggtgaaatgcgtcagtggtttgtagtgactttgaaacactatacagtaggttcacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaaggtatgtattttcaaaggtgatgtcaggaatgtgagcgttgaaactggaggtattgtaaaaatgaacaagtaaaatcaaaacttttaatttaggttcctaaatagtagaacattttatattctacaaataaatattttggcctttttaaaagttgtagttgtattcctagctattatttgataaggcgagagagtgagagcttgtcctggtgaatttgtatattgaagttacttatttgtggacaaataattgtttaaaaaatatgactttttaaaagtagtttcaatttcctgtatgactgaacacagaagtggtgtgttttgaagtatttttctccagtggggagttttatctttaagtgatcttgcatttaaaaatggtattctagatgttttaggttgtgtttcaggagggagcaaatattacatactatcttaaatagaaatttgcactcttttttgcagtacctcttgtgggatctgtcaagaattttagtgccttaatggaatgattttcctgatagatggaaagtgacagttaaaactataattaaaaaagtgattgtcaacttttctctaggtaggagcatgtaagctagtgagccatttgagactggaaaaacaccatggacctcctttagagaacaggatgtgaccatctcaggcttgactttcagcacaaatggtgctgctgtagctatgataatataatataaatataatataccagtatgcaccagtattattttctcaggttcgacaatctgaagatactgacttattcctcattaggatcttgttacttcagagataaataccagtgattatctttttacaagtgaatagcagaataccttccattatgggaaaatcttagacctagataagcaaactctgttaaaatctagtaaaattttttatgattattttacctgaagtgtttttgttttttttttgagatggagtttcactctgttgcccagcctggagagtggcaccatcttggctcactgcaacctccttctcccaggttcaagcgaatctcatgcctcagcttcccgagtagctgggattacaggcatgcaccaccatgcctggctcatttttatggttttagtagagatgggctttcgccatgttggccaggctggtctcgaactcctgacctcagggtgatccgcctgcctcagcctcccaaagtgctgggattacaggtgtgagccaccacccccggcctgcttgaagtgattttgtttataatgatggatttggtcagaaatagaagggaaaaatccaacttaatgagttgaaatttttcagagactacaatccaatgaatttatacgcagctttttctttctttttttttttttaaaaaaaagcttcatcataaactctattatttcaatgaatagaagagtttgacagaaaatgtttggaagaaaacattgagaatacattattagaatatgtttctttctctatgtgttcattttacagcggtacccatacacacttacaaacggcaaatgtaagcatgcatacttagacgttcaacacaaacccatgtcatgcaaacacatggagaaagaaaccttttttttttttttttttttgagacagagtctcgccctcttgcccaggctggaatgcagtagtgcaatcttggctcattgcaactttggcctcccaggttcaagtgattctcttgcctcggcctcccaaagtgctgggattacaggcgtgagccaccgtgcctgggcacagaaatatgttttaataacatgttttaaaggttatctttgaaaggtgtttcattgtcaaacacttatactcactgaaagaaaacagcttatatacagcatttcttattagaaatatttcttttgtgtatgtatgtgttttcatccttataatcctttcagtaattctgtcaggtgctttactgtgtttattttggatttattgacttaagagccagaggagacttcagaagtttctgtagattgtctgtacattatggtacttgttaatattttcatttattgaacaagcatctgtgaaaagattgtatttcagtggcttcttcacttttctctccaaatagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagaggtaatcatcatcattttgcatatactttgttaactgattgttaaaatacatctgatcatgagtcaggaggattttagatataaacttgttttgaaagccttttgtgtagatttcaaggagtgaattgtcattagatttgccttgacaccagttgactgataagacattttattttctggccctgtcaatgccttagggtagagacattttaatgtgtagtatatttgaaggatcaaagtatatccacattggctggcagaggctcctcctggcgcctcaccctcctctttgtaaacagaaactaacatttatacgattctgccatggccaaaagtaacttttctgctttgaagatggtagaatctccttgcttgctcctgggtcctctgactgtgagaatctgagggaagagaatcatttcatgatggcccaaagcagcttatacaccaaagtgaccactcctgggagctccacaggcccaatgtctgggacagctttgaggatgacaggccacagtgctgggttgggggctgaatctaaggtgccaatggctattgcttaaaaaatatgctcctccttcgtcaggtgcagtggctcatgcctgttatcccagtgtttgggaagctgagataggaaaattgcttgaggccaggagtttgaaaccagcctggacaacatagtgagaccccatctctaccaaaaaaaaaaaagaaaaagaaaaccttctctgaactccccctttgcattattactgtagaaaattaggaagatacaaaaagttaaaggagaaagtcatctctaattctgagataattactgataactatttggtatattttcttccggagacagaaaaacacagtattgaaattgcatattcagacgatccctgactgaagatggtttagacttaatgttttttgattttacagtggtgtgaaagcaaacacatttcttagaaaccttacttctcttgtgatgttaggcagaggcaatgaactgcaactccctgtcagccacacgcttttggcttgtgatatttccaattcaccatgggtttatcaggatgtaatcccattgtaaatcagggagcacctttataaaatttacattgtgaaagctgacttcacactttctgttttttgtttttttttttgagatggagtttcgcttttgttgcccaggctggagtgcaatggcgccatcttaactcacttcaacctctgcctcctgggttcaagagattctcgtgccatagcctcccgaatagctgggattacaggtgcctgccaccatgcctggctaatttttgtatttttagtagagatagggtttcaccatgttggccaagctggtcttgaactcctgacctcaagtgatccacctgccatggcctcccaaaatgctggcattacaggtgtgagccaccgcgcctggcctgacttcatattttctacgtgattttggatcctgtttttatcaatgtctttactattttaaagtaatttatttttatctcaacatcttataatacaagtaatgcatatttattttggaaaaaaattagttataaaggtaacattaaaaccacccatagtggactttaacaaagctgaacacatagaaacagcaaagtggtggttaccagaggctgggggatagggggattggggagctgttggtcaaaggccacagtatttcagttagacgggaggagtaagttcaagagatctgttgtacatcatggggactaagttaataagaatacattgtatgtttgaaaattgctggctcggcatggtggctcatgtctgtaatcccagcactttgggaggtcaaggcgggcagatcacttgaggtcaggagttcaagaccagcctggccaacatggtgaaaccctgtctctattaaaaatacaaaaattagccaggcatggtggcaggccctataatcccagctactccggaggctaaggcgggagaatcacttgaacccaggaggtggaggttgcaatgagctgagatcatgctattgcactccagcctgggcaacagagcaagactctgtctttaaaaaaaaaaaaagaaaagaaaagaaaaagaaaattgctgtgagagtagattttaagtgttctctccataagaaatatatatgtgagataacgcatgcaaaacaggttgatttagccattcctcagcatataccaaaacatcatgtggtacaccataaatatgtacagttttacttatcaatttaaaaatcaattagttaaaaaaattataagaaagaaaacatactatgtggagagaatgcatttgtggtatttcaaacttttttctatacatgcttttcttaatagtttatgtttaaaatagttttttaaatacaaaaataggattatgtcattatacagactacttttgtaacctacctttttccataatatattgtaaatacctgctccctcttttcactcatcatcaaagttatcactcattatcaaatattaatattttaaattattaaaatctgcagtatctcgggtgggtgtggcagctcatgcttgtaatccgagcactttgggagaccgaggcacttgagctcaggagtttgagactagcctgggcaacatagactgtcactacaaaaaaaaaaaagtctttggcatctggatttagcatagtaaaatttaatagttttcatcattgtttaacatttacattgtttatatttttaaatattgtaagtaatatatctttgcatatgaatcttcttatgcatctttaattatttccttaggatggattcctacagttagattaattgaattaacaaataagacttttttcccccaagttctttatagaatgccatatgacattctagaaagtacatgccaatttaacaccttctcttgcagagtttaggaatgcctgtgtcacttatcaatagtgctattcaaaaatggctatagttatatttatatttttatttatttttggagggagaagagtcatgttctgtcccccaggttgtagtacagtggcatgatctcagctcagtgcagcctctgcctcccaggttcaagtgattctcctgcctcagcctcccaagtagctgggattacaggcgccccaccatatccagctaatttttatatttttagtagagacggggtttcgccatgttggccaggctagtcttgaactcctgacctcgagtgatctgcccacctcagcctcccagagtgctgggattacaggtatgatccactgtgcctggccagttcaatttcttaaaagccgaaaatgtattaaataatggtgtattaatatattttggaataaatcctaggtgcacacggtaagaaatcaaacaatagagaaggctatagagagcaaaaagttacgtctcctttgggttcctaagttccagttttgctcctcagaaacaactttcattagcagtttcttctgtatccttccagggacattctatgcctatacacatctcctctgtacccttattagtcaacccataatattctgtgccttttcatcagttaactatgtgtcttaagtgtaattccacatctgttaatcagagagctgtcactttctttttaacaggtgcatggtattatattgtttaaatgtgtatcataattaggaagtcactgctgttaggcatataggttgtttccagccttttccagacaaagctatggtgatcaaatatttttgtcgatgtttgagttctcaagatgggcagtgtggtatcccagaggacatttggttatcactgttgtggggctgggcgtgggtggggtgcttctgttatcttgtgagtagaggatgctgccgaactccctgcagtgcccagcacagcctccattgctacgagtgacctggcccagaacatcagtagtgtgaggttgaggaaaccctgggttaatagaaatgtgagatatattcctgcaaatggagttgttaggtcaaaggatatgtgaattcaaaattttgatattgtcaaattgttttccaaagagattttgtcagtttatcctccagccaataaatggtgtgtaagattgctcatttcttcataccattttctttctctttaaaaaaattattacttaaaaaaaaatagaaatcaggtctcaccatgttgcccaggctgctcttgaactcctggtctcaagtagtggttggattataggcgtgagccactgtgcccagcccattttcttttctttttttttttttgagacagagttttgctctgttgcccaggctagaggcacaatctcaacccactgcaacctctgcctcccgagttcaagcgattctcctgcctcagcctcctgagtagctggaattgtaggcacctgccaccacgcctggctcatttttgtatttttagtagagttggggctttgccatgttggccaggctggtctcaaactcctcacctcaggtgatccacccgccttggcctcccaaagtgctgagattacaggcatgagccgctgcacctggccagccatcccattttcaatactctgttgtaaaagttgtctcctccaatctggtaatttaaagatagtatgtttttgttttaatttatatttctttaattatgagtgaagtttagcatctttccatgtttattagccatgaataatatttttattttaattaagtaatttttttttgcaaggtggatgtgtggggattattggtcttattcttgcaaacttgtgtaaagtatttacattcctggaaagttaggtttttctgccttgtgtgacaaaattatttcttggtttctggtttcattatttttctcttcctggcagaaatttttaaattgtcatggactcaaattttcagtctgttcatttatggattctggttcttatggcttgattagaaatgcttcccaattctaaaattattttctaaaatattccacacgtctggaacatcccacactgatctgcctggtacagatcctcatacatgcagagcagaactcgcatggaagggatgcatccacactgatgctgcagtgtagcccatccccgcagggcctccctgcctccccctagttcccacgtggaccacttctctcgcagggcttccccatgtccccccagttcctatgtgggctccttctctcgcagggcctccccgcctccccataattcctatgtggggtccttctctcgcagggccttcccccagttcctgtgtgtgctccttctctcccaggacccagcgcctggcagcaccagcattattactcactctctcatcctgaatgctctgaaggagccgtctgctcagccaggacccccatggtcttcctgtccaacagccctcagggttccacatttctcaagccagccccccgaccctacttcagatggcaggcacaattagatatggtcttcctcctctgccgtggttttgtgaagtcagcagggtcacctacttcactttgctgccatgtgggacctctcccttcccattcttatgattccaggccttcagttaaccaccctccttcaggttacattatctgacacaaaagacacagtgcaaagcagaggagagtagaaggctcggggtttagtttttgaatatttggatattaaccaactgttaaaagtcaaagtgacacaggcaggtacacttggaggagagcccatctcctgcacccttgcccgcccactcacctcggcctttcccgggctgccttcctgctcttctagtgtgtctctgctgtgtctctctttgtaatgagaagcaaatgtttgtatgttcttattttctttttctggcttatcataatgtgaaatttagaattttatatagttaattataggctggtatttttattgttctaaatatttagattcaggggagaactgatcatgtttataatgttgaatctttatgagaacacggaatgtgaaaacatcagcgatgtttggttactatggattcagtacactttttacgtttcttaagtattttaagattctaatgatattgtgtagggaggtcttttggccatatgttgtgttacgtgcctgtaggaaagcgatgcatttgtgtgtgttagttttccctgccatcctccctgattctctatgcagcctcatctacacataataatcgggtagtaagtttttggttctgtgttgttgcaactagcatatgcgcagtttttaaaaaaaaatcacccttatatcatttattcgttttcatagtatgtagcgatggcatattcacttaactttttattttgaaaaattccaatcctaagtgaagatttgaaataatagtacaatggatatttgtataaccttttcctggactcaccaattgataaatttgccagatctcacctccccccttctcccttttttgaacaattttcaagtaatctacagatttcacgttattttaccactaaatacttcaggatgtagcccctaaaaacaaagacacttttcttcatttcacaaaacagtgatcacagtttaacattgctgtaatatccattttcagaggtccctatctggaggggaaaagagtgacattttacaaggggagcagttagttttgaacagatgagatacttctcttttgaccctggaagaagtggaagagggctcaggtggaggcgagtgcaggtggaggaggaagggggaaagggctcagctggaggcgggtgcaggtggaggaggaagggggagagggctcagctggaggcaggtgcaggtggaggaggaagggggagagggctcagctggaggcgggtgcaggtggaggagaaagggggagagggctcaggtggaggcaggtgcaggtggaggaggaagggggagagggctcagctggaggcgggtgcaggtggaggaggaagggggagagggctcagctggaggcgggtgcaggtggaggaggaagggggagagggctcaggtggaggcgggtgcaggtggaggaggaagggggagagggctcagctggaggcaggtgcaggtggaggagaaagggggagagggctcaggtggaggcgggtgcaggtggaggaggaagggggagaggactcaggtggaggtggaagtggagcagctcctggtatgtcttgcacgtgttcccagctttcctcagactgtgctttcttagtgtctcatgaagttttttatagactttcaggcagaacccaagggtctgcgtattaaccagttagatctgtatgatctagtaagtatttctgtcttaataacttaatagttatttgaaagaccaacccgggtgtgttgggtactgcacagcgtctgtatccttgcatttcctatttacaatcattcgtacattgattttggagttttctcttccacgtggttcttcacttcatctttgatctttaaccacagcaaccgtggaaacttagcttcacaaagacatgatgttattgaaactgaagtacctcaatctagtttctgggtgttattggtcaagtgtggagcaccgctgtttcccttgaacatgtgacctattcctgggcctcctcataagcttgttatggtgcactgcagtgcctcagttcatgggctggggctgaggccttagagcccacatttctctgggaaatggaaacattactctgtcttcaccaaaaacatggggtggcctgaggcatctagagatctgcatggggtgcctattttgggaaatgagagcagagcctgagtggggcacatctgtgggtagccctgggagctgagagcccatctggttgtggagtctgggctgggcgggggtatggtctgctttccaccgctcagccgctgggaggagtggagatggtggtttgcctggaggtgggggcttctgaagcatgtgctgtggaataacaaaggagtcagggccatgggaatgttggcgggagagctgaaatgttgagccgtgtggtctaggcagagaggtgaaacttgaggggtgtgcgtgaaccctctgttaggatgacacaggtaaaggtggttgaagatgtctgtgcatgccacatgttctgggtggcccaacccgaggacgacatgaagggcaaagattacctctaaggctacacccatctacaggggtcaccagcacagtgagctttaccgttttccattctgaagttccttcagatgtgccttttaatacttcactgtgatttcctccatcactggaaagagaaacaactgttagctgtcattcgcagatgttctaaagtatttataccttattttgaaaaccttcccttcgtcctgttttctcttccacagatgggccaggttctttccagatcacttcccacagtggtgctcacattctttgctgtttgcttcagtccctgcctctgctgttgtgtggttttgttatgccgtggtctcctgggtaggaccacatcatctgaactttgtgcagcctactctcatccaaaccctcagttctgtttgtaaaactccagctcccttcgtctcttgctgttgtggttgtaagaacttacacattccttcgcttctgactcctttttaaatttttttgaaaagtcttttgagaaatatgtgttttctgaaatcgcttgactttacatttctattactactcacccctgcttctggtttctcccttcagcacacagcaggctgtctttgattaataactgctaacaggagaagaaagcggggaagagtcatggaagaggctttgctgaagtctggcgtgaagctggtgagggagctgtgaggatgcttcacagcttccttggcactgtgtgtctgtgctgccggaggaagggttctggaagttgggctgtcacattcagccacctgaacttagcaccctcatactgagctcaagatttacatgagcagaggggaaaaaggcctcattgtgcttgttctgtaataacgtgttggcaatatgttggctctcttttttccaactgttgtgttgatgcttaggtcagagtttgtgactgtgcctccctcacctggcaggctggcgtatgtggtacagagctggtagggcagccgtgccctcaggtttgtccaacatcttcatttgttatctctgagttctttgcttctgaaccatggtttacagtgagaacgggaggaggaaggtgcactgcttctctttaaaggcgttatctggaagatgcatttcagtcctgctcacattcagttgggtagaacgtagtcatcaggccagtgatctagtggttgggcggctgcgaaatagtgttgagttgattagctgtatgctcagccagtaagtctattattgcataagaaaggaagaatcagtattggagcacaattaaaagtcttttccctgtatgtcaaaataatacattccttgctgcctttgcattttgtgtttgatttttcagttaattgatttgaatatggcatattaatagtaactagagggataatttcttacctttaattgtatttaaaaataacctctaaggttccagccacagtggagcagcttccttctcctaggggtcccccgtatcactattgttagagataaccagccaacaggcacagaaggactctgaaaggcatcagaggtggcggacggttggagggacttgaggaataatgtggccgtcagctcccattatttcttttttcttttctttttgagacagagtttcgctcttgtcgcccaggctggagtgcagtggtgcgatccagctcactgcaagctccacctcctgggttcaagccattctcctgcctcagcctcccgagtagctgggacgacaggcgcccgtcaccacgcccggctagttttttgtatttttagtagagatgggatttcactgtgttagccaggatggtctcaatctcctgacctagtgatccgtctgcctcagcctcccaaaatgctgggattacaggcgtgagccaccctgcccggcctgggtttctttttttcttcccagacacctggacacggttttgaagaagcctgcagccttctgccaacaagcggagaagaaaaacactccaagaaaagctggtttcccttagccagtactgggaaaaggttggtccaacagaacagaaaatctttttatggtatttactcaattccaatgaaatgccaactgaaaagctgctcagcggagccgagtacagcattgaacttctatcccattctgcccccgtcccttgggagctggcagcacttcgatttccccggtgcttgggcccaagcagggagctaaccttgcatccaggagggggattctcctggcagagggaggagacacccagaattcccctcccagcgtgttggcagagtctatctttggaagcccggcttccatcctcccttagcagaagcagggagtgttctgattctccctccagagtgtgtcagtgggtccactagggagttgggcctccctccccatcagtgatgagacagaaccatgcaagacagacaagtctgcactgtgctttcctcccactgcggtcagtggggctctgcgaaatgggtctctgctgctgctggtccttacactgcatctgaacagggcagctgctgctcaaaggagagcccaagagctggtcccacagtttaacacccaaagtgtctaggacacagacacgagccagcacagtccctgctggaacaaggaaagagcggtatcaatatgaagagagcctggacattggaattacctgacaagtactttaaagcagctgtcaagaaaatgctttatgagttttgaaacaaatgaaaaaacagaagaaagaaatagaagaaataaccaaagggaaattatagaactgaaaaatcccatgattgaactaaagaactcagcagaagggcttactggtggaccagagaggacagaggagaatcagaggagaacctgaagatagagcagcaggaatgacttaggctgagcaacagagaagaaatagaaaaattaacagggcctcagggaactttgggacaataacagaaaattctacatttgcatcatggtcatcacaaaggataggagaaagagtgtggggctggaaatgtatttgaagaaataatggctgaaaacgacccagacttggtaaaagtcataactcacagattgaagaattccaaacaggataaacccaaagaaatacacaccaagacatatcataatgaaacgtttgaaaactaaacctaagaaaaaaatcttgtgagagactagagagaaatgatctgttgtttgcagaagaacactgattcaggtgacagcgaatttctcatctgcctccatggaagctaaaagaaaatagcacaaaaattttcaattgctgaaagaaaagaattgtcaattacaaattattcttcttcttttttttttttttaaattagagacggagtcttgctgtgttgcccaggctggtctcgaactcatgggctcaagcgatcctcccacctctgcctccaaagtcctgggattacacatgtgagcaaccatgcctggctacaaattctatatgtggtaaatgtccttcaggaacgaaggagaaataaagacattcttagatgaaggaaaacaaactcttgctagcagacttacccttaaagaatcactgaaagatctccaaacagaaaggaaatgacaccagaaggaggcttggaacttcagaaaagaaagaagaatggtgtggtggttaattttctgtgtgaacgtggagagtgtttttggatgagattaacatttaaaccattgagtaagcagattgccctccatgatgtgggtgagcctccttcagtcaaagacctgaatagaatgaaaagactgacttccccaagtgagagggattctcccgcagacggcctttggttgtcacttacattatcagctctcctaggtctccatctgccagcccacgctgcagatttggggcttgtcagcctccataatcatgagacaatttcttacaacaaatatctttttttttttttttttttttaagacagagtctcactttgttgccgaggctggagtgcagtggcactgtgtcggctcactgcaacctccgtctcctggattcaagcaattcttctgcctcagcctccagagtagctgggattacaggcatccaccaccacacccggctagtttttatatttttagtagagatggcgtttcaccttgttggccaggctggtcttgaactcctgacctcaggtgatctgcccgcctcggcctcccaaagttctgggattacaggcgtgagccaccgcacctggccaacaaatatttacacacacatacacacacacgcacatgtgtttgttctgtttctctggaaaaccctaacacaaaaagaataagtaagaatacaaaattggggtgaatataatacactgttcttctccttatgaattcttaaatcatagttgatggtcgaagcagaaattatcatctagtgtgctcagtgtacatggaggaaatactcaggacagtgatatttaaagagggaaaacggtacaagactctgaatggaaataaggttttccgtacttctctcaaggtggtaaaatgtcaatgccagtagattgtgataagttccgtatgtataatcctacctagcacaatctccaagaatgccatacaaagcaatgtactcgaaaatactactaataaatcaaaatgaattctaagaaattctaaaaagtaatccaggaagggaagaagagaagcagaggaaaagaaacagtgagcgatcaacaaataatgacagacttcagccttcagataccaataattactttaaatgtaagtacgtgaattaaaagacattgctggctgggcacggtggctcacgcctgtaatcccagcactttgggaggccgaggcgggcagatcacctgaggtcaggagttcaagaccagcctggccaacatggtgaagccccatctctactaaaaatacaaaaattagctgggtgtggtagcgggtgcctgtagtcccaggtacttgggaggctgaggcaggagaattgcttgaacctgggaggcagaggttgcagtgagctgagatcatgccattgcactccagcctgggccacaagagtgaaactccatcaaaaaacaaaaaacaaaacaaaacaaaaaaaacctctcatatgatctaacaatacattgtctccaagaaacttactccaaacataaaatggcccagcacagttcctggcaggtagagagttcaactagtgacagctgttggaattattgctttttaaactattcaccacttaggacattcagagagccttctgaagaaagccacttcgtttggtagaaagtgcaggtactttgaggtctgggggagctgctgttgctccttcagtgaggttgaagatgaagtgagatgaaagtcagtgaagcacccagcagtttgttgggtgtagacagtattgggggcaccagtgcagggtcccctgaaaccttggaaataggaataaaattgcttcctaagggttaaactctgaaatcatcaacattggattggagtagtaaaaagttacagttaaaatgggtgcatttgttatatgtaaagtatgcctcattaaaattggtttagaaaataacctgtaaacatgtcttcttaaatatacttaggaactaaattaactttttagtttaaggtgttccgtttttaagttttactttcagaacactgaaatctaatttttagttactgctctattgagatttatagtctaaaattcacactggtcactactctgtccaaataaatctcaaacccagaagagtaaaccagaaaaattactgtagtttttaaatcacttaggaatttttcttaaaagtcacataattattgaaggtcacattattttttgagtaaatcacttcccttaaggggtgttacagaatgtttggagaaacaacacatgcatgcccacacacactcaacacaaacaactttcccacggaagacattgttcacatttattgatcatctcagtggcacgtacaaatgaatagtgatggatcaggttctgtaagtgttgagggaagagcagcgttttgtggggtgggtttggggtttattttgtgtgttgagcagtagccgaggtcagcagaggcacactgcattaggaaaagaagcatggcttctgagaaggccaggacaggagacaggatgatgatgggggggatcctggaggggattcggagaaggggaaaatcccaaacactcggagtctggtgaacacacgctgccatccgagggccggggttggacaggagagcagccttgatgcagtcagtacctagcattgcacgctctggtcttttagagatgatcgtatcttcagcaaggtggagacagatgaaaatgccatgcatttctcttgatgatttcccatggccacttagcatcatgagaattaccccaggacagcctctgcctctaggtgagagatgtgatgttaactctgtatggagggtgcagtaagtggaaggcccgttgtcctagtggcctgtgactatacatggggtgttgttcttcttacagaagaacacttcctcaagtgttgccagggcgcgcagggggagggaggagcatcgtggctctttttggcttgcaggagagaaagcagaaagacagtgatgtagccgtctgtaagctggcaggtcttggctgtggcctgggaggtgctggatcctgctcgcaccatctgagcacgtcgtgcataaactggggttgtcactcagacagatccaacaaatgcctgagtaatatccgtgtagatatccctgaaacacatgaatcagatcatttggtaaaagagtaagtgaaaagagggtgggtgtgagccagggcagtatcagtacggagaggagcgggctgcgaggggttttgtgatgtgattttgagacaggaggcatagtggggaatcattggtaatgaaagcagtgcattttgttcagatgcattcaggactgcagaggtttttttttttttttaagagctgcatcaaattatgatttttttttgtggggagtttcctagaacaaattttcttttatcaacaagtcactaaaaatttagtagtttattatttccttaaattattatacaataatactactttaaagttatttaaatgatttttggatttctcaaaacatttcacttttctttgtctttttctgcagtgtagctagaggtagtatcaattaacagcctcattttaatgaggtttacaaacatttatttacaagactagtatatgcagatcagaaaaaagtctgataggaaaaaatcaatgtatttttatttggaaataacagtttatgctcattgacaggtcatgttttttcatgtttgtacagttcattttgaggatcatttaagtaaatactgtaattgtgtgatggaactccaaatgagtgaattaactgaaatttgtactaagtcagcaatggctactgatgaagtaattattgagttctcactctaggccacgcacagtcagcgtcttacaggtgtcattttgtctaacctcgtaacagccctgtgagggcaggggtgattgttatccctgtttcataggctcagggtgggcaacacacccaaactagcagcttagctagtgattggcagccttaaggtgaacctagacccagctgtagaacatctagaccagcatcatctaagtgaaagatgaggaatttaaaattttctagtagccacatttttaaaagaaaaaaaaaacccaaacaggtgaaataaatgttaatatatttattaaaatatgtccaaaatatgaactcaaatatgaaagattactgagctgtcattcttgtatttttgctcggagtctttgaactcctgtgtgtgtgtgtgctgcagttaccccacgccttgcttcagagggtccctggttcacacgctcagtcagccgggccacagcctgcactctgctctgcctctgaaccaagcaagacagtgatgtggtctatctactaaaaacttggaagctggcattttgtttcaaggtcgtctcttaaaccataatcttactttgaattctttcctgaccctttgtagtgctgaggtcatcctacttctctctaaagcgctcacagaataggcggacccagtgccattacccaacaccacttcgaagcagaactcattttgctcaaaaattgtgtcaatctctcacccttttcccaatgtttctgtctttttcttccaataaagaaatgatttttgtatattcaaatacatttttgagaggtgaaagtgatgcttgttccagaggaaagtattagatcaaaatcaagattagagagaccaagtagttttcatttaatttgtgtattaaccgttgatcataccagttctttgaaggagtggttttgaaaggtttgctctgctcaccgatgggttttctcttccagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattaggtatgagtcattacatgggcttggtcaaaaatccatctaatatgttaaaagctggcgcactttggtacgacccactggaaatatttgctgcaagaacccagcaaagtggaaccccacagataatttggtgtcagaacgtcttttataacatgcatggtgcatccctacacattaatgaatagtgtcaggctatgtgagtagaagtgtttacctagtattataatgttgaaagctgtagaacaggatactggcaatacatgtttatgggtaggtaacaaaatatgtcaactagactcacaagggtttaattagtactccttttaataaattagtttgtggtacccaaccgttaaaactcatatgtgcctgacactgttcttagcgtgtatataaacagaacctcatttcatcattacaaacaaccctgttaggccagagtacttttatgttcccattttgcagatgagaaaaccaagattagaggaaccaagtagttctatgagattttgtagcttataagtcaggagtttgaaatttaaaccataagagtctgattttagagctcataatcttaacaactgactatatttgaatgcatttatacatttattcgtagtcaaacttaacatgtttttaaaaattttatattttgcctaattcctgataatatatttttactgatgtttctgtttcttaataaagtgaaataaaatattcttcctggccctttgctcaagttagctaatggtgataatcagttttcacactaatttagctaatttctccaacaaactctaaaaggcaatattgggccaggcacagtagttcacacctgtaatcccagcactttgggaggccagggcaggcggatcacctgaggtcaggagtttgagaccagcctagccaacatggtgaaacccggtccctactaaaaatataaaaattagctgggtgtggtggcacatgcctgtagtcccaggtactcgggaggctgaggcaggagaattgcttgtactcagaaggtggaggttgcagtgagccgagatcgtgccactgcactccagcctgggcgacacagcgagactctgtctccaaaaaaaataaaataaaataaaggcagtatcaattatcattttaactactatattatcagtttagcttgccatccttctaagctgcaatgtttaggaaatatctgtacttcttaacaacaagaagttccgtgccagttgattaccacagtttataaaatgcctgaagactctaatgtttatttagcctcttagacattgcatttgagaaatgtggactggacatctctgtatgatcagctgtctcctgtctttttcattttgcctcttgttgactaatgtggtacgcacctaatgctttatgatttcagtgatttttttttcttttttccccaaccaatttgatggtaatttcagtgatttttaaacccccaaatataatacatggtctctatacactccagatttttattctcatgaggctttaatgcaggcatttttgatgtttccttggaggtttgaaagatgattgaagatgtttaggtgcttgtggcactcagacagtcctggcttctaggtctttccagactgaggagcaaaccagacagacgaagcctcgccctcacagaactgccctttagtgagaagataggtagtgaccaagtgagtgggttagtcggtaccacagtttcagatagtggtgagtgtcaagaaagaaggacagtgggatgggtgtgtgcagtgtggctgagggaggctggggaggcagctgttgtgcgtgggcctttctgagtggggcttttggaaggagactggggtgaggagcagggagccctgcagccttaggggacccacctttcaggctgaaggagtgtgttggtggaagcagtgagcctccctggtctgagaagcaggaaggtggctggggtgaggagagcctgcccggcggggctgcggatgtgcatttcccatgagtgagatgggagtccttggagggttttgcacaaagggaatggtgtgaccagactttcgggtggcactgggcctggtgtgtgggcaggtgtcaaaagcagggagacctttttggaggctatggaagcagtgcactggagagccgaacccgttctgaggccgcaatggtggctagagggtggagagacatgtccacatttgggggtgtttcagagtaagaccagcagcttttggagatggactagaaaaatccagtgtgactcctgagacttaaatttgtgcaagagggagctttcgtgtcttgacatggaaaggagcaggttgggaatcaatgaagagttctgttttggacaccacccatgaggcaatgccaagtgagagttggctgtccagggctggagccagaggaggaggcagagttgctggaggtaggagtttggacatcattggtatgcagatggtgcggagagcaagagactggaggaggtggtgtgggtcaggtgtcagtgtagaaattatacccgtagcatctttgtttctgaccatcacaggtaaagctttgtctagaagagacattttgctccccctgtcccaatttctgtttttgacctggaaaaaacaaattttttttcatcaaaaatagagaaaaatgagttttatgatttttaaaactaacacatatacacacagacacatacatatatgtgattgatttatcattaaaacaggttctgatgactagtcagccaaattttctggtaggattttcattttgaaattatggtacaagggagacatcttactgtgtattttgcccccctttattacactagggtatcaagtacaaggtcttataaccggaatatcgacagaagtggattcacgtattcgtgtccgcactgtggaaagacgtttcaaaagccaagccagttaacgcgacacattaggatacacacaggtatgaaaacactgacttctggatgactgaccgtgtggctggaagggaagaacaggtgcctttttgctagctcgacttggaatctgatcccagctttctcatagtttgctggataatcttgctgaaattagttactctttgtgtgattttatttcctcacttgaaaaatgtggctcttttatctgtatatagctgtcctaaattatacattaacaaatatacttagtgctcattgaaaagtgcttgatacatggtaggctgttaataattgggggttgatgttattactgttattggtatggtatttattccctcatttgttgttactgtgtgtcagatattatactgcactaattagagctaaattaacaaagaccggatgtggtggcttacatccataatcccagcactttgggaagctgaggtgaggggatctcttcaagccaggagttcaagactagcacgggcaacatagcgagatcctgtctttacaaaaaatacaaaacttagccaggcgtggtagcacccacctgtagccctgaagtgggaggattgcttgagcctgagagtttgaggctgcagtgagctatgatcgtgccactgcactccagcctgggtgacagagcaagaaggtcctgactcttaaaaataataaaattaaaaacaaataaaataaaaaacaaggaagcagtggattttcatattcttttataattttgccttcactacgctatgaaacattgaaataataaaactatttctccatgccttatcttgttccttagttttgcttgaatatttgaaagtgagtacagcattcatagctgaatactctttgccatcttgtaaagagcagcctggttataatattgtattagtaacacgcatgatctctagggaaggaaaaaggaaaattgtacgaatatttttagtatttgaggtttgcaattaaaatgatccatgctttgtccttttgttttcttctgtatttcttgatttggttttcttttatagtgataaagtaagaaatctcacagctattttgcttggctgctattgtttgtcaagcagttctattatgttacattgctttttttttatttttcagagttttagtgaatatttctatgtagagtattgtggagtcattcagatgatttcaatgtttatatgtcagcataaagttaatatttttagagcatcagtttttatttattttctagagtaagagagaaagaaaacaatgcctttgtaaatgtgctaatacattgtgtctgtagagtattcagctttaatgtgtagtctttgaagttttaatcaatgaaaaaatagtttaaaaagttataaactttacccaaagtagagataaagtaaaaagtaaagcaaatccttctcgtgttcacttctcagttgtcatttacctttaacagtttgatatctaccccattagatgttttttacgcgtacataaatataccgacatcatgagcatactctcactcctagagagacacatgcgtgtagaatcacatacttaggtgtcattttgggattctgtgatgctactcctcctgcattgaacttgaagcatgtgtcacttgctccaattggcttgtgagctgcctggagagagcagcaggtcccagccccaggagtcacgtaggccggtgtggtttaaacaggaggctggcgggcccgggtggaggtggcagggagtgcctgcttgctgttcaggcaattccgtgttctgggcttggtcttccaatagctgtgcctcacagtgtgtgtgatgatgtgaggggggtgaccagaatcctgctggaccatgcctggattgtgtatgccccagcagggctcctgtccaaaggaggctgagtacattgcagcatcgtcatctagaacaggaagggtatctcttcgcaggcagtgtcgtgactgggccacactctcgccgtgcctcctgcctgcctgccctcctctcctgtctgccctcctctcctgtccccacgtaggcagtgctgtgactgggccacgctgtcaccgtgcctcctgcccccctgtcgtcctctcctgtccccatgcgggcagagccgtgaccgggccacactctcactgtgcctcctgcccgcctgtcctcctctcctgtcgccacacaggcagtgctgtgactgggccacactcaccgtgcctcctgcctgcctgtcctcctctcctgtccccacgcaggcagtcccatgtccaggccacactctcactgtgcctcctgcccgcctgtcctcctctcctgtccccatgcaggcagagccgtgaccgggccacactctcactgtgcctcctgactgtctgtcctcctctttcacacccttgccccctccgagttaaagcagggatttttaccatttgtgtactgtccccaagcttgttatatctcattcacttatttaaccctaaagctgttcagagaagcagggatctgatgttattatgaactcagctgctttctgtttcttagggagtgaaaatttagtaagactagaaatttaagtagccttgcagttaggttctaacctaactcgattttgtctttttgctcattccttcattcatcagatccgtactgcatgctagtgtgcacagggccctgttctaggtgctgaagagccgcagcgcacaagcacttgccttcttggagcgtgcattctagggaggggaggtggacattaagtaaaatgtaaaaggtcaaatgctgagaagtctgcagaaaaatcaagcagagaagggggctaggggttcccagggaggacacaggagattttaatgttaaatggaatggaccggaaagtcctcagtgtaaagacgattttgagcaaaggcctgaagaatctgagagagcaagtcttggggatactggggcaagaaccgcccaggcggcggatttcagaggcccggaagtggaaacctgcctggtgtgtctgagggcggtggcagaagtgggtagagggagcaagagagcaggggcaggggagctgacaacagctggtgtgcgaagcactgcactggcgcctcctctactgagtattagaagaacttcgattttactctaggggggattggaagccattgagggttttcagcagacaagtgacttgctcagacttaaagagggtcattttgtctgttgttttgagagcagcctaggaaggggccagggtggaagcagtgagtcaagctgggggtggtttcaggagctttgagtgataggggagtgccttaccctggggtggtggttgtggacgggaagcagggctgctctgggtgtattttgaagttattattgagtgtgagacgtgagagaaaccaaagataaggatgactccaaggttttttgcctgatcccctggaaggatggcattgcctgatcccctggaaggatggcattgcctggggaagcccacaggtggagcagtttgcgagatggtcaagtgcagttttgacatgttaattttgagatttaaagtagacacttgtatatatgcatctagagttctggggagacattttggctggagggataggtttgggtaacttcagtgttgttcttttcaatccgtaagatgcccatacaatatggaattatattttgatcatttttctcccactctaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtaaacacgggttgggggcataagcggtatttcacaggggacagtaggtatcttttgggttaataaacggacctgagaaattcttttccatttaaaaaaatgcagattgattttgtgccgagcagaccctgttttaaaaaatacatacgtgggaatttttttggtttattacatgtggaagaaatataaactactatcttttttgtcttcttgctgacagcatggctttggggaataaatatttgaaaataatcctaatacctttgttagttatagtctgtcattctaaataatgtatttcatccctttagcaaacttgaaacacaggcaagtgtaagaaattaaaagataagaaataaaattgggaaaaaaaagtgtttttcttactgctaatactacagagctcatatggtacatgtccgttccctcttggacagaggcctgctttgttcatttccttccatgctgcttgtccagtctttcgactaaaatgatgatttcctgtggtaattttctgttgtctacagagcatactgatgtgtagatcctgcaagtatttctgtaaagcaggtcaacctttgctctaactaaccatcgtgacttattgatttatattctaattgtagaatacaaagaaatatttaaacaacacaaatacttttatcatggatcagtatatcctatggaatgattttgcagaatgaaaactatcatattcttgggagcaaatgtgtatctcttaattttttacttagaataataccttaactaacactgaagtgaacttagagttaatactcactatccaaatttaataaaaacaagtagaagctgtctttgatcttagataaacagaatgtctaaaatgaaaaagagaatctaaaatgagaaaaaaaccctgcacatctcacgtagttttatgaacagattcacagttccatgttcaatgagttaatctttttagtatctaagacccagagacattaggaaggcatgtcagtgttagtgaggtactgaggttacctttagatttcggaagaataaatttgggctgttgtaagtcattcttgtggtgttgcctctgggtgaagatgattgcataggaaggatcgtctatttgtgtagcacacagaaatgcctcactggaaccttagaggagccttgtgaggtacttgtcagtactcctgagtttagaaaactccccctatgctaaagggcccagagactcacctgttgccactgagaagtgctctcggacctgcactagaatgggttgttccagaaagagcctctaaagattggttcataaatattatccaattttgtaagaatctaaatttggttcttagagaggcaccagaaacagaatggaagtcttactcaagttcggaaggggccaatgggttttcaagctagccttcatagttctacagtaactaacactgggttttagtaatagagaaagaatattttaggtattttctctgttcacagctgttcttactcattttactggtttccatggtttctggatttatcatagctttaaaaattagttgttaggccaggtgtggtggctcacgtctgtaatcccagcactttgggaggctgaggtgggtggatcacctgaggtcaggagttcgagaccagcctggccaacatggcaaaaccccatctctactaaaatacaaaaattagctgggcacgatggcaggcgcctgtaatcccagctacttgggaggctgaggcaggagaatcacttgacctgggaggtagaggttgcagtgagccgagatcacgctgttgcactccagcctgggcaacagagcatctcaaaaaaaaaaaagaaaaaaagaaaattagttgttgatacagaatatcaaaattgatgaaaagttcatatatcattatgaccatctttcctaacctctgtggttttggccatctgaaagcatatttggtgtaatatgtatttatatataactgtctggcctttgctattgaacattgtattcaactgtttaaaaaactgagaatatcttatgcctgacagtttgtttttgttaaattacaataattgaaaaatgtgttttctcactcttgaataatttctattttatagaaaagactgaaatttcaattcatcttataccggcaatattgtttaaagagtagggtcattgattctagaactatctaatttaaaagaaaaaaggtaatgttgaagggttagattatttctgtcattttgaatggaatggtaaattatgatttgccataatttagatgtttaaatttaacaattaattgtaaaacatcatttttttcctttttattctttaaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggtaagtttagtaatttggaagaacttctttttaaactaaaatctgtcattttaaatatgacctttacaattgaatatttagtagcaaaaaggtgctatgaaaattttttatatggagaaaaggtgctactttttaaagaattaaagtcaatcttttaaaatttgagaataataattagatgactgattcagactgtcatctgaacctgtgaaaataagacaaactgtaatcattaatttgtgaaatgatgatttctacagtgttattgatgattattgaatattctttaaattataatttaagaattaattatcctttgtaggtaatatttctcttttcttatgtgacagtgataatttttcctaagtctttggacttttgaaactaaattatatttttcagtacatgtagttaaaaattgtatgactctaaatacatatgcctacacacagagagacacaggtgcgcacacacacacacacacacacagggacatacacccactcttattttttctgtaggcgtctttagctcagtctcatttagttactcgtactgcactaccctctcaacagattaataaatggtaaaatttaagcatcaactataggtatcttaacagtagtagacattaaatacgaaagtgtcggaagttttaatgtatgcttatgaatgcagttacttggttgtattatgtcaacagctgcctcctaccagtatggaaaataagtctaattaatacttagtttttaaacattaggtttacctttagtgtttgttttttcttttcttttttcataatatttgcagtgtgggatggttcctcaatatattcttgaccaggtagaatgttgtaaaatgaattataaagctggagaatagagtccaataattatgtcttcaaaattctattttggtctgaatttttttaaatacaatttttaacgttgtgtaaatcaaccgagtattagttttcatcatttcctttggcaatatgcaaatcaaaacatagatgtagtgaataatctagaaaaatagtccagatcattttaaacatttatattctcaataaaaagaaatgtaattatagggatttagaaacctggaatctcccttatactcttacttgggcaggtaagaacatagcagtttttacagacaatttgggcagaaagtacagagagctaccatatactcctcttctcttgtgctcagtttcccacatttctgacatggtgcatcggtcgggtacatttgttacaactggtgaacgaatgtggatatattattattagtaaccaaagtccatagtttttgtcagggttcactctcagagttgtccattcaacgggttttgacaaaggtagagtgtcctgtccacaccctcacagtgtcgtatgggtagtttccctgccatccgttttcttctggatgggacatttcggattcccgagccctgcaggggtgggactggctctctctcccatcacagccctttcctctgacttaggttttcttggctgtagcattacagcgcctttattcctccagtctccttgcaggaagaattttttcacaaatgtgttgaattattttgactgcagtggtttctttcctactttttaaatttgtgtaacttgatattttaaaaattccttcacttcaattttatgggctaacaggaaggtgagggttcacgtgctcaatctgccatcttgagtctctatgctcactggaaaaaactgtacaaaattgcattagaacaatgtattgagtatattaagagccaatatcgtgccaaacaccagaatcagtgaggcattatatttaaaatttatgtttaggatactcttagattttaacacccttaaggagggtattgcctgttttttttttttttaattttcctttttaaattgaagagcaaaattgtatttttaatgaaaatgtttctgtgtttcaggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacaggtgaagcacgcttccctgcggtgtgaggcttacgtgctcgtgctgggtcagaaaccagggatgataattgagaataaatctgcagggcttgtcaaagtcagggtatcctcatgaaaaatgtgcctgaaccgaaagaaattaatatgcctacttaattgcttatggacggcgcaacattcaaatgatttattcatctatacattaaaaaaaaaatcacaaacttttattttttttccataagtgaactttacttgaaaagaacaggcttttccgaagttgtatctatttatgttgacagaggtggaaaaagcgttttattctttcttgaggttctggtttatgatttggagacagtcatgggtgttgacaattctgagagcgttcatactgcctggccttctctcgtgggtgtgtgggcagcacctgcacgtgtgggagaggaggggggcaggagcgcagagcccccagctttctagtccaccgtgacttcacactaactcttcactcctcctgtctctctgttacttgtttaaccttcctcctgtaccttcatggggaagagctggccaggggtatgaggaatctcagggtgtcgttctacagccgatacctgaaagttaaacccagtgtaactcaaaagccttaaaatagggattcccaagactatttagagacaaccaaagttgtgtgaggtaagatttctgaaagtcaaataaattttaattccctttaatttagaaatgtaaatgcttatattattttgggtgggagcaagatgtcatatcatcagaaaggacgttacagcctcaaagggttggaagcctcacttataagtgatgacttggaattgtagattcttatttcttggagtggaattagaattctataggtaaagcttttgactgattttggtaggcagagttgggccatcgttaccttctaaccttttagttttgttctgtcttagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggtaattttcctaaactttaaagtttggacatttgggatagcatattgctggtttttaagaaatgtgcccttcttttttcctctgaaggtgataggatatgtttgttgaatgttttgtagctagctgtagttggttggtatttaaaattaaaaagaatgacagccataaaatgcctgaaacttatcacttttctttaacctggcttctttcctgtattcagtttctcctgactcctcgccagggcttgaaagcttcttgtctctgtctgttctcttgaaagcttgttgtctccgactgttctctctctgccctgcttaggcgcctcctctccactcagatccatggctttgcttcagttcttctcacccttggtgcttctggcatccagccatgtgattttagtagcctctgactagtcctttcctcttcatcatcaaaggacccctgcagcacagctccctcctccacacctcaccatttcccattacacaccaagatccatttcttggctcctgagtatcctgtcacctgtcccctgcatttccatccgccctccctctgtgcttctaggcacaaacttattagacatcatactgaaactggattcctgctgtttctaggcatccctgtgtttctgcacatcatgctttctgcaggctttctgcagcaaggatgccttccttctacctcttcctctggtctctgtcaaatcttggccgtcattcaagcatcttcagtgctccgtcattcaagcatcttcagtgctcctcctcgtggatggactctgaggggtgcttttccttgtcctacctcccacagcacttagagtgtttaggattcctgcgttctctcatgttaattgtgcacagatgcagtctaatatcccttctaggtaataagctctttctggccaggaatacagccttctcatttctgaacaccccacagtgctcaatatggctctttctacaggagcaggaatttactacatctttcttgaaaaagacagattcctgtgtttttggcaaaactgttctgtgaaaacctttcccagttgtcttggggaacaagtgcattcttgctacaaagcatggaataacattgccatttctgttaacacttctttcctagaatacattttctcatgtataacatgattctgaagttcttgtttctcaaaccacactagtcaggctcttcttccccttgatctggacttcttctccccaaggaaagacaggatgctggaatctaagcagtttctcccgcacagtttcctggtatctggcagggcaggaaaggaaaacaggagccatttccgtatatttcgattagctgtgtggtagtcttccaggttacaggtgtgttttgtattcctgagaatctgatgcagatttattacctctgtgcgagtgcccgcctgagccccacgggctactgtctctagtcattgtgctaaatcggatgctttcacatgggcagcaagccactgagtgaggagccacgtcagaccttctccttcctgagagtacacatagccatggtccttagaccgagaaggtgagcaccaccccgtgctgctccttccagaccttcacccgcatgtgctggtgaagcagctttctccctgcaccaagtactagccagggaattccacatggaattgcaagaaaccttcctgtacggtattctagtttggggtgctgtgtttacagagttggtaacaattaggtactttctggactacttgaatcaatcaaatacacatgtagagtactgagcaagtgcatgcagttctaataatttcccattacattcatgggatccctagtacaagttggagccagtgctttttttttttttttttttttttaagtgacctctctaatatggtgatgagaaaaccattggggatttttattttttttgagactgggtcttgctgtgttgtccaggctagagtacagtggtgcaattatagctcactgtagccttgaactcctgggctcaagcaatcctcctccctcgacctcctgagtagctgggactgcaggcatgtgccaccacatatggctagtgaaaaacacttctttttgtagagctgaggtcttgctatgttgcccaggctggtcttaaattcctggcctcaagtgatcctcttgccccagcctcccaaaatgctgggattacaggcatgagctaccacacttagcctggggacacgtttctatataaagatgttccttttaattaaaacttttcaattactagtgtacttttaacatagtgattatatctgaaaatacctctccaaggatggagtatcatttgatatcttagaaagaccatgaggaaaactattcttgtctcgtaagtcataacattaattgcttataactaaccttcattacgttcctaagttaagcatactccgccatgtaaaattattgcttttgatttattcacttttatcagagtgaatgttttcggcgggatttgcttggtttgaagaagttatattaaaaatttaacaaatgcttttatagttatcatgcaacttgtgacacataaatcattgtgaatttttagtaaagtttgaaatttatgaccaggtgcagtggctcgtgcctgtaatcccagcactttgggaggccgaggtgggtggatcatgaggtcaggagtttgagaccagcctggacaacatggtgaaaccccgtctctattaaaaatacaaaaaattagctgggtgtggtagcgggcacctgtaatcccagctactcaggaggctgaggcaggataatcgcttgaacccgggaagtggagtttgcagtgagccgagatcatgccattggactccagccccggcgacagtgtgagactccatctcaaaaaaaaaaaaaaagaaatttatcgtggtgaaatattgcctatctagaaatcatggtgaatggtgttttggaaagctgatgattgactcctttaaggatgaaaatggtatggtatagtgaaactattgtgtgtggaaacttttctaaaagtccttgcatactttaccttcttagatcagagtgtggtcttgttaacttagccacttcttgatgacctggggtcactgccgtgaacttcggtgtactctactgggctgtaattggctggcatcctactgtcctatttcagtccacgggctccaggatggtgtggctcttagactcatctgctttttgaaattattatctctgcaagtgtgctttttaaacattcactgtaacaaacctcccacgttcttcttttgttgtttgtggtctgccaagttcttacagctcagataaatttgatttttataattgcgtaaaagctaagtgcaggtagcctttctccttctccgtggggtctgcatccatgagtgcaaccgacctcatatcagaaaatcctcagtaagtgtactgcagtaagcccaaagcagtgttaaaaatactagtgtgaatggcacacaaaaattgcttttttcccccctaaattattaactggaattctcattgtgaagtagacccagggagatgcagtccttagggttcccgccctggaagagtacctttaaagaattctcataaaactttagcctcaggctgctgaagcacttgacaaaagtcctaaatcattcctggggcggcgtgcgaggagggcaggtttccttggtgaagatgctcagtgcatcctgggctgcatcggagatgcactgttctcagtgtcactgtgtaaccacataaggcagtactgtttgtgcatctgccaggacagagatttgttttcaaggttctgggaaccacatgggggcaatgcacttataaacaggagcaagaaatcccacagtccctccaaacctccctgaggttctcaactttgaaggacaaaacccgtttctgtgcacttggatctggatattcagctgctcctgtgagacagtaaccagcactcattctctgttctctgtaccttcactcattccactgcctgtgactgacagaagggaggcaaagtaactcctcggcagcatctgcctttctcagcagcagactggttgttttcttctgctggtcagagcaattcttcaacaactgcatgagcagaggcatgaacatctgtcgtaaaatggggatacctgtgtcttaggcttggctgtaatctgcttgataaaaggaatgagttcctgggggtctcttccttcatagtctttgagcacatgtctgagcagacaagaggaacagaaggacttcttcctccaggcaagtaatcatgcaatgaggaagaacatgggacctctgcttctgagcatatccttctgtaaggcacagctgagggctgatgagaatatctgtaaacagttcagagcctctgaacagccacgccattccccagtctgctcgctgctctggcaagtccagcaccatggttgaagcagtctgttatagatgcctgcctttcttcccctgcggtcagcatcagtgttcctaacagaagtttaaacttttccatcagtggagtctacagattcctcaattaatgcttgcttcctttttgatgggtgtttactgtcaataattggtattccggctgtcttgtaaacaaatagttgattattgttcttcagtaaggactgctaaccattctcagtggagaaagccctgataagtcttctattctattgagaatatcctcagtgaaaggattcattgtttcttgagagatctgacaaatctaaagaactgccaagcagttccgctgcacgcttttgcgctacagtgttgcagaccccctgtgatctaagaaagccattaatacccacggaatgtgttgagattcagcagtaaagaactttcctgtctgacaagttccgaaaaactcatgtcacacataagagctaactcctgacattaccaacggctgtgtcatatttgcagagcactagccattgaaccagcacctgagaagggggcaccatgagatcctggaagagcttctgtcaatttctatagcaagcctgctgctcctgcagcttctgtaaaccgtgtagcctaccagtgctgtggtgtcgaaatataaactgcgcaggagtcagcagtaccttggtgaagcttgagctagccggtccaacagtaacttctgttgttttttatagttgacaaacatggcttcatcgttactctcgttttcaaagatagggtcttcatcataagttcctttgtggcaactgacatgattgccgctgcaccggctttctgctgatctaagatgtttcaaaatctgaacataatcacagcaaaagccagtatcttagaggaggtcccgtcatcaggagctagtcaccgcagcgtcagtgccatccttgtttcagcagcttctagtgcctcttgagcattcttgatatccccattctgaattcacgtagtccagctaactatcagtgactgtctctctcctgtgaccagctgagaaaacctggccaggaaatcaacatcatcttcgtggtcaatgctgaaaaacccagcagactgtagtacttgttaaaaagattctactggctgggcgcggtggctcacaactgtaatccccgcactttgggaggccgaggtgggtggatctcctgaggtcaggagttcgagaccagcctggccaacatggtgaaacctgtctctactaaaaatacgaaaattagctgggcatgatgatgcgcacctgtagtcccacctactcgggaagctgaggaaggagaatggcttgaacccaggaggcagaggttgcagtgagccgagatcacactactgcactccagcctgggtgacagagtgagactccatgtctaaataaataaataaataaataaataaaaagattctactagctccatttcatcagcagggtccgttcctcgatttacagtttcagatatccagtcacgtgcttctgttaacccagtcctagcagcatatctataaacctatcattggttgagggccaggtttatgtaagaggctgtattagtctgttctcatgcttataataatgacataccagagactgggtaatttataaaggaaagaggtttaattgactcatagttccacatggctggggaggcctcacaatgatggcagaaggtgaataaggagcaaagtcacatcttacatggctacaggcaagagagacatgtacagggcaactgccctttataaaaccattaggccccgtgagacttattcagtgtcaagagaacagcacaggagaaacacacccgcatgattcagttacctcccaccaggtccctcccacgacatgtggggattattagcattcaaggtgagatttgggtggggacacagagccaaaccatatcagaggcttttgtgtgaagccccaagacccagcactgacctgttgcttctgatttgtataatgattatttggtaagatttgctgccgtggttccaccaggtttgaatgcactgttcccagtgttctagtaggtctgctactgagagagtgtttagaaaaaaaaaaaaaaaaagcataaaaaacaaatgccgggcacagtggctcacgcctgtaatccagcactttgggaggccgaggcaggtggatcacaagatcaggagatcgagaccatcctggctaaaatggtgtaaccccatctctgcaaaaaaattagccgggcatggtggcgggtgcctgtagtcccagctactcaggaggctgaggcaggagaatggcatgaacccgggaggcggagcttgcagtgagccgagatcatgccactgcactccagcctgggcgacagagcgagactccgtctcaaaaaccaaacaaacaaacacttaggctgtgcagtgagatattctgtaacagaagtcaagaaggtgagtcaagctgttgtatttcacgtgaaggtctcctgtggctgaggagtctgcatttgtgcgtgacgctgagatatcagtccctctctaattagatgttggacagtagttacttctgaatatttgatgttctggtccttgaaagcagaaagactttgtgtcaccctgactgtcgtctgggctagaacttctgtgtgtacctgtcaggcgtctgggggaatcttttgatgttcccagcaggccagggtcctttgttggaaccagcatttggattttgtcccaaaagagcaggctatccatcccaggtgctctacttggagttttctgattacagtaggtgctctccgatcccacagaagaacccacagatgtttctctggtcactgcattccccctgtctgtctcccctacccatgtctggccagtggtcttcctctttggtcgtccttgtcctcctgacggcccagctaatgctggagataaagctggctgggtggtctatggcaccttctcttgcatgggagctaattgaagactgaagagaacacgtctaggcttttttcctctcctgccaagaaactttctgcagcatgtaaggctttctgtaatttagccctgcctgcacttctgactcttgctagtcccaccaggcatcctgtaccccagccatattgaactggaggtttctgggactcaccttcacacctggcttttgctgctgcttttatctgataaatatacctcaggccgtgtccttcttggcaaatatctgccttcgaagctcaccggcagggccaccttatttctgcagaagtttctgagcctcctcctatggaagtaatcagcattgtctttgcattcctggtgtgcatccatgcacacatctgtcttggcacctctgatgctctgccatacatgcttggttacgccatacatgcttggttacactgccctacccgcttctcccctagaccacagtcctttccagggcagataccttttgatgcctggcatggtgcttggcacttgtcatgctgtgcttgaagtagcactgggaagacagacctccttgagaaaactgcacttaggcgctaggatcacgtggacctcactggccatctggtcctgggcaagtcagttaagatgtcaacttctcatctgtaaggtgggactaaggatagaataaatggaagataaacgaatgggaggatccatgtaaagtggatagcatggtggtagctgaccaataataagtgtttaatgaatatatatgtttttaaattatttttaaataggtgaaacatgcccatgccacacaattcaaaagacacagtggtgtccacagaacttctgtgaggggtcttctgccacccctccccagggaagcgcaccactactgtcttctgtgtcttttaaacaagcacaggcatctgtgtgattgttttctaggaggatgagtggcttcctgctagaggtataatataatgtgatgttattttttaggttacttttttccacttgatatcttatttttcaaaatgcttgaatagtgtttcattttatgaatgtatcataatctaaccaatctgcagccatttgctaacatgaatgatgctgcagtggccgtgtgtgtagctgcatcatttcacacatgtacgtttatctgtaaggacatttcagtttaaaataatttcagtcttagtggaaatgtttcaaaacaatacaaggaattcccatatacccttcatccatattcccccaaatgttaacattttactacatttgatttcgctgtttagctatttttttcctgaattttctgagagtgacttgtagatataatgcccttttaactgtaaatattttttagtgtgtatttcctaaaatcaaggacatccttgtacataatcatagtaaagtcatcaatatcaggaaattaaaattgacccagtactattgtccactgtaccgaccttattgaaattttatcattggtgtcagtaacatacttgataacaaatgaaaaggattttgtcaacagttacactttcctttggtaaaaaggaataagttttgataaacagttatactttcatgtagtcatgtagatttacccttctaggagcaattattggagcacctgtttcctcacagccttttcaagaaattatcaaaatttggggattttttttactcatccaatgggttagaaaatggtgtcttattgtacgtttaatttgcatttttcttacaaggagtaaggttgaaagcttttcaaaagagtacctatattttcctataagactaattcttgacttcttttgtccatatggtattaaagatgatagcattttgtgagctatatttgtgggatacagtttactcctagacaacacaaatttgaactgcaaaggtccacttatatgcaggttttatcctgcctctgccaccccaagagagcaagacccccgacttcctcagcctactcaacatgtagacaaagagaggaaaaccacttccacttaatgaataggagatatattttctcttctttatgcttttcttaataacattttttctctagctttattgtaagattatagtgtataatacatgtacaaaatatgtgttacctgttgatgttattggcaagtcttctggtcaacaggaggctattgacagttaagtttttggggtatcttataggcagatttttaactgcatcggggtcagtgcctctaacctccgagttgttcaagggtcagttgtacatttttttctaatttgtttgcctttttgagctgaaaaacttttttaactggggaaatatttatttatatgtatagctaagtttgtcaatgtttaatgactttaggcttgggtgatatttagacttcatcactgacattatggaaagataacctcttctcttatatctgacttttataatttaataggttttttttttcgagacagggtctctgttgcccaggctgcagtgtggtgccacgatcatagctcactgcagcctcgacctcccaggctcaagtgatcctactgcttcagcctcctcagtagttaggactatacgtgtgcaccaccacacctagttaattttgttatttttatttttgtagagacagagtcttgctctgttgcccagggtggtcttgaactcctggcctggagcaatcctcctgccttggcctcccaaagtgctggtattacagtcatgagccactatgcttgtccataatttaatgttttaaactaaatctttgatttaattttttttttttcaggtggccacccagatgtgcaaacatcatttgtcaaataagtcatgttttcccaattgaaatgtaatgccaccttgatcacactcccaaatcgatatatgtcttttctggactgttctactcctctaatctgtctttttattcaagtgttctgagtgtactttgataactagaaagccagtcttctcttgatactcctttttaaaagtgtatttttcactattttcacatatttatttttcagatgcactttagaatcttctgctaaagttccaaaaactttagttccaaaaaacaatcttattggtatttgtatacagatgataaattaaaccagggagaattgatgtctttgtaacttacagtctttgtcccaaagaatagggtatgcatttccattaatttatcttttttttttttttctttttgaaattttcttctgggttttttttttttttttttttttttgtaaataggaagcgtattgattttcttgtattaaaacttgggtatctttctgagttctaggtttgttagattatatggtaatatcatttgaaaataatgactgatgcttcatttctagtgtatactgtatatttctttatcttgactaatgtcattgactagtatctctagatcacaataaattaatggcagtgatagtggacttttctccctgactttaatatatttttctattaagttgaatgttatattgagatatgttttattcaccttttcctgtttttagaccttttttaagactagatgttgagttttagcaaatgtcttttcatgttgaagatgagtatatatcctttacttttctatatttactaatatatatatataaacttattgagacggaatttcgctcttgttgcccaggctggagtgcaatggtgcagtcttggctcaccataacctctgcctcccgggttcaagtgattctcctgcctcagcctcctgagtagctgggattacaggcatgtgccaccacgcccagcaaattttgtatttttagtagagacggggtttctccatgttggtcaggctggttttgaactgctgacttcaggtgatccgcccgcctcggcctcccaaagtgctgggattacaggcgtgagccaccgcacctggacttactatttgaagaggaaagctactgcccaactccaggaaagcttgccatgtgggattgcagatctagctttccggatctttccatttgtcagagttggaaatctggattccattttcttttttaacattgtgtgggtgaaacaaaacatatgcaggccagatttggagacagcttcaggacttccagttcgtagtctctgttctagtctattcacagatattagaacctggtggcagatttagattatgtcatcctgcgtaacttgagatatagttttattttggtttggaaaaaaatctgatttctggggaatggtgtcctaatttttactagtagatattatagtctctcataccctttttataccttgcatttttgatttgtcatgataaagcctttaggtaattatgcacatttgtgaattaatttttacctgttaattttaagcagtcttaaattttagatgtctttatgcactatcaccacaaaacaaatgtctcaccttttaaaaccagttcccttatttccttctccatttttacccccgtgatttgtgtctgtacctttctttgtttttatttacattctgtcactgtgtttaaaaaatatattatttttcattctttttttctacctttctttcctttttttctttttgagacagggtctggctctgtcgcccaggctggagtgcagtggcacagttatagcacactgcaactcctatgtcctgggctcaagccatccttctacctcagcctcctgagtagctggaaccacaggcatgcaccaccgcacctggctaattgttttaaaattttttctcaagagatggaattttgccatgttgcccaggctgatctcaaactactgagctcaagctatctgtccgccttggcctctcagagtgttgggattacaggcgtgagccactgcgcccggcccacctttcttttttatgtgaattattcttgcaaagaatattgtatttgagaaaatggtttctatctttacagatttacttgcatatatggataattccttatgtttagtgataagagagaaggaaacagaaggttttctttttccctaagaaaactatgttggtacagacacagttaaataaattttagttaaaagtgttctggtgaaatttcattaatgtgggaaatctttctgatttcatgtggattctttatgtgagttatctatatagtcactgtagatgctaccttaatttcagatgaataaatctaatcaaaaattttaaaaataaggtgattctaagttttagttacctgcattcaaccaaattcccaaaaatattaaatggaaaattccagaaataaacaattcataagctgtaaatttcttaccatttcaccttccactgtcctgctccatcctgagaggggtgagggagacacgggtcatccctttgtcccacgcactcacgctgctgcattcaccactcagtagctggcttggttctcagatggaaccactcgggtcttggcagtatttcctgctgaaaacagagggacaggtgtacttactatatttccatcaatttgtgattttttttctattagaaatagttttaaacttgattcaaaattgagtaataatatgagacagatccacttatattttatcatgaattgatatatactatttgtcttaactgtttaccaatttccttttatagcatatagatttactgtttcttaattatttgcatttatatttttttaattggtgatatccagtaggcccaataaatacttattccagtgtcattccttctcttctcgttccctgcattaagcatgaggtcattcgatcccatctgcttttgttctcattgagagggagccagctgtgtcctggtgccgctggacctaccgaatcaatcaccctgtcagtgggcgctctttttcagagactgaattgtgttttccccgactgttaggggtttcagcgagattaactcctagccctcgataatgtcagtgatcctgggaattccaagctttcccataactgatcatgcgtgcagctttctgtggggaccacagggggtcctggacctgaccctaggcggggtgtccaggccaagcgggacgtgtcctctcccttcacaggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggtatggcctcagggctgggcccacacgggcactggccacgggggccacacacattactgcgcacatataccaaacacaggtatggcacacagtaggcacacaggtactgcacacaagtactgctcacagggactgcacaaagtatcacacacagtactgcacgtaagtgtggcccgcaatgcagcacccacaccggtactgcccacagggactgcacaaaggtctcaaacacagataccgcacacagtacccaacacagcaatgtgcacaggtactgcacacgagtactgcccacagggactgcacacagtactgcacacaggtactgcacacagtatgcaacagggcactgtgcacaggtactgcacacaagtactgcccacagggactgcacacagtaccccacatagtactgaacacagtactgctcacgggtatggcccacagtgctgcacccacacaggcattgcccaaaagtaccaaacacatagtactgcacatagtacccagcacagcactttgcacaggtactactgctcacaaatactgccctcagggactgcacacagtatcacacacaggtatggcccacagtgctgtacccacactggtactgcccacagaaactgcacacaagtatcaaaggcaggtaccagacacagtaccacacacaagtatggcccgcagtgctgcagccacgtgggcactggccacagggaccgtacacagtaccaaacacaggtactgcacatgggtactaaactcagtatcaagcacagtaccaaacacagtactaaatacaggtaccgcacacagttaccaaacactataccacacgcaagtacagcttgcagtgctgcacccacacaggcattgcccacagggaccacacgtggtaccaaacacaggtactacacacaggcaccaaattcagtatcaaacacagtaccaaacacagtactaaatacaggtactgcacacaggtaccaaacatagtaccacacacaggtacagcctgccgtgctgcacacacacaggcattgcccacagggaccgcacacagtaccaaacacaggtactgcacacaggtaccaaactcagtatcgaacacagtaccaaacacagtactacacacaagtaccaaacacaatactaaatacaggtaccacacacaggtaccacagtaccacacacaagtacagcctcagtgctgtacccacacaggcactgcccacagggaccacacacagtgccaaacacaggtactgcacacaggtaccaagcacagtactgcacacaagtactgcacacagtacgaaacagtactgcacacaggtgtcatgcacagtgccaaacacagtactgcacacagtacacaaacagagtactgcacacaggtacagcctgcagagctgcactcacacaggcactgcccacagggaccacacacagtaccaaacacaggtaccaaacacagtacagcacacaggtactgcatacaggtatggcctgcagtgctgcacacaggtactggccacagggaccacacagtactgtgcataggtactgcacacagctactgcacatactaccaaacacagtactgcatacagtacccaacacagtacacacaagtactgcccacagggactgtatacagcatcacatacagtactgcacacagtacaacatacacagtactgcacttaggcatcaaacacagtactgcacacaggtaccaaacagtactgcccacaggtactgcacacaatacccaacatggtgctgcagacaggtactgcccatagggactgcacacagtactacacacagtactgcacttaggtaccaaacacagtaccaaacatagtactgcacacaggtaccaaacagtactgcccactggtaccgcataaagtaccaaacatagtactgcacacaggtaccaaacagtactgcccactggtacctcatatagtaccaaacacagtactgcacacaggtaccacatacagtaccaaacagtactgcacacaggcatcatgcatgctaccaaacacagtaataaacagtactgcacacaagtagtacatagagtaccaaacacagtactgcgctcaggtactgcatacagtactaaacacagtactacacacaagtactgcccacagggactgcataccgtaccacacatagtactgtacatagtaccacacacacagtattgcacttaggtaccaaacacagtgctgcacacagggaccagtgctgcccacaggtactgcacacaggtgccacacacagtaccaaacagtactgcacacaggcatcatgcacagtaccaaacacagtactgtacataggcactgcccatagtaccaaacacagtactgcacacaagtactacatatagtaacaaacacagtactaaacacagtaccacacatggtaccaaacacagtgccacacacaggaactgccaataggtactgcacacagtactgcacacaggtgctgagaagggattgagtcacagcacctgggggagcaataattgactacttggaggatatatttctgtcttttcatcagcacttgttgagtctcttctataggctgggcatgaagtatctacaggtaaagaaaacagatgcaaccttgatctccatggagctaaggatatgctgggggaggcattaaaaacaagtaacacttataaatgaacgtagaattgcagagggtgaaaagagacttctgtccggatcagatttggatttagactgagtgagcctttctgagaatacaacatgtaatctgcatttgatctgagaagacctgaaggctttagctgggccaggaggaggaccggggacctgtttgtactgaggcatgaaatctttcattacggagctccattttttttaatgacatatttattgagatgtaatttacatataatatttaccattttaatgtgtacacttctgaattgtgcactctacaccactgtctgattttggaacatttttatcaccctgcaaagaaaccctgtactcattggcaatatcccccaaattccctcagggatcctcctctgggctgacaatgtggatgagtatttgacaaagctgaagttactcaattttgttgtatgtgtttctttggaatttacattttcatttgctgataaaattgtaaaacaaggaaatattctttagaagtggggcacagtagtaagaggatcattaagaagatattagtactattatcatcatcatttacaatcagtgacaactaccatttactgtttatttgcaaaatgtgagacattgctaagtgctgtttaaatgttagcttacgtaatctcagcagcagccctggaggcaggtgtctttaagccactttacaggtggtgacttaagagagagagcatccttacatactgtaaagttctgaagaactactgtccatattttacaatgtaagactttgtcctaaaaatactaaatgttctttttttacttaaaatgctcttataacatgccttaatatctataatatgcactgtatacaaacaagggaaaataatttacaatatccattaaattataagcatggcctaataaattgaaggttcaaatcagtattggaaataataacattttatgttagcatttgctgttgagatgtaatttctggaaataattctaaaatgtgatttcatttttattaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtaagatggattgtagggcgtctttataatttattgagtactattttctttgacattttgtgaattgtgtacacacattatggtctctgtagttaaatagttttttaggcatagtattaatgaagtctgtgttaagccttgttttgctttatggactagtatgttttacagtcaagattaaaatctaagttgtatccaaactactgctcaaattgttttctcggattagagacaaataatgtgtaagtgaaaacagtagcgtgtaagtcctcattgaagaaacattgctacctcagtggaaccatcaaaagtgagaaggggtttttatgtgaaacacacagtgcacgttgttgttttcatctttaggttctttgtactgtgttacagattatttgggctactttaatctttggattaaaaaggaaaagaaaaatctgcctgcttttctttttaggttcagtgttactataaccaacccaaactatgattttgttgatgatctagaaagaaaacactgcttgttagaatctttagaaaaattatatttgttagtactagaacaaaatttaagaaacctcattgtcttagtttgtttgagctcctgaatcaaaaataccactaactgtgtagcttgtaaatactaggagtttacttctcacagttctagaggctgggaagtccaagatcatggtgctggcagattgagtgtctagtgaggtctctcttcctcatagatagtgccttctggctatgtcctcccaaaggtcctacctcttactacatgaattttggaggaccacaaacatttagaccacatcacttactaatgtgtgaatttacatttttatgcagtttctgtatttcactactttcctaggaaagataattcaatctataagcaaaattaatattaaaatataattccttaattccaaagcataacctttatttacaataattgtaaattattgtatagagagattttagattgttataaattgggggccaccagtaagatgatcaacagccataaacttgtgtgaatctgagagtttaacatcaaaatatttaaactaaaaaaattcaaagaaaggaaatactcaaattctcaagtgcagtgaaagatcctcaattagacaggtcaacttaaacaccttaaaacggaagatttgagcacacaaataaaaagagttacttaatagctttatagaatcttttgccttaaattacatacttttaaatatgcatgaaacagaagttgatcacattctaggatacagaaaaatttcaataaattttcagaagttgattttgtataggatacaatctttgattacagttcactgaaaaacttataaaatagccatccaaaatttcattacatgaaaagaaggactcgaaacagatactgcatactacacatgtgagtattatgtaaacagattggatggaccaaagccgtcctaggaaaaattaagacttttgagtattattagaaaataagacagattgaaaataagtaaaatatttaactaaaaaaactaggaaaattaaaagaaagtagcagaaaggaattaatatagcagttcccaacctttttgtcatcagggattggttttgcagaagacagtttttccacagattgggggtcgggtgggaggactggtttcagggtaaaactgttccactcagatgtcagagaatcagacattagattctcggaaggagtgcgcagcctagatccctcacatgcacagtgcacaatagggttcgcactcctgtgagaatctaacactcttcggatctgacaggaggcggagctcagatggtaaagcttactcacctgctattcgcctcctgctgcgtggcccggttcctaacaggcagcctggggcttgaggaccccttaattaatacatataatggaattggagatagaagacaaaactgtagtgaactgaagttttacaaaacttataaaaatgaacagaaaatatagatgacttgtcactaataaagaaacatgagaaaacataggaatgagaaagaagttgtaagcacagatacaaatgaggtaacaattgtttgcaaatactctacaactttttcctaatatatttgaaaattttgatgaaatgaatcttttctaaaataatatgcttggcagaattgactgtagaagaaatagaaaactccaaaatacacaacaaattgacaagatagtaaaagatcatcttctccaaaacaccagtctggttgggcgcggtggctcacgcctgtgaccctagcactttggaaggccgaggtgggcgatcactcaaggtcaggagtttgagaccagcctggccaacatggcaaaaccccatctctactagaaatacataaattagccgggcgtggtggcaggcaccaataatcccagctactcaggaggctgaggcaggagaatggcttgaacccaggaggcagaggttgcagtaagccaagattgcaccactggactccagcctggggaacaacagtgaaactctgtctcaaaaaaaaaaaagtctgataatttaatatacgaattgtactaagcttcctaggaactataattgttatgctatttaactgtttttgagcatagaatgggatcaaaacccccatggtagcgtagaatactttgatatccttgtccagttttggctgctcacaaaatgaagcaacagaccggtttcttctttcaggttgccgtaaatcaagttgtacacccatgggtttctggacttcaagtttttgaatcttcagttgagttaggttcttgactcttcagcaatttttcagggttaaaatgggatatattttgcttgttggcttcgcagatacttgtatcttagaccagataggggaacctgaattctttggtttaggctgaggaagacacatgagggaaatgattgctagagggagcttcacactgtaaattgtaaaatattgtaactatgtcttgtgcttaattttgttatttgtatttgtgttcatctcttctctcagactctgggctccttagaggctatagaaaagacttggctgtcataatctttgggggacagagtttgataaaaacatggtaaggagaggattagcatagaatagtgttatgagagtaagtgaaagtagaatgctcattgaggaagctagcggtagtccaggggagtccttgaccgagagcaatgtggaagaggaaacctgcatccagggttctgccatcactgtttttgagaaccaggcatggcattcagtctgcatgtctcagcatgtgtagggaaggtggtaggcacggactggatgcctgcatttttctttcttttttctttcctttcttgagacagagtctcactctgtcacccaggctggagtgcaatggtacgatctcggctcactgcaacctctgcctcccgggttcaagcgattctcctgcctcagcttcctgagtagctaggactacaggcatgtgccaccatgcctggtaatttttgtattttttgtatttttatttttttttaagtagagacggggtttctgcatgttggccaggctgatctcaaactcccgacctcaggtgatccacccaccttggcctcccaaagtgctgggattacaggcctgagccactgtgcccagcctgcatttttctcttttgagcaggatgagttgttaggaaaaagtgaggctgtgctgtcaagcacagggtggtgtcagagctgcctggagcgaggtctttgatacagctctgattgtccagaaggcttgtgagatgagaaaaggcttggtagtcttaggagttgtgctgtgtgggttatatcacaagggagggttctgaatactttttgaaaaataaggttctgatgcaagcttcaggaagcataggtgaatttccttaaatctaataatgagctaggtgaaattggttgggctgtcaaattccctccagctttgtaattgtttcactgctatttgagattggtggcagtggaaaaagaagagaagatgcaagtttaagagacattggagtggtgttgatcatcaggactggcaaatgccgagtacaggacagggaagggaactctcagaggtccggggctccccagccttagggaccagaagactgttccaggcatgcagctaggaaagctgggagaagtgggctttaggggaagaaattgaaacggaatctgtatttttatggaaagtccggaaaaaccgagtgtgttcagaggtgcatcatgctaatcattgtatagcagttaaggtacaaatgagggaggagagaggaccgggaatggagagctgtgggcagaggacaaaatcttggccaatgcctccttgtcttggcaggaggagcagcccaaggctgattagaggactgactgcgtgtgtcaccctcttaacgttccaaatgactcttaaggaattcgaaagtttacccccaagcttgtcctgaattgctgaaataatgcagtagcttgatcaattcatatttattacatggtcaacctgaaggaattcttaatttagtaaatgtatataaaatgaaatatttaaattactaattttgttatttgtagatatccctttagtgatatctgtgaaaatgctaacctttttagaacaaaagatcatgttagagtcacttttgttttcagtttattatagtatctagtgtgcagtattcatactgaataaacaaggtattaaaatcttgcttatcctgaattttggacatagttatgtagactccatgtcaacaaatgcccatatagaaagtaaatgtagaaattcattagaaattggccgtggaatcaagggaagtaattgtgactagatatttctcatgtttaaaaaatgagcaacattaatatatattaatttataatgtttgttaatttataaattaatttgtaatgttatattataaatatattaatttataatgtttccccataggtattctttgaatagccagttcctaacacaattaaaataacatagttgcaacattagaatctaacttaccagaattttcatcttctgggtaaaacatgtgccttgtgacatttaattgtattactagcattgacagtgaattacatctgcttttcttttgctttgtaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcaggtaaggtaacggattcacagatggaaatttagtataattaaactgacttagtgacctgatgacgtctagaagtatttaggatggtagcattagcttttggtattaaagatgtcacatttgactccaaaacatttattggtaattaatatttttattctttaatgtcttgactaaaatattttatccagaaattgctactggagtttatgtatatgctcattaaatttcagtgtttgcaatttccaagaaatgtcaaagaagtttattttattagacttccttttgtgtttttcagatgtatttatcagtttagattaattcttagtgctagccacagtgaaaaggaagtcgaaccttgatcatgagagacagtgtgatgtcatgaaaaaagtatagaacttagaaaaagacatggcttctagcttcatctcagtcgtgtgacttgaggcaggtcgcttaagcactctgagtctcaggcttcctcccttgtgaaatgtggagagctccggcattgctgcttagctttaaaaaatgtgatgatgaagtgaagcgaaatgcaagagtgcattctagtcacaaagcattataaaagtataagaaacatattcattaaaatgtgtatttttttttaagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacaggtgggtgtaattctggtggtcactttttatcatctttataatttccagtagatggtggggagtgtttttaggaaataattgtctttgattcttacattattatttctagctcatactatatgggctcaagaaatgtaagtattagtgtctaaggatctaatgggagccatagactgaagcattagcattttcatttttaatttaataatgaagtagtttatattctgtaagctgtcttttaaagctgttagttggtaattagatgaaatgctggactgtgtctagtatagtcagatagtgaatatttcagaaaagagaatcttaaagaccctgtgatttctaggcctgtcatcagcaaatctgaatggtaattattctatgttgttgactttaaagaatacatattttagatattccataaacttttcattcagcctagcttatattttcacatgattggaaggctagctcgtctctatgtggatgtaatccggaagagatgcatttctgactagtgctggggcctattcgatgagtatttctgtgaagccacagaattctgtgtggtactgtaacacctgggtagggtgaccacagcttaggagatgtgaaagggagagtcactaggcctaaagctgctgccctggaacatttgctttgagacagcattttaacccagatatgtctgcctggatgtcgtctacaaagcaaaaccttaaatattagaataagttacctgtgatagtgttgttttgatattattgatctgactgcctaagcaccctcaacagaattgacgtttttgatttcagtatcgttgattgcttagctgagaaatttacctgctgcttgagaccacccagggagtgtggtattggcggtgttatatgtggactcctgttaattacatatccacttacacttcactgcattttgtggagggaatcctgtgcagggcactgcatgtgtttgggaactggggaactcgggggcacatggatgttgaggatgcttgtgttcctgctcgctgtagcaggatgacgggtccccagttggcccaagagcttaccgtgctaagaagaatggagcttgggcgcttgcttgctcagtggaatgttaaaccaaatctttttcagtcaggaagccagcctcttccagtgtcctttcgtagtagtattgggaatatgggtgttcaggcccttgtttccggacccagtgaccaatgctgtaattgcggggtcacctttattaagtggtatattgtgcgaccattgtttgtcatcaatttcgagggacacatgtaggagatgaatgtagagctttgagaggacactaagcagatcagcctgttgttgcagagctgcagtgctttgcttttacagattgtgtgcacttggaatctgcctacaaggagagcatccagccagggtttcattcctttgaattgttggaaattcccaaaataccacatatactcatgctaaagataggtaaagaaggttactgtagtaaaatttattggaaaaaacaaagaaccaaggaaacaaacagaaaacaagcctccatcagttagcgtgagacacacatgtgcttaggttagagtggcttttacaggcccctgcgtgccactgcgctgctgtgtggaagcatcacagtggaggtgcaggcgtgcattttctaactcttctctattatgcgacacatttttgttctcccttccacagtaaaagtagttatgaattgtctattttggatattagaaaacgaagagggaaaattttgtttggaactgagaatgaaattctgagtaggcagattcctaagacactggaatagagcccatgatgcagcttgtatggtctgtgtgtgcagaggcagaagaggggaccaggcggctcttttttgtgtgtgtgggtgtttttgtttgtttgagacggagtctcgctctgttgcccaggctggagtgccgtggtgcaattttggctcactgcaacctcctgcctcagcctcccaagtagctgggattacaggcgtgcacccctgcacctggctaatttttgtatttgtagtagagatggggtttcaccatgttggccaggctggccttgaactcctgacctcaggtgatcctccagccttggcctcccaaagtgctgggattacaggtgtgagctgcgcgcctggccggctctttgtcttagatattcttcgtactagccagcctgttagtcagataattgtgtgagatttttttcttttttttttttttcaagttctcagttcattgctgaattcattgttcatcttttcctttgaaagagaaatcgttgactttgatgaatgctggatacactttgtgtatgtaaatgttgctgaaagcaacatttggatcgttggtccaataaagggcctgaggcccaggctgtgagagacagtaggtgatgaggctggaggctctctgcgcaccacgtgttgtcagatttagatcagtctataaaggtgtcgtctcatttagtacaattatttttctgaatacttagactcattgcagaacttgagttgggagagttttacttttaaacacgagacatctttttaatgtttttaaactattaggcattcgggtgtgtgttgtccttcatcctccgttcgtgccttgtgtcttgtagccggtggaagcacttaaagataaggcaaacgagctctcttcagagttactaatgtgttcagtttttacctgaattgccatcatgacttcaaaatgaaatcattaataaaaaatgttatttaatcaatgacaactctttcactgtagtatcccaggcaagtaacctttgacagcatctaacctgatgaactgttgttaatttttctgaagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaaggtaaatgtttcaggatatttaactttgagtgatcccagcagagttttgcagcctttcccactcattgcagtccattggtgtctcccatcactgacttttaaaacaatttgtgctgtatgtgaaagagattgaattgagtatttgatatcattccatgtcctcttaaattagatttttacttttcaattttattagatttcttaggggaagttcttttttgaaaaaacaaaaacaaagtgatcagacttcttgttaggaaatattcgaaatcttgttaagaagtagttgaaattttaggactgcagcaaaatctaccgtccttattttgatataggtgctaccaatttttttccatacaaatatgcaggggtgtgtgtgtatgtgtgtgtctgtgtgtgtgtgtgtgtgtgtgtgtgtgtttggtatgcgtatataattatacaaataaggctgggtgtggtggctcacgcctgtaatcccagcactttgggaggctgaggcaggtggatcacttgaggtcagcaattcaagaccagcctggctatggtgaaaccgtatctctactaaaaatacgaaacttagctgggtgtggtggtgcatacctgtaatctcagctacataggaggctgaggcaggagaattgcttgaacctgggaggcggaggttgcagtgagccgagatggcgccattgcactccagcctggacaacggagtgagtgagactctgtctcaaaaaaaaaaaaaaaaaaaattatacaaataggaccttgcagtgcatactattttgtgaccttttatccccggtatattgagaacatctttcaagtgtacatctgtatgatctttagtattctataaagtacactcagtgtagattcaaagatgaatgtaggtcagtgaactgtgggtgactggtctgcggtgagatgaggctcctgaaccagaatataaagcagcactttgcttccttcatcagtaaagtttggctacaaaacacaatgtcaggtcaactgtagactgtgtgattagtgacatagctggctgcgtctggcacaggcttcttatctcacacaggcatgtcagcaaacagtgtgctgaccagtttactgttttgttttatggatgtctcaaatgtattccgtctttggggaggattatacacttacccctatggtgcctgcaaccatgcacacgcagaaaggttttaaacaattatggaatgtaatagcattttagaatattgtttaatggaacaatgtctgagttttcagacagacgctaaaggctttcagggatggtattctagaaatgcaaagagaatgctttaagcatatgtatgtattaaattatctccctgttttcttttcaaaataaggtgtctgatatttgaaaactcgccgaagtgtacttttggacagatttgcagttgtgaaataacttccaaatgtatgcgtcccccttttttacatctcatcctcagatgggtttgtggctccacaggaccctctgcgagggcacgtagaccagtttgaagagcagagccctgcgcaacagtccttcgaaccagcagggctaccccaaggtcagtggtgggttttcaatgaaatttgtaagtgagctatacttcagttgaatttaatctcatgacaaccttacatgttttctcttaaggcccttctaaagtgtatggtttcaaaccaaataactttttgcatgcattgtagatttttttttattgatgcatactattttgtggtctgcttaggtcttctggaaagtgacctttgcagccattctacacgtagtttccagtcaagaaaaggtggctgagtagaaattggaacttcgtggtggctggtcctgtaaagcctccggtgctgtaatgtctgctgagcacagcctcctgcctgttagcaaacagtgttaaagcttgctaatagcagctagtcctaattctaattcagaaaatagaaatgcccctttagacattttaaatttataaaccttttcttagaacattttaatgtaactttaatatttttgtagaactcctcttttctaatttattttaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtagtgagtatggacagaggggtgcatacatggcagtatttagcaggtgctatgttattcttcactgtcattattaaaaatttccttaagggaaattttaagaggcatgctcacttcttgtagcattaaggttactgcattacctgggaaatcctcagtgtttagtacacagggctttctttttccttaaaacattttaattttgcttaaaggtttcactgccatggtgtggccttgcatttgtgattaaaaaccaaaaattgactagagtgctatgtaataacacgttgaaaggtactatgttgctttaggcacaaagcctcaacatttttatttgtggacttttaaacatgttagaaggaaaatataatgaatgctgacgttaaaaaatatttaaatgcatcatttaaaattttatctcttactcctggttggagacattttaattttggttttggttttcattttcctgcttttggaaatttcttaatagtgatgagaaatgattgaccaattgttatccctctttaaaatccaccgcgggtagctttgcccaagtggtagggctggaccctcccgtgaaaatttcagaacatttttctcataggtagaaactacataattggcagcagatgctgaatctgggaagtggagaacgtacttcttagcagctgactttactccagagctctctaaataaaactgtgcaaatccagttctgttgttgtggtttatctaagttggttttggaagtcaggtaaacaaatgcgacacaggcccttgcttatagcaacgtgcacttgctgcccaggggtggatgactctactgttcgcagtctgtcctgtgactccaggccttctgaaggtcagtggagcttatcctctactcagtgtgagcatggatctattatagagtggttagaaaacattgaccagatttttgttttgtccttgctgtggtagcatgggttgtaatgccgctgtcaggaagggatggggtcagtgtgactgccctatatgtgcgtggtaccgttcttggggatggagagcatgtctttctcaccctctggtttgtgtgacaagaggagacataatattatactctctgaaggtgggattttattcactgtcagtaagagtagagcagatgaaagaggaatctcttattaagatatataaaataatcagttttatggttgattaagctttgtattaaggtagggtaatagaaaataaataggtcttcatttaataaaatctgtataagtgatctttattattgctctggcctaaatgattacagtgaactatttggggtttctctctcttagatccacattttatgaatgttcttatccttagttcttagctgctcagttgttttatgtttattcacagatattcaagtagtttgctttatacttctcttaaattttagacaactcgcttgattcaggagtcatcccaagaggaactggacctgcaggcacaaggttcccagtttctggaggacaacgaggaccagagcaggcgctcttacaggtagttgtctgcacagaccagctcatggtattgccggctcccaggaacggatgctgctgtgtgtttgccccgctccaagggctctgcgatttcattctctcaaaactgttcaaaacagttccattgtcatccatattctgtaaataaacaatctgagacaaaagagattaacttgctaaactttttacagcagataagtgagcgggccaggatttggatacggcagtcttcagtttgtctgtttgaagtactctgctgcagcttcccgtcactgttttaagtcattattattccattttcgaaattagttaaatttatattatgccttttagttcaagactcttcatgtgctttacatataacaatctgtgtaccaggatacagcacaattagaaagacagctttttagatgtgtccgtccactggctcagcagtacatactgagcaccctctgtgcacaatgtacaagtaatttttgtatttttagtagagatggggtttcaccacattggccaggctggtctcaaactcctgacctcaggtgatccacctgcatcggcctcccaaagtgctgggattacaggcgtgagccaccgccaaaccagatttacaagagtgaattttcaaaatgtattcagacacttccagcttttagtttaatttggacttgagaggaaagttagttgcctctacgtgggcacccagtcttgacttaggttatagtgtagggacgtcactaacctcttgctggagattaaaacttgagaatggacaaaagagacatactaatggaataagcttttaataatatgtgagtaggagttttgaaatttataattattttaatccttaagataacattagtctattcagtaacaactgaaggggaaataatactgcatatttatatattattcagcataactccagtatactctgttttgtattttgtaaaccaaaggagtacatggattggcatttccaagtgactagatacaggagtgattctgcttctgaggcaatggaaggattcatagtgtctaacgacttaataaagaaaagagtgcatacattttcttcctattatgcttagagagagtttctaattaatcaaatattatgtctgctggggagttataggatttactgttttttaagtaatacatttaagactgtaaatactctaagcagaatttggtctaacaaatgattgttggcaatattttatactttataatttcttcaatgttggagagcacacctaggttctataacagttgtgcctaaatgtttcatggttgttggtgaagcttgtttgcttttcttcccttttcaggtgctgtatttgtaattgtgctatgaattaacgtggtctgagttctgtatgtttgctttgtaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggtcactgtctgccttatacttggagattagtcctttaaagaaaaaagctttattgagatataatccatataccattcagttcacccacttaaagtgtacaattcagtgatttttagtatgttcatagagttctgcaaccatcaaaactgtaattttaggacatttttattacacataaaagaaactctgtacccattaacagtcactccccatttcccctcaatgcccagaacctcaggcacccagtatctacctctgtctttatagatttgcctgtcctgggtattttatagaagtacgtggcattttgtgtctgcttctttcacagcacagtgtgctcaagtttcacctatgctgtatgggtggatcagaacctcattcctttccattgtaggatatgccacgtcttattgatccattcatcgggtgatggacattggagttatttccatattttgtttattatgagtaatcctgctatgcacatttgtatttaagtgtttgtgtggacatgggctcattgctctacctaggagtggaattgtttggtcatatgttaactctgttaaaacatttgttttccattgtggctgtcggatttgacagcccaccgtagcgtgggagggctctggtttccccacatccttgccaatggctattattgcttctcttatgaccggccttgtggatggtcatgagccttcccacgtgccattgtggttttgctttgatttgcatttcttcgatggctaatcatgttaaacatctttcacagacgctgagaaatgtctgttctaatcctatgcccattttaaaattggattatttgccttattgagttgtaagaggtttttatattctggctactggacctttatcagatgcatggtgtacagttaaaaatatttttaacatattctgttatctgttacatatactcagtatattcattataagtttaatatcaatgtatattttgtataaggctttatttgaaaatgaagatatactgcttagaaacatagagccaagcaaaataaggaaaagttttattgactggtccataggttgatgattgaggagtggttttagtggatactggaaagattgctggcagtagtttatatggtactttgaaggacatgctacggaggcagagagcagcaatatatgacttttataaggaacggtggaagaaagacagaaataggaggaaaatagctagttacttggttctgtgtcattggtccagaggagagagggccttctgtatgggactttatttgaaagtaaagctgtatagaaaatttatagactagttcttaatgcctaatctacctcatgtgctatgggagtgatgaaaagatggattggagaaaacatttctggggtagaatccacatgttgccagtttaaatgtaaaagaccaaggagagaggggacttgatttgttttgaagactgtgacttcacagagcctgctgatttcagtagagaaggcagtaagatgtcctatgtcaacttccatgttcttaaaacaatcccatttctaaaaattggaaacccacaccaaataaactgtctataattttgtaatttacttttttttttttttaaccaaagtctgttaagcctcaggataatgttgtaacttattaaacatatctttgtttggttttgactgcttctggttttaaggtagtgaaataggattggttccagccgttttttctgtttctgtgcttgcaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggaggtattttccatttgttgattcaaggtgtattaacccgatgctaatttaggaataaatccattcacaaatcaccgtgagtattttgacgtggctatatatagattagttcagtagcaccctgagtttttaataattttattttctgattatgaaagccatacatgctcttggaagaaaaattcagaggtgcaatgaagaaaacatctgctcttacaaatcaccacgcgctgaattggcattcactctcacactgtgttcttcctttcatgcttgggcgcgcatgttgctagagacttgaatgtttttaacaaatatggtatcttgctctatatagtgtagtatgcttaattttttgtctactgaagtttattacaggcatatttaatttattgaacacaggcctacatcagttcagatgactccgtggaattccatcatattttattatataattttctgttgatgggttgatggatgtgcagctagtatctggtctttcactgaaatggtaatggtagcagttatggactgctgtaacccttggtaaaacctgtgcttgccattacgttgtctcatgtaatagacacaaaacaccgcatagttggagggattaatctcattttgtacgctagccagctaaacattagacacgttaattcgcccaagtcccataccaagtgggagatcctgagtattatttttgtgcttatactttttgtacttataagacaacttctttttaggaagttccacgatgaaattatacagttacgaatagagcacattttatattttgacacgttgcgccagcacacagattgcagtttttaaatccgtgtgtgttctgacactcttggaggtcacggctggtctgagtgtatgtgttggcctgggctcttgcctgtgccgcggccatcctgtcctggcacagttggtgcgcagtgttgtcagtgaattttgtgtcagtggctgtgtggagacaggggtgctaaatggggactgtcatcggaggtcagacctgctggtggcccatcatcctctctcaaggtactgccccctctgtctgctttgccaccatctgaccgaaagaccacagtgagaccatctggggtccccggtgggttatggcagtctacctttctctgctgttttgaggaataagtctgtaaaacttgcctaaactccctcaaagtaacaaaaactgcgacttaaccattgccagagccattgtgcacctcatttctttagtagataattctggaataaaagtttctgacctgttaaactgagatagttcaaactctttaatctgatgatacttagtaaagccttcatttccatttttaaaattctgtcatgagatttcataaagtataaaaagaaaatgaccctttccttcaaatgagttaaaggctataggacatccaggcattatttctagaaccccgtcatttggagagtgttaatttatcagccaaatacaaataatctctaagccgctttacatattctttcctgtcaattaataaagcttctaatgctactgaattctagcatcgatttgggagttctgtttgggcttcatctcactgctacatatttatttagattcaccttgtatgccttgttttccttggatcattgtgggggaaactgcagatgaactcttgtccataggagaaaagtcacgtgttaaattgcgttgttttgcccaaacctagagacttggataggggttaaattccctcacatttattgtgacgttagcctgcttggcctaacacttgccgactgtttcatgctgtctgtctgtcgtgcttaattttgttgttctctgtctccagtctgtgctatactgattgtgttctcagttcgttaaagaatgttaacagagttacctccttatttcctcatgtgtgttggtggggccgctatctataagctgccctcaaatcattccaagctttattggtataatgcggactttcagtttgctgtatctttttctggaatttctacgagatggacattgaatccactggctttatcctccatgactttctccctcaacccacaccctcgctgtcctttgctcccctctctttcttcttccctccccaatcccctcccatctctcatcttttttcccttttatgtgctaagaaaaattatccagtttgtttttaaatttacttatttggtgaattaaccactgtccactttgcaatttagtgtttctgttgagttgtaagtttttttcagtcagtcatacaataatgacctccctgctcccagccaaactttttttccttctctagtattcttttttaatcaattggaatgcgtccttatttttcatttaggaatgaatacttatgcatatagttctctctcagtatcagctgaggattggttcctggactcctgaggacaccaaaatctgcagatgctgaagttcctgatatcaaacagcatagtatctgcatgtaacctacacgcatccacttgtatactttaagccatctctagatcacttataatacctaatataaatgctatgtaaatagtttggggttcttttgagaaacagggtctcactctgtcacccaggcaggagtacactggcacaatcataattcactgcagccttgaactcctgggatcaagcaatcctcccacctcaggctcctgagtagcaggggctacaggctcaccaccacgcctggctgatttaaaaaaatttttttttgtagagacggggtcttgctctgttgcctaggaggtcttgaacttccctgccaagccccaccttggcctcccaatatgctgggattacaggcgcgcgcccccatgcctggttaatttttaaatttttggtaaagatggactcttgctgtgtggcccaggctggtctcacactcctggcctgaagcaatctttccatctcagcttcccaaagcggtgggattacaggtgtgagccactgcacctagttgtaaatagccagtatagtgtatcgtttattgaataataacaagaaaaaaaggatctgtattttctaactgcagtcggttgaatctatggatgtggaaggcacagatacagagggccaaccacatatatttttaaagttttattttcttctttatagtaattgtttttagttgggggctgtttgctaatttattaatttggtctcccatttttgggcttctggttttaaaaaatctgatggtaattcattttttgcccttattaataaatgaatatctatatttatgaataccggtagcttgtgtggacactgtcagcctcaaagcttactcctgaattttcagggaggtgtagaagcaggtctttaatctgagcgtcttcctaatgttggtcatcactctcctaaaggatgcccttcacttggcttttttttggttacataatatttctacatatttatgacgcacatgtgatattttgtttcatgtatagaatgtggaatgatcaaatcagagtacttggggtattcatcaccttaagtatttagcagtttctaagtatgggaacatttcaagttctctcctgtagctactttgaaatatacattgttgttaactagtcaccctactctgctatcaaacattagagcttattccttctatctaagcggatgttttcaccccttcaccaacctctgttcatcccccgccccccactttccagtacacttggctgttttctttccatgacctaagtttctcaatagaggtgggaaaatatagcaactctctaccatcataaaaatagcttggttgagttattaattttcattacatacatacctatttagttttaattgttttgctaaaaacctaggttttcttcattacgattttgatcccttttccttgattttgtgtagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggtgagggcatggctacgccgcgcgggttccgctctgaagactggaggtgcaggcagctgctcctttggtgattttcactgcagcagggccattagtttctgaacctggtgtcacctgagtgatggcagcttacttacttgaatgtatggttttaagcttgaattagttctctgtagtaaactcattcagaatattaattagtctgttttcggctgtgcatggtggctcacacctgtaatcccagcactttgggaggctgaggcgggaggatcacctgaggttgggagtttgagaccagcctgaccaacatggagaaacctggtctctactaaaaaatacaaaattaggtgggtgtagtggtgggtgcctgtaatcccagctactcgggagcctgagacaggagaatcgcttgaacctgagaggtggaggttatggtgagctgagatcatgccattgcactccagcctgggcaacaagaatgaaactccgtctcaaaaaaaaaaaaaaagtctgttttctctatagattgcttatgcttatttctgtatggttgtcatagtagtaaacaatgaaaacaaatgtatccattgaggaaggcagggctctaagctttgtggacaggcagaagagcagcaggcgccctcctgcctctgaggcctgccagtcagtgtgaggagtgggacacaagcgtgtgacaggagggagactaattggcaatcggccaaacagcagtggctgatacatgagatcgagttgagcagaaccatgaagaatctggaaaccaagacccatggtaaagaacagaaggggctctcagaatgtccttcctttctggagaaaggaagaccaaagtatcagcgttctcctgaagaatcagaagtgtttctgtatataacagggatgcttatgttttgctctaggagatagaactaattattcagcaacttaataaaacaaaccgtgaagattttaatattgcaggatgtttcagaaaaccaaagggtgtgttccttgtactctgttctacagaggacagcagcaggtgctgcagggaaagggtaggtggtttcaaggagctgttgggttggcagtgccaccctagtgagcacacaccttgactgctggccttcatgtttcgaccacagcaggaaggggaggtgtgttcagctagagagtgacaatgagggaggtcactggagaagagagagagcccaggtcccactgggtggtgtggccacaggacccttcaacagcgagctctcgttgagccatgcagtgaagttccggggtaggatctaagttgatggtgtgatctgaggttgggcataagacatagaaagttaaactaaggagaggaggagctaaggggttgtgatggaaaacttgagatgtttataagaaggagtccagtctggccagcagttgtgtgtggcctggaggaactcatgaactaactgatagggtgagatagttttccagtaggggttagtggtggagtcatagatgagaaagtcaggcctggcaagggtgtcacatggaggtgttgagacagcagtttgtgacctgcctgtgggtggggcgtgccagccaattagcagagacaaaatgctaccaaggcgacataaagtgctaaacatgtctccatcgactgtacctgaagaccagaagagtgggagtgttctttttttttttttttttttttttgagttggagtctcgctctgtcgcccaggctggagtgcagtggcgtggtctcggctcagtgcaaactccgagaacgggacgttcttatagctgtgttttcttcttcttgtcctatccttcattttaaaaaagttcaaggttcagactcccagtgagtaagtgtgatgagaaacaaaaaatggtactgaagggtgtcctgctccccagagataagcactgttaacagttttttgagtatttttttcggaaatgtctagacatataccaatgttaagttgtacgattctggttttcaaatttttacatatcaatgagtcataggtatttttcttcgtcagtatctataaacctattttattctttttaatggcagtgtagggttctgttgcatggggataccaaattaatcttaccagacccctcccgacgaacactgagtttccacgcttggtgactggcagggcgctgtggtgactcttccgtgagcctgtgtgcctctgatggctcagtgagggtagagtctggcaaaggccaccagagggccgtgtgcctctgtctttcagagactccgagtgcctgttttacagctgcagccaacaggatgggggaaatgatatctcgtcgttttcatctgttcttctttgattctaagtgtgattgaacagctttgcatatggtttttggctgtttgtatttcttctgtaaactctctgtgcattgccaacttttctactctgatatcgtttgggttttcctgctgatttgatttgtcagagttcttgggttttttaaggaaattgtcttttttttttttttgagacagagtctgactttgtcacccaggctggagtgcagtggtgtgatcacggctcactgcaacctctgcctcctgggttcaagcgattctcctgtctcagcctcctaagtagctgggattacaggcgcctgccaccactccctgttaatttttgtattttcagtagagacagggttttaccatgttggccagtctggtctcgaaatcctgacctcaggtgatctccctgcctcagcctcccacagtgctgggattacaggcgtgagccaccgctcctggccctaaggaaattatctctattattatttgtcctgcaaatattttcgttgttatttggatttgtttatggtattttttgtatggagtgaagcttaaagtttttcttggccaaacttaagcagaacgtagtaacacctaattttaatttatatagttataaatttcaaatcatgaagtcgtttgtcaatatgtctataattaatgctttttggataggcatgttcgaatccatactggagaaaagccatacaaatgtgatgaatgtggaaagagttttactgtgaaatccactctcgattgtcatgtgaagactcacacaggtaaggaaaacatgcctgcgtcattggtagaggtcttaggatagcatttcgtatgttttgttcctatatattttgtgtacataaatactttccaaattatagaacgcttaaaaatgaggcaccaagaaggaagtgatataaaagatttttttattcctgacacagggaaaactgtccaaatgacactaagaaaaaaaaggattaggtctcaaaagttgaatttttcttaaaaattgtcacgtattcttactcatgcttaaataactttgttaaaaagattacctcttagtctcatttaagccaaagaggtttagtttgttgaggttttgtaaaacctggcacttagcaaatctgatggcagttatcatttcataattatttttatatggggagaaactcttgcaaaggcagaaatgaatgtccaagtttcctggcctttttctcatcttcatcttgtctgtgcctttgcttctggaattctgcacagtgcctcctagcggtggggaggctgcctctgcctctgcctgcttgggaatcctgtagtcctcctgtgagctctgtggtcctagacaaggttctcctctcagccacaagtttcttctgcagaagatggggctaatagttgtacctccgtctttgggagttcagacatttaaatagctttaagcattaagacatttaaatagcttggaaaagtgtttggcctttggtaaacacttaggaatggattggcctgtggtaaacgcacagtgaatgcagagctgttgttataatgattcatagaattatgattatgagactaatttacattcttcattgttggttataagcagaattcaacagacaagaacaaatggactttcacacatttacctgaagccctgtgattcttttctgatgggttaatatttgtaactagataaacagatccctgagcttgtttatatgactgtcctgtgtgcagtttttctgttgtttcattaggctccctgtatttatctcttttgtgtaatgcagtgaactttttgtggatatggagggcccggcatcacttatctttgtgcccccaggcctagggcacggcctctcatgcagcaggtgcccagtgacgtccacgatgacttggtgcacgctgcttcatcatttccttggttttggagttcagcgtaggccacgtggataaggactagaaatggaagtctctggataaataccttttggtgcctctttctccattctgaagtagaggtgtgatttctgaggaacccagggcggcgttgggatagcaggttgcactagtccctcggtggatcctagtgtgcaccatcctgtaaaaattagcatttgttcctggacagtagaggggaaaagccagccaggaagtttttcagctcccagaggctcttggagggtggagcctatgctcatggtgctccgagccttcgtggcctttgatatacccagtaatcatgaaaagagcctaaggaactaggtacatgacactaggcacacagccctttgaccctagcatagaactttcctttgcatattctcccagtgtgatgcctacctgtgctggcattgtggttgcacctgtttggcagaagagaagatagagagatgctgagatgttaaagtaccacttgtaaaattaaagaaaagtgacaagtaattcacgatgctcgggctgttaagctcataccacccagtataacttactgatagaatataaatacaactagctccaagtcaagggttcaccaatacatagcagtggatttaagacaacactgctaacaccgtcaacaggcgttgatgcaagaatgcataagattcaccattgctaaacgaactacactgttaaatttacaatactgcagcaattgcctgtgacgtccgtaacatcgttataggtgaaagggattctcattaaagtacttccatccactgattcaacatatttacatccatagtgacagctgagtggggtgggggtgagtgtcgcgactgccatcgcctctgttgattcttggctgggcttttcacaggtcagaagctcttcagctgtcacgtctgcagcaacgccttctccacgaagggaagtctgaaggtccacatgcgcctgcacacgggagccaagcccttcaaatgcccgcattgtgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcaggtaaacgctgagccgagggaatgagagcagcacagtgattgaactgttctgtgctgcttctgtctgttcccacgacagaagagatgttgtttaccgtagcaccacgtttcccttctttgagccttttccttataaggcattcggaaaaattggaattccgtcttgcagacattgctcctttccatttcgcattctgtcttccatgccagctgcttttttacactaagcactttgtttagcttttgtttttagtgggtgtaaacctgtttttactcagttggcattctcataaatttagtagtgagaagtgtaatttataaatactcaatagcattgtttttgatatagtgcagttttccagttgttcttgcgtctcatagtgcttgagaagtgttacattttagctagttgtgttgatttgtgtgcctgtgagtaaatgcagccgttgtacatggcagtcagatgtcctgtgtgcccttctttctgtttctgtgactcgtggcaggattgcagcctgaccaccactcagtagtagtggttgttttgaacctttggctaatcagtagaatctttttgagctacttttctgatacgtttaaagtgggcaatatgagtatccatttcacagagttctggggtgattagacagtgtgtgtgtatggtataaagtgtatctgtttcacagagttgctctgcggtgattagactgtatgtggatatagtaaaaagtaggtttctgaggtgatgagacagtgtatgtgtatatggtataaatgagatttcgcgggtgattagacagtgtatgcgtatggcataaaggagtatctgttttacagagttgttctggggtgattagacagtgtatttgtgtatggtataaagtaggtttctggggtgattagacattgtgtgtatatatggtataatgggtgattagacagtatatgtgcgtatatggtagaaagtaggtttctggggtaattagactgtgtgtgtatatatggtataaagggtgattagacagtgtgtatgattagacagtgtgtgtatatatggtataaagggtgattagacagtgtgtgtatatatggtataaagggtgattagactgtgtgtgtatatatggtataaagagtgattagactgtgtgtatggtataaagggtgattagaccatgtgtgtgtatggtataaagggtgattagacagtgtgtgtgtgtatggtataaagggtgattagacagtgtgtgtgtatatagtataaagggtgattacacagtgtgtgtgtgtgtatggtataaagggtgattagacagtgtatatgtgtgtgtgtatggtataaagggtgattagactgtgtgtatggtataaacggtgattagactgtgtgtatgatataaagggtgattagacagtgtgtgtatatggtataaagggtgattagacagtgtgtgtgtgtatggtataaagggtgattagggccgggtgtggtggctcatgcctgtaatcccagcactttgggaggccgagatcgacggatcacgaggtcaggagatcgagatcatcctggctaacatggtgaaaccccgtctctactaaaaatacaaaaaaaaattacccaggtgtggtggctggcgcctgtagtcccagctactcaggagggtgagggaggagaatggtgtgaacctgggaggcggagcttgcagtgagctgagatggcaccactgcactctagtctgggcgactgagcgagagactgtctcaaaaaaaaaaaaggggtgattagacagtgtgtgtgtatggtataaagggtgattagacagtatgtgtgtgtatggtataaataaagggtgattagacagtgtgtgtatatggtataaagggtgattaaacagcatatatgtgtatatggtataaagtaggtgttcgtattccacaacaacattgtattgacataatgtgtacaacttatgtatttaaaaatccctatgtaaaaaatgaattactttagttttaagaagcattcataatatttgatcattctctttctctttctctggccagctgggggtgacctgaccgtgtctctgacagatgggagcctggctaccctagaaggcatccagttacagttggctgctaacttggttggaccaaatgtacagatttctggaatcgatgctgccagcattaataacattacgttgcaggtatgacaccttccatggtctcctgtgctgtaattctcttggcatcacagagaagcatgaagttttcattacaagtacctgtgctgcttttcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtggtaagagccactcacttttgcttattttgacagctggagtttcagtttcttgcttgtgattacatatttgaatttaggatgttatgatgtcattttcttctctttgtagaagagaataaatcaaatgtcctgagaataaaataagcttttcttacaattaatgatatgtatttaatatatgctcttagattattactaccttcatttaattactcttttcatcctggcttcatttcctcacaaggctttcttcttagacgaaggaattagagatgactgatgctttgttttaaatctttgtcttattgaaatatgtaataacagtttaattaaaatatttttaatataaaaacaggggaaattggttattttgaatctcaactttgttttgctttgtaatgacaatcagggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttagtaagttataattttaaacatcttttcaccctgcaatttaagtactgtatatcttactatctcttttcctacaatactctgctgtgcataaagcccgtgctcaatatgtatttataatttatgggagaaattgaagtttagtgaaaataatgtattctaattcagatctggcaccagaaatgaaaaattatagtttctcatgtcacttccagtttgagtacagtcagttatttaattatttcattcattgactcatttttagagaataagttatttttgtttagcaaacagcagaaagcgtagctttgtggttctcactcatgctccatgaaactggtataaactgtttacattagggcattttagatccgcatggcactctctttaccgtatgtcttcagaattctattaggattatataggaaaattgaaacataggagaacattgaaaagtagataaacgggtaggaaataccctttggcagtaaagcccacctaaaactggcaatctaattctctctgccagtcaccaggctgactcattccctgtcttagggctatgctgctcgcattctgacttttctccttgtgtgccttccttggtccttacgtatcattaattcccatagtgtgttcggatctcagtgagcattgaacatattttcctggtgtgctttgctcacgtgactcttaactataaactctttgtattactaagagtcatttgttaattcagcaatttttagagcccttactatgtgcttgatattattctagtaacttccacagatattaactcattcaatattagttcatttaagactcgtaacctgatgatgatgttaacaaagacattttgctaggaatcaaaacacgctccgtggagatctgatgtgacagagggaagcagccccacttccctgaaacacacctgtggagaaggacagcattctagatggactcaaccatgaagggcaggatttctgctgtttcagagatatttctgcagaaattaatttcagaactgaaagaaaaggtattcataagaaaaccagaagctttctttttcaggaaggtgtctttatttcttttaatacattagtgagaaatttgaggaactgtttttaggtacagctttgcttttaaatgagatgcagtggtttttagatgctgttggacagcaaaaattaacattgaattttatataattcagtaaccttcctccttttaaaattatatttatatctgaattttaatgttggaaatacagaagagttacaatattttaggaaagctatttggttgatccaattaactttctcgagtacacttaatataagaagtattgtgctaggtcctatcaaaactacatagtgcatggttcttgctcagagttaagaaaatgtattcttcagtttgtggattgtgcctctgttcttcctgtgtgttattattggccatttggttattttgttagtatatttgaaagtgtagatgaatataactaatattttaagaatttggcttcagctgttctaggagaaaaccttaaatgagttaatgaaataagtttggtttcaactttgggcttcagattgttttttctcacttattatgatggataatgagaattggctatacagttccttatcccattttgaaagggctgcaaaaagcatttaatttatggtaacctgttaaaagcatctagatattccatagaaattttcaaagatttcatagtgtgttcttttttccattaacacataggattataaatgcatgcaagtactagagaatgcacaaatcacttcagctaagttttgcagactttaggcagttcatgagtcctagcattcagaaaaaggttacacgttgagtgaaaagcaaagacagtcctttgcctcccggaattaccctgtccagatacaatgaaagtccttttacctgatgttttcagcccagttattaataaaaaggtatataaaattgggaaccaaacaagtgacatctgcatactttggagattcatccacggatcttttgaatatgggtctgctcaggtgataatacattttctactttttaaaatttttgcctgtactcatgttcatcatgcagtttcatctcctgtttctctttctttagcattgcatgagaatgtaggtcactataaagcaatcatagtgcagcatacttttgtcttttgaatctttttctctctgattttgtgtagttgtcttgcctacacctattttgacagcagaatgtttaaagtatcttgtctttaccaagtttttccaaggcattcaatttggtttccattggatgtccaacagattttttattctcatattcatttctagttgccatactatttgatttcattatatcattacagtagctgatgaagctggcataaacgggttttgaatcaagcaaatgtgttttagtaggaatgtattgcaggcatgttagtgtgtacttgagagcattcagaacacataggataggaacacagcacacgggaaaccgcagcatcgtgggctcggcaagcctgcccagtggagggcagggaggggaggttctgttatcgcctggtgatgcccctcagatccttttaacatgcttttgctatacctggcagtgcactatatttggaaatattttcaattcattgacagtttcattccacacagtgtgtgatttttagggcctaaatactgagttaaagtaaaactcataagaagtatttttaaaatacttcacagcttaaaaagtgtgaacaaatactgtcatttagggaaatgcattttgtggtctcattttcatttttccataaattgtactgaaatgacaatgaaaactttgaggatagaattatatgtttaacacacttgccaatacgcatcttagaatgttgttttcagataccacaatattaatttccatttaggtcaagaacttattcaacacaattctaatggaaatagtgaactattaataaacgggagcataagattgttagcgcctgaaatcaataatcaatctacaggtgccaccctaacaataagcaatgatcagcttctctcccagagcacagcattgagctcttcaggcacacagcacacgagttagccaagaaagacattataagaggtcggagctaaagagctctgcccacagtcaatgaggagttaaactgtccttagcatgacaggtgtgtcagcgtcatgctttgtcacatggattatcattctgtaaggattactggcttatgtctaattctaggatacaaaattctctctaatgttaccaaccaatcgatgatgttactttttaagccatgaaagtaaataattttattcaactgtacaaagcatcgtatatttatacaagttagcatgttaataactccatgtacaaagctgtccctttctaacccagcgctggaagactcttacttagctcattacttctgccctccagtgagaattttctgacaccagctgaaaatagaatagaaaaatggaaaggaggcagctttctaagattttaaagcatagaattttatgaaaaataaacatattaatattggcagaaactgcaattacttttgcaccaacgtaataaatgagctcatgtaagataaatgacagtttcataagtaaccattaacagtttaggataacatacctatctcgttctcttcaccttgtagagattgcattcacttcttagccttgttattttccaactatgtatatcactttgtgaggaaaaaaaaactaatcttcagatatgtttgtacccaaaagctagacctcttttcatgcttcattcttaattgaaacgacctcttgtcccgtagttcatttattccataaaagattatagtgtctgctgtgtgctaagaattgtgcaaaatctgggactgtgactctgggcaggtcagagctggccctgtgttctggatctcagaataaatggagtgcagacattttttgaagaatccacaagtgactataaaattacagctgtaaccatatataaaggagaggtgatggcacagagagcacatgtcacagggggtggctctgtggcttctttgaggacatcctggctgagctgagagaggggcttgggagtgtggtggcttttctcccaacgccagccactcagctttgcatggcccatggtggcctttagctgaagcaaggaggtgtggatattttaatgggtggaaggtccaaaatatatgatgtattgttgaagttaacatagcaaatgtttttctccaaacgttttctaaaactcatagtttgtggtttttaaaggatcaggcagtgtgttcttctcatctctagaattctaatcttaggctgtgagttcatcatctttcccccgctgcatggttcatgttgcaatgtgaagacgtgctgtttgtgtgtgggccgaagcgagtggtagtcgctcgtggtgcagggctctgggtgagatgtctggattcatgccctgctggccggcctcactgagcaggaaactggccgtcagcagtgcagcctcatgtcttcctggaaactctgctgaacatccttagtgagcccctggcacattgatggagagacaagttgggttgtagaggtttcagtttgagtggagtggtgtttgtgcctcttggtgatcctggatgtttgtaggcgcagcagattgcttgattcgaaattggggatgttctgaccgaagggagaagttggatggaatgagggcgcacgcactccagggctctgctctagctgcccgcgtttctttaaactcctgtgatctggctagttcggtagtaagtgctgtacctataaattcacctccacagacgcatgttggaagtgtcacaccagcatctcacactcaggtgagggtcctttcagggcaggcgagctgtcctcagtcagtgggtgcaaggctcccacatgttatgcagctgacatttctgtataaacagcaacatacccactttgctgatttgcattttttaaattattattcttttagacctttttttaaagagccagccgaggccgggcatggtgggtcacgcctgtaatcccagcacttagggaggccgaggcgggcggatcacctgaggtcaggagtttgagaccagcctggccatcatggtgaaaccccgtctccattaaaaatacaacaaattagctgggcttggtggcgggtgcctgtaatcccagctactcgggaggctgaggcaggagaatcgcctgaacctgggaggtggaggttgcagtgagccgagattgtgccactccagcctgggtgacgagcaaaactccgtctcaagaagaaaaaaaaaaagagtcagctgagaaaatcagtctctctctctcactctctctctctctcttaggctactttagcttatatcccacttgttaaattaaaaaaaaaaaagcttttcaagggattgggtgacattataaaataaaagatgaacgcataattaaagaatatttgtgtattaatgtgatatcggctattcttaaatacaggcttagttttatgtgatcaagtaagttgtcttatgttcttgaatacctttggcatctttgaataatcctgggtataggaagcaattgttcatatattgacccactcaatccttgatattaagcagatgtttttagagtggcttgcacatcccatttgtcctagttataattatgtagtggatctcaactgtatagtagtagttaggagattgcctcttagtgagcaatatttatctagagtcaaagtcagtttcagatctagcttgaggccacaccactaataattgaaattaaaatgacattattttgaaattaaacatgactcttctaaggtaaacactcaaaaacctctaatgcccatacaaaacttatgttgagcataatgaatatgtatatggctattattattttttgattctctatgcaagcaaggtttggttaagactcatcagcttctaggttaactctggctgtttcatcttaatcgaaggcattgaaagaagtgtatcaccacttagggatttgcgatgaatccaggcgagacaattagtcagaatttcacatgcaggacaaaagcacatgcttttgttgagattcgtgatgcaggagttgaagactatttcagagtttcatcccaacatccattcccaaatctgacacaaagagttttccttaaaaagtgatcccatagaatgtaagtactgtctcagaagcagatcgtagtcttgatagaggcttgagaaatttagcacaactttttaaggaattcatctcaaatgagtattatctttttgttcttaccttcgtccacttttaaatttaagataattttgatgaataaattgagttctgcttttgatgaaagaagcaaagaccagtatttgttttctatttatttgtagggttattctagccttagtttcttctagatttaagtataatcacttattttatttttaaatagttcaacaatttaacatttcccattccccggtgtatattaaaactgaagaggacgttctcatcctcacgagttgtccctttgagtgacctggatgcttgggaacgaggggctaccccgatgcttctctcctgttctgccgcccccacctcctgtcttcccacatttcagttaatcgcaagaaaaaactgatatcatatcttttaaattatttttagaaccttacaaaattatgttttcttagaagctatgaggtgatatcccaagagatttaagacaatgttgggtttgatgagcgtacagtttattaatctttttaacttatttttgagtcggaatcataaagtcagacttgtattgctctatacatgctggaggaacagtggtttcagaaaaataagtgaagaataaaagtaagagtctacaatcttcacttcagcatgggatcttcattttcatgctaagagtatttaatttgaatataagattgtagcttttaacaaatggatagttaagagctatttgtagcttgtaatttaactgcatgcttaagaaaatttcagcttttttctgctctagtcatgtgttcttttcaatcatattgaggacagttctactggaaccggtatcatcctctttgtggaaaatccattgaattaggacattattaaaggttcactgtttgagttgaaatacgaaatttggccctgtctgaagttgtttattattttcattgaactttgtgtcaggtttcactttaatcaaacacaagccttctctatctttttacatttttcatgctgcacagtcccggaacctctgataccttaataatcactagaaagtcaggattagttgactggtgggagtggggagaagatctttggttcctttatttcagcagttggggtgaggtttgaatttttgctgtgcgctggcttcgccttggctctaagtgtgatcctgggcgagattcacaggcacatgcatctcttccccgtcttccctctgtgcaagctcattggcagctgccacctgcccgcccgccccagtctctatggttttgaccactcatgttaaaaacgtacccgcaggctagtgtgcggtaagggtgtgtggagggaattttaggaggacagctattaggtcagctgctgtactggtcactggaacgcttagtgcatgcagacgtcctccacaaggccacactcctcgggctcccaccagcactctgtgcggatgctggagcaggcgggagggtctgacctagctatctgtggagccccggcggctgcttcagcgctcgagcctcccagcctgctaatggttctactgcttttgaaggttccaggtctgtgcagcacagtgtgggaccccaggagtgtggatctgtggaggcattgtatttggagaactccagcgacaagtaagtaacctagttttcctgttggcccctgactcctaggagagcgctggactgatgtgacccaagtcacagcaaagtgctgacaggcgcgtgtttcttttgttttgaaacctggttaggcaatagctttttgaactttcctttggtcgtcatcttggcatccttagcaactggcacagtggctggcacaagtggatgaggaatacatgtttcaaatgaatggatggctcgactgtgggataaagtgagtgtgcgtgtgtgtgcccatgtgtttatactttcaacgttgtgttcactggtgcccactacaggactttgataatcccatgctgaacccgtctcatctgccagcaaggtacatgagtgtctgttttgtaaaagaaaagccctttcttcaccagatactttcgtttctcttagtatcggctgcaaggggagatatttcagttttgttgtcttttctgaagaaaattaagatgtcatgcaggataaatgaatatttaaaggatttatgagatttattttgacctcctgtcttttagaataagaatcagtcagggtgatgaaagtgagaaaatgagcagagatggtcagatttatcccgtaagctcaggagctagttattcctcagtggatcacacttgcttcctttcttcagctggtctcttcagttgtggatgggtaagctccggaagtagctattcctcagtggatcacacttgcttcctttcttcagctggtctctttggttgtggatggggacaatgcactggaaattcttgtctgagttttcattctacagtagtagctgtgactgagactatggggtcacattttcactctttgtttactggtttttctctgtgtgtgttatacttaagaagcacagtatattcatatgtaaagatgtttaaaaactaagaaaagccttatcctaaaattagaattgaagaccctgtgatttctttggtgcagcttggagacctcgggcatgaatgctgcttcctgcaggtgggagcatcgctctccctatgcccttacacctggacttgtctggccttcccattgatctacttactttgcctcttttgtagaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcaggcaagtgctcctcagagagggatgcgaaggtcctttcaaaaagtgatctttgaaaacattattcattgactccttcctaaataaatagtctgagcattttttttccccaaaatcgaagcattttttttctgattaaaaaatacggtaaatataaaaggggataaaaattcagataatgtagaagaacataaaaaataaggtaaaacataaaacccaaagctgtaatcccaccacccaaatggaaccacagttaacattttaatgtatatatccttctacacctttatatgaatgtataaggtacatagttataaatttctgcagaaatttataaaatgatgtacacatcatgtagatgagctttattgaagggcattatgttgtattcatggtttcaataagtagtatggaatttttcatgcccttagtcactgagattcttagatgaattcctaccagtagaagtgctgtgccaaaggggtgtacatttttaaatgattcgttgagctaagatgctgaaaaacctttcagactttaattaggaaaatcataatgatacattatgattagttataatgaaggtgaattataacaaagctatgccagcattttgatagttgaagactaattataataaggctgtgtcagaattttcatagttgactgtaaaaaagtctattcttagttgatgtaaattgtgatttctatgtgtctgttcctggctgtaatagaagcaaaatatgcagcagaattagaaagctgaggctggacacaggtggctcctgcctgtaatcccagcactttgggaggctgaggtgggaggattgcttgagtgcaggagtttgagaccagtcagggcaacgtggcaaaactctgtctctacaaaaaataaaaaatttggccaggcgtggcagtacacacctgtagtactaggtactccgggggctgaggtgggaggattgggtgagcctgggaagtcgatgctgcagtgagccatgattgcaccactgcactccagcctgaacgacagagtgagacctctctctcaaaaaaaagctgaggttgttttcaccaaaacacattccttgattgtcctgtctctgctttttaggctcactgtacaagaaaaacagatgttggcatctagagcaggattggccctaacactattacaaccacttgctgaagaaatggcctcttctgagctctagtccctcgcattggtgaaatagcagcatttcctctgcatcgcttcaaggcagagttcagtcagtctcccttggttgtgggatgctcacatgttgttggcaaataggctttgcctagagctcctcaccgaggccccctgcacagccactaccctcttctgaggtgacccaggcgcaccgcacgccagggttcctgctcactggacacaggggctcccctttggctgacctgcctgtagccaagcagccctgcctacgtcgtgcccccagggacctgtcgggcagcccctgtcagccacatgtggtgctgggaagcagagcttgcatctcactcagaggcattcctcctgagctgtgcggagcgcgtgactgcttatggagtttaacacaccttcttcacctgcccttacgcaccatcaactcctgcttgtcacataattaaccttctaaatgttagcaattcgtatcatgttttaaaattgtagttggaacaaaagtaaccgactggctgggcgtggtggctcacacctgtaatcccagcactttggcaagccgagatgggcttgaggtgaggagtttgagaccggcctggccaacatggggaaactccgtcgctactaaaaatacaaaaattagccaggcatggtggtgggtgcctgtgattccagctacttgggagtctgaggcaagagaatcacttgaacctgggaggcagagattgctgtgagctgagatcgcacctctgtactccagcctgggcaacagagtgagagtccatctcaaaaacaaaaacaaacaaacaaacaaaatacccatcctaaggtgtaaatgactggggtgtgctttcctagatgcaagaagcatgatgattatggtggaccagccaggtctcctttcctacctgtcatcttggtcactgtatctcagggcctagtgaagccccctgaggtctggggcaggcagtgggcagggggaggctggatgggagagcacttttccttatttaccattcaaggaacacacttcaaatccaggtacaggagtctgtacactaactcagagtcatttgtctttcccacgtttttatttgctgctaagatgttgtttttatatttaaatgatgacggctgtaaatatgaccttacacttccggttgtcttgtaaagccttaagggtgtaatgtgcattgggctttgggaactcggtgggcgaccctagcactgcatttgggaacacggtgggcgaccctagcactgcatttggtaacacagtgggctaccctagcactgcatttgggaacacagtgggctaccctagcactgcatttgggaacatggtgggctgccctagcactgcatttgggaacacggtgggcgaccctagcactgcatttgggaacatggtgggccaccctagcactgcatttgggaacacggtgggctaccctagcactgcatttgggaacacggtgggctaccctagcattgcgtttgggaacacggtgggcgaccctagcactgtgtttgggaacacggtgggcgaccctagcactgcatttgggaacacggtgggctaccctagcactgcatttgggaacacagtgggctaccctagcactccatttgggaacacagtgggctaccctagcactgcatttgggaacatggtgggctgccctagcactgcatttgggaacacggtgggcgaccctagcactgcatttgggaacacggtgggctgccctagcactgcatttgggaacatggtgggctaccctagcattgcgtttgggaacacggtgggcgaccctagcattgcgtttggcaacacggtgggcgaccctagcattgcatttgggaacacaatgactgtcctgttatatgtgtgagtcagctcccagggtccctggtgtgtttcttattgtagacttttaactatcataattaaagacatagtaaagaagtaaaaattatttaaaatataaattttaattagttaaatgcctttgaataacttttggagtgtgggattgagtttgatgagaaaaacccagaaaggcatttatttcagtgattatgagagcgtattttctgtatgttaagttttatcactttgagaattatccactacaattaaagtgaaagttcagtaagtagttctcagtattgtctaggttgtatttttaaagtctgcaaatatttgccaggatgtcccatgccttttttgtagaacaggggtccccaactcccaggttgtggactggtacctgtccatggtctgttagcatccaggccgcacagcaggggtgagcgtgggccagagagcattactgcctgagctccacctcctgtcagatgaactggggcattacattctcaaaggagcatgaatcctattgtgaactacacatgtgagggatctaggttgtgtgatccttatgagaatctagctaatgcctgatgatctgatgtggaaaagtttcatcccgaaaccatctccccaacatcccctacctcaaatccgtggaaaaattttcttccatgaaaccagtcttcctggttccaaaaagggtggggactgctggtgtagtgcacaagggtcacccaggagccttgtgagcgggcaggtggttctccaagcaggttcttgaggaagggctgtagagtgaagctttggtggcagtgatgaccctgggatgcgctgtggcccatttcggggcctgctgtcctcaccagctggcagctcaggctccctggcttcacaccagtggggtcactttctcatttaggatgctgcttttggacaaaagtcctgtgggtcctcagcgcctcaggacaaactccatcagctgcccctctggctcctgcctggcccctgctacgccacgtggacttgggctctgctggctgagctgccagtacctcgtttgccacgccctctccctcccacccactgcacaggtggctcctgtgcctggcatccaggatgtgcctgcagccacacaccctgccattagcgcttccctgctgcccccctcagcccttccactctggcctgcggacatgggagcaggaggctttgtgagcagcacgagccgggtgggtcttctggagcctgtgtctatccagatacattagtgtttctgttaagctttggtgggttaagttcattctgtatattcttttctgtactttaaaaaaaattatcaaatacaaaatttttaaaccaaattgattaattagcatgcattgtccaacaagtaatttaaaaatatccaatagaaattgtgtagctttatttgaatcttttttctattagctggcaaacttagacttgtgctgatttaatactctgaaaacttgcaaaaaccagatgaaaactttcttagctttttgaatggtatttttctaaacataatgaatccttggtagcaataaaaccaccattttattgtcaagagattaatgaacctacaagaaaatggctgtaaatatgtaaattaaatttgacctgaaaattagaaggtggtcaagagaaattaaccggtgtctaatgatgattgttcagttaagagttattcactaggggataaatgtcgaatgatttaatattacttccttaaaatgacatgtgctccttgaatttaatgaggaaacggactaatagcacggggaagagatccaatgtgaagaaatcaagttgttcagcattataccaccctgaacactgcactctgtgcatggaaaaataagaatctccctaaatggactgaaggaaacagtaatataaacatagaaattactgtacatatttaaaagataggaaagtcatgtaaacttattatgtattattttttgtttctttgtaaaatccatgaaagaagatgttcctaaaaacagagaaaggtggtcttactttacttaaatagtattctattttataatttttttaattttttatttttttattattttttttgagacggagtctcgctctgtcgcccaggctggagtgcagtggcacgatctccgctcagtgcaagctccgcttcccgggttcacagcattctcctgcctcagcctcctgagtagctgggaccacaggcgcccgccaccatgcccggctaccttttttgttattttttagtagagacggggtttcaccatgtcagccaggatggtcttgatctcctgacctcgtgatccgcccgnnnnnnnnnnnnnnnnnnnncgcccgccactacgcccggctaattttttgtatttttttttttagtagagacggggtttcaccgtgttagccaggatggtgtcgatctcctgacctcgtgttccgcccgcctcggcctcccaaagtgctgggattacaggcgtgagccaccacgcccagcctagtattcttaaataatgggcaaatttggctgggtgcagtggctcacgcctgtaaaacctaggactttgggaggccgaggcgggcggatcacgaggtcaggagatccagaccatcctggctgacacggtgaaaccccgtctctactaaaaatacaaaaaattagccaggcgtggtggcgggcacctgtggtcccagctacttgggaggctgaggcaggagaatggcgtgaacccgggaagtggaggttgtagtaagccgagatcgtgccactgcactccagcctgggcgacagagtgagactccgtctcaaaaaaaaaaaaaaaaaaaagaagagcaaatttgagttcataatagcaaaaaatttggaatatatatgtttttataagtccataattctaatttaaaacttgaaaagggcccaattttggaagaatattgtgggagtaagtgataattttaattcagagaaaattggctaattttgaaatgtaattctgatttatttgttccaaactttagactcttcaggggtgaggaggagcaggccggtggtagttgtgtgtcctgcttgcccactgaagtctgacagttttatcaggaggtgtaaacgtgcatgcagaaaatctattcaagaaagcaaaatgatttttagttcttattctgaatacaagaagaagcaatttacttattcatgaagggaattctcttttatactaattcttgtcataaaaaaacaaacttattattacagataattggtcaggtgcaaaacatttaaaactttgtatttaggtatataaatgtggctttttaagtctaaatttgactgtggagtgacccagaaattggcaaatcttattacagactcctgatgggaaaagaagccaattctgaagtaacaagttagttgtaagtttaacactgagagtcatctggcccatgctgtttaaagctttcttaattttgtgcctttcttagccttgatcttctacaagtcgttcatatttactcttgtacttgtaaatatcttgacatttttattgaggcacaatgttttgttttaagtttattaagagttgtgtataggccggtaaaattatgaactgctaagaaaaatatttctaatgaaattgtacatgtgagcagtaagtgaggttgatttatgggtacttgacaatggtatagtgaagtttgttattgcatagaatgcctttcatcagtatccagcccttgctcatattttacagcatttcccagattcagtcgaacattgacattcctgggtctcagcaggcccaagttaattcagtagtcatgggtggggctggcgtctgtgctgttcattacccaccttccctgtgactctgacgcagctgccccagctgccagggccaacagctgttgcgccattcctctctgctggggcttggtgcttgctgttacattctcatgttgcaaaattcatgtgctccagggaaatgcaaattcctgtaatctttacctcagtgtaaaccaaatatagtaaagaaaccaactgcaaataataatacaaaccaaaagtaaataacctttagattatattgttttagctgatttgtgtatcacttccataagtatagctaatcgttgagtatagcttttattggacactgatttttaaatcagggtatttgcattaagaatacttaaggttggctgggggtgtggtggctcatgcctgtaatcgcaggccgaggcgggtggatcacctgaggtcaggagatcgagaccagcttggccaacacggtgaaaccccgtctctcctaaaattacaacaaattagctgggtgtggtggcatgtgcctgtaatcccagctacttgggagtctgaggcaggagaatcgcttgaactcaggaggtggaggttgcagtgagctgagattgtgccattgcactgtagcctgggtaacagagcacgactctgtctcaaaaaaaaagaatacttaattaaggtttgcaattgaaacacaaatgataagctaataaattacattgtattcaagtttttttaatttaagtttttattttgagataattgtagactcatgggcaatttttaaaaaatagtacagagagattccacatacacttacccagttttgcccaacaggagcatgttgcagaactgtagtataatatcacaaacagttgttatcattgataagccaagatacagaatatttccatcatctcaaggacccctcatgttgctttttataatgacttcaagaccctcttaaccctgacatctgccactctgttctttatttctgtaattttgctatttcaaaacaacaagaagttgtaatttttcccttgatatacctatacaagctaagactctcaaatatcttacctttagtttgggaatatattaatttattgagccaattggttcttatgtgcatcagaatttctgaccagcagtttttttggtctttgattaataaaacaaatgtgaattaataagtccaggttgattaatacagtttttcaaattgggtagtctgataagggtggtggcagcagctgtcaacagacatgtcacaaaaaagtatagcattcaccggtatttgaaaatagcaatattcaatcaacttctctatgtagggaggtagggaacatgaagctttgttagtataggtaggaacttcaggtgcagtggctcacacctgtaatcccaccactttgggaggccaaggttggtggatctcctgaggtcaggagttccagactagcctggcgaacatagtgaaacccccatctctactgagaatacaaaaattagccacacgtggcgcatgcctgtaatcccagctacttgggaggctgaggcacaagaatcacttgaacccgggaggcagaggttgcagtgagctgagattaagccactgcactccagcctgggtgacagcgcaagactttatctccaaaaaaagaaaaagaacttttcaatttagatcatgtttatgtaaaaaattaggctgatatatggagatacctaaaatagcctaattttgcttttttaaaaagctgcatatgggaagtaaggaacccaaatcaagttagaagctctctttctctggaatccctgatgatgactgtatgtttttggcttctattttgccacctgccactctttcccttaagaagtgaacctaaaattctctgatggaggaagtttttaaaaatgccatctcagtcctatttttcctccactgtgtctgatatagtttggccgtgtccccacccagatctcatcttgaattcccatgtgttgtgggagaaacctggtgggaggtaattcattcatgggggcaagtctttcccttgctgttctcatgatagtgaataagtctcatgagatctgatggttataaaaaggggagtttccctgcacaagctctcctctctttgctgccatccatgtaagatgtgatttgctccttcatgccttccaccatgatcatgaggcttccccagccacatggaactgtcagtccaattaaacctctttcttttgtaaattgcccagtcaagggcatgtctttatcagcagcgtgaaaacggactaatatagcatcccctcctcaattcttaatttccttttgggggctcagcttgtgtagttccctaaaacattgagaaacacccctcaccttaaagcacaggagccaagaacatcagccatgcttcctgtggtcagccacggttttaactgtgtgtaaaatatgtttagaatcagtgctgattacagcagttcaagttgcatgctgaattatttctataaatttgcagtagatattcagaccttttaagctgcagcttcctctctgctcttgtgccccataccaccctacctttctcattctctcgtattctctcagatctgctctcatagctagaggtgtgctgggctggtaagaagacttacagtagttttctatagcatagcaaaattgtatatgtgtttctaagcaaataagtgttttttaaatatacacacatgtagagactctgagatgtaatttatataagttcacctaattatttaaagtatacaattgaatggttttcagtgtatttacagagttgtacaaccatcaccatggtctaattttagaacgtttcatcaccccttaaagaaacgtggagccatgagccatcactccatgttcccccgacccccggcccaccctcaccgctgcccctggcaactgccagtccactttctgtctccgtagatgcatccgttctgggtatttcatagaaatgtgatcatccgtgtggtcttttgtgactggcttttttcattccttagagtatttccaaggctcctccatgctgtagcatgtaccagaactttgtaccttcttattactgaacaatattcccttataccacattttcatttgtgcatttatcggttgatgggcatttgggctgtttccattttttggctatgggtaattctcctgtggacatttctgtacaaggcttctgttttcacttctcttgggttgctgggttacatggtgactccacggttcactttttgaggagctaccagcttgttttccaaggtagctgcaccataaaagatcttttaaattattgcttgttttgctaaagttacaacttctgaaatagtactaatcttttgccagggtcagcagttcccagcgctcctcacggatccctctctctcgggccagggtggagcaggctcgccgcaagtcatactagtgagccacacgccacagtcagcgtctgctgcttgtgaagaaatagcctaccaggtacaggatattccttcattcacagagcttttgtcgcttttaaaaacatacagattcagaagggatggtggtagagggttatgggcgtgctgtgtgacccaggtggctggggctgacttctgaggtgtccccggctgaatcctgagtggacataggccctgcgggggcgtgtgttgaatgacaggtacgatatctcattcgttttgtgatttgtttcctagggagtgaggttttaataccacagaattagatgtagccacagtgatacgtaaatctaattttaaatttattaatatcttattatatttgcctgctgatcagacttcacatatccagccacttgcacttagttcttctgcagattttctagtaacacctttgcagattctgttaagtgtcatacacattttcatatacgtgtgtgtgcgcgcgcgtgtgttcaagatctgtcatttggctagtcttttttcttaaaatacatgtttttgggagccaaaatatttagtaagcaatagtctaaatatggaagagtctaaaatctctttccttaaaagtttccagggtcagaattaaagcacagatgatgaataatctctgaatttaggaagcattaaacatttttagcaaatgagttttcaaaataatgacttaccggtttttctgtagaacaagggctttttcacaaagagatgagatataacgagcactggggatgtcctgcagtttgacctgagtaaccagagctgtctcactgaatttcagtttgtataactttagcacatttgtgtctggggtccccaagactgccttcaggtttgacgattcactacaaggtctcactggattcagaaaaatctgatctactggtggttgtggtttatacttgtggttacaatggaagggtgcaggtgagaaccagcggaaggaaaaggcacgtggggtggagtccagagaacccaggcacgagcttcccagtgtctgctccagtgaggtcacacggacactgctgattctcccaggaaagttgtgtgacaccgcctgccaagtgtcgcccacttgggaagctcagctaagctctggtatccagaattgttttacaatcagtcatgtggccatggaatgcccgcgtggttgggcttagctatgcggtctccaggcccctgcccctccaggtcaaacggatgcagtggtccaggtccccagatgaaacaaaaacaggccttcaccataagtcacatcatcagcacaaactatgtggcattgcccaaggttctgggtatgaaatacactcttacctactaatagcaggatgttccaggggcttatgggtgatgctcgggagctgatcaggggcactgtggagtgtgcagggtttgagcacctcaggcctggtgaggtaactgttgaccacacacattcattgagacagaaaaagcattggcagcttggtcatatttttaagctctctttctcatgatgcttttgtagtgaaaccttattagtctggtatgtttcagagttcctaaatcagttccaaggcacaccttacctaattcctatattttatgtgactagtaaatgaaactactttgctattttttaacattatgattttagcatttggtttaatataggtagaagaataatgtttgtagagtaatcctatgttaagattagtttgaaatgtctccactgaagtgatatattccgttttaacttccatattccattagatggaaatgagagaaaccaaatattaaaacttggtctagcttgtaatttttttcaaaatttgacagattaaatataaaaatgaggtagataaccaatctgtatgagtgaatacaggcatacctcagagataacatgcattcagttctagagcactgcaataaagcgattatcacaacaaagtcatacattaacattatgatttagttttctggtttcccagggcatatgatgtttatactatactgtaataatagtgttcagcagcattatttctctttttttttttttttgagacagagtcttgctctgttgcccaggctagagtgccagtggtgcaatctcagctcactgcaacctccgcctcctgggttcaagtgattctcctgcctcagcctcccaagtagctggaatcacaggtgtgcaccaccacacctggctaatttttgtatttttagtagagatgggattttgccatgttgccaggctggtctcaaactcctgagctcaagtgatcgcccacctcagcctcccacagtgctgggattacaggcatgagccactgtgcctgaccagcattacgtttttttttaaatgtacataccttaatttaaaaataccttattgctaaaaatgctaacgatcacctgagccttcagtgagttgtaatctttttgctggttgagggtcttgccttgatgttgatggctgctgactgatcaaggtggtggttgttgaagtttggggtggccgtgacgatttcttaaaataagacaacagtgaagtttgctgcgttgattcttcctttcatgaaagatttccccatagcatgcaatgatgtttgatagcattttacgcaaagtagaacctctttcaaaattggagtccatctctcaaagcccactgctgctttactaagtttctgtaatcttttaaatcttttgttgtaatttcaacaatgttcaccgcatcatcaccaggagtagattccgtctcaagtaactgctttctttgctcatccataagaagcaactccttgtctgctcaagttatatatacctttagatccctatctgctcagttatatataccatgagatccttatctgctcagttatatataccatgagatccttatctgctgagttatatataccatgagattgcagcaattcagtcatcttcaggctccatttctaattctgttgcccattcctccacatctgtagttacttcttctgctgaagtcttgaacctctcaaagtcatccatgagggctggaatcaacttcttccaaactcctgttaatgttgatattttgacttcctcccatgaatcacaaatgttcttaatggcatatagagtggtgaatcctttccacagattttcactttactttgcccagatccatcataggaatcactatctatgtcggctacagccttatgagatgtatttcttagtaagacttgaaagttgaaattactccttcatccatgggctacagtgtggatgtcatgttagcagacatgaaagcaacattcatctctttgtacatctccatcacagctcttgggtgaccaggtgcattgtcaatgagcaggaatattttgaaaggaatcattttttctgaccagtaggtctcagcagtgggcttaaaatattcagtaaatcatgctgtaaacagacgtgctgtcattcaggctttattgtttcatttgtagagcacagaaagaatggatttagcatcattcttaagggccttaggatttttggaatggtaaatgagcattggcttcaacttaaagtcactagctgcactagcccctcacaagagagtcagcctgtcctttgaagccagacactgacttttctgtagctatgaaagtcctagagccatcttcttccactataaagctgttctgtttacactgaaaatctgttgtttaatggagtgaccttcatcgatgctcttggctagatgttctggagaacttgctgcagcttctccagcaacacttgctgcttcaccttgcactgctatgttatggagggtggcttctttccttagttctcatggattgacctctgctagtttccagcttttcttctgcagctccctcacctctcggccttcataacatggaagagagttagagtcttgctctggattaggctttggcttaagcgaggattgtggctgttttgatctgtctaggccattaaaactttctgcttatcagcaacagtgcagtttcactttcttatcattcatgggctcactggataacacttttaatttccttcaagaacctttccttcatttcacaagttggctaatagtttgacacaagaggctgagctttcagcctgtctcagctctctgcgtgccttcctcattaagcttaatcatttctaggttttgaagtgagggatgtgtgactcttcgtttcacttgaacacttacaggcattgtgggatcattaattggcctcattttagtattgttgtgtctcagagaatagggaggcccaaggagaggtgggatggccagttggtgaagcagtcagacacaaacatttataggttaagtttgccattttatgtgggtggggtttgtggtgcctcaacacaattacaatagtaacatcaaagatcgctaatcacagatcactgtaatagatacgctgtaatgaaaaagtttgaaatattgcgagaattaccaaaatgtgacacacacacgaactgagcatgtgccgttggaaaaatggcaccagtagacttgctcgaagcagcctcgccacaaactttcaatttgtaaaaacgacaggatatctatggaggacaaaaaaagcaaagttcaatgaaaacaaggtatgcctataattagtaagagaaattctcttagatgttttctgtaaatttcccttgttaggttgtagcactgtttgccaacattaattggttttaatcatggtctaatttcatcctaatgctttcttgtcacagatggaatgcacattgacgcttccaggctctgacctgggctctgaccagggacttgagacacatgcctgggtctgcctctggcctgtgcttctgggaggaagctgggaccatttgaagcaccctgggtttatctgaacccacgacagagtggctgggagtgctggctgtagcctctggtgatgtctgtgcatccctgctcccatgctttctggccaggagccctcaggcaatcctacatctgtgtgatggcctgtttttaagacagaggtggccaggcacagtagctcacacctgtaatcccagcattttgggaggctgaggcaggaggactgcttgagcccaggagttcgagactgctgtgagctatgatcaccactgtactccaacctgggtaacagagcaagttggtgtttcaaagaaaacaaaaaaacaaaacaaaacccaaacccccaaacaggggtgtagttaggactacctcatagtggtcagagattgggcatgtaatgttccctggcacagagcacaggtcctggtccaaagtaagcactcaggtaaggaccctgctggtggcgttggagcagctactacggcctggggctcacttcgctctctggtgaagtccctagagcaacagcctttgctttttaaaaatccttttcttcatggttcatctgaagagaaatccatactgatctgacaagatgtgtactcacaatggaaaaacgtctttatcctaagagagccattgacagactgcccccttactcagcctgtctttactaaaacgaatgaactaatttctgcctgacccttcccataaggatcaagagacctgacctaactttgttagcaacttcaagctattaaatcagaggggagccgctgcagcaaactgcctttcttccttcactcactgcttaaggggccatggccttcttttgaaactggttttgcaggagaaaagagccgacacttgctggccaggtgcctaaggccaggctcccactaggcatgtggtcttatgtagccgagcccttcccacagcctgtgaggtgtctaagtgtcacggccccgttttactcacaaggattctatcatttaagggtagctttgaataacttaaagtcaccctgccaatagagacagagctggcatttgaatccagatctgtcttatctcactcttcatgtctgaatagaagaatatcgttctgagcatttacacctggatttcctgttacttgagatcagctggtctcagctgggaactttttagtaaggggcaggtttttagagggaggtttggggtcagaagggtgatcatgtgcccaggtgtgtgttgtgggcagcatttctttgaaatattgaccttgtttcagttcagcaaacatttaagttcctgccagtgccggccgctggacgcagaggatgttggatccgcgcccgttctttccgggctcattaggaggtggatggagaggccgctttcctccttctgctttccaacagccacactcctcatgcttgggagggggtggacatacacgctcctaccctcccacccccatgcagaataacctgctgtgggaagcacattatttctagctgtggccaagtttatgcctcaggcttaaaaatcatctcacactcattctgtaaccgatttccccttctcctttgggcaagtatgattttagcaagattctattaatataattcagtctctagatatgtagttatgaaattcagcagaacattggagatttgtttcacagtagtagcaataattcagaagctttgcttctgatgcgattatgctgaaaaatattttacagaaatagtttttaaagtttcgtgtgtttgtttgtctttccttgaatgatgtggaccagatattgaattctcacatctcatgagtaaaatgtttggttcagaaacaattttctgtgtgttcattgccatgactactggtagatgcttcgtaatactgatggaggacattaggtcgctccataactacaggtttttgtttgagttgatgttcttcagcatgcatttatctgcagttacacaaccagcctttagtgtcatttattcctgtgcttttcagacttttttgactcacatggaatatattttatgcagtgacctcaacaggcatgtgtttctgtcatttttctttacactcacagatattcacatgtagacacacacctgacacaggtgtcattttctagaataacacctatagatactcacctgtagacacacacccgacacaggtgtcctattgtagaataacacctgcagatactcacgtgtaaactcacacacctgacacaggtatcatattatagaataacacctacagatatgtgtagacagacacctgacacacaggtgtcatattctagaatgacaccagtccctgcacatctcacgaggctgcaatgtcttttctgatcttttcctttgttcctttttttccccattccattttttaaattatagcacagattaataatatagcaccctgtataaatcttttttgttgtttaagtatttttctttaatgtttacttatttcttatattccagaattaatgaaaaagtatttgataaattaggaataataaaaatgtggacagatctcattaattttcattataattgttttgttaagccatcacatagaaatttgcaaaactggaatctgttgtttataaaagctgagtcagccaggtacagtgtctcacactgtaatcccagcacttgggagactgaggcaggaggatcctttgagttcaggagttctaagaccaacctaggcaacatagggagaccctgtctctacaaaaaataaaaaagttagctgggcatgatggtgaggtggtgcgtacctgtggacgcaggcgtgcgggagggctggggtgggaggattgcttgagcccaggagtttgaggctgtcctgagctgcgattgtgccactgaactccagcctgggcaagagagcaagacttcatctcaaaaaattttttcaaaaattttaaaaatgattttttcaagtggtggtggcatcccattaagatgatttgaaaaccgaattggttgtgatccacggtttggaaaaaatggtttaattccattaaaagctagaaacactttttgttgttacgaattgtttatctaaagctactaccagtagcgagcatttagtgaaagcttgccgtatgcagcccttggtaggcaggtgttctcccatgaggacgcgaccacggactggttaagtacttagcccagagtagcccggatagtcacattggagctggaatttgcacctggtcagtgcggcgccagagctcattccttagctgctgttgtgtggtctcaatcttgcaggacacagtgtgcattctggtctcatattgtgtggaaggcgcctctggctaaattatcctgatgataggacatgcagtgtgggcttggcgtgtccgtgctaggaatgtccctcttatcaccacggtgtgtgtcagttcacaaactgcacaaatcaagccaagtgagtggaaagtcacaatttctggctctttccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggtaggcccactgtgccagggcacagctgtgtgccccccaggcggctagagatgcggagtccaagatttaacactggccgggaatctggcatgtgtttttgaggaaaaggccggtttttgaggaaaaggtcactagatgtagatgtattgttccggttgtaagaggtctgcttgctgtacagatgaattgcatgttcacctgcaactcacaatcaatttgcaagacaaactgaaataacattgaaatgccctctctcccttgtcagactggcaaaaatgtaaaagtctgtcagcacctgttgttgaggctgtggggaaacagaggctcgctcacgtaattgctagtgagactgtgacttggttggactttctgtaggggcattgggcagccctaacaaatgcatgtgtgctcaccctggggaccagccctgaagatgcccctccagcctcccaaggtttagctgcccacgctttccactgcagcagagccatcattgcacagtggagacctgagtgcccgcatgtgggaagcagaggatgagttctgggacatccccacagagggtgctgtgctacagtgggcaggaggcagaattccagcagggtgctctgatatccagcccagggcgccgtcttccgtgtgaagggaatggggtgtggaaggggtggaacacagaggagcgtgcagcacggatgcctagccagcaccactccagcccagcggccgtgggcagcatcagcacccacacatcaagactgcttctgtccttggcagtgtgggatgaaagtggcacttttcccaaaaaccccgtaacatgagaaaaacagacaaattccaagtgagggatagcctgcgaaatttctgaccagccatggccaggccacgcagagggcagaggcgtgccacgctggccgggaaggaaagctgcactaagatggctggacccttggggttcctgtgtatgttgggggggtggggattgtttttggcctttgtgtgtctgttgtcttttaatgagtgtaggactagaagaagggagagtcctactcaaggaggaattcctgtcccagaaactggaatccttggatccctgtgaccaggatggcttttttggagtgtggagtagagcacatgggctttggatgtattgcaggccagtggtgtcagcagtgacggccctgtccgggccaggaagcccagggccccacctgtggtgcttgcggtggctcctctcccaggtccctccaggggctggtgagccccgagaccctcagtcctccctctctgtcctgaagggagcctgtcgcttggctgcttgggttctttttcatttttaaatttcttttactttcactttaggttcggaggtgcatgtgcagggtttgttatacaggtaaactcaggtcacaggggattgttgtacagattatttcatcaccctggtactaagctaagtagccaataatttttcctgctcctctccctcctccctcaaggaggccccagtgtgtgtgatttgctcctctctacgggtccatgtgttctcaccatttagctcccacttatcagtgagaacatgtggtatttggttttctgtttcaagatggattgaagactgaaatgtaaaacccacaactctaaaaaccctggaagacaacctagacaataccattctggacagaggaacagcaaagatgtcatgacgaagacgccaaaagcaattgcaacacaagccaaagttgataaatgggatccagttaaacttaagagcttctgcacagcaaaataaactatcagcaggattctttcttttgaaaccttctgatgaatctccctgccccagggctgcattagcgtcctctggtgcagtgagctgacggccatgttggggggctctgctgagtccccaccaacttcagggcacaacaccgccccttcttagaaattcacacctcacttgtcgcttgtagcagagccaggccgacaggtgtgttgcagtaagaacggtattaactacagctgatcgcaaacttatttgatgatgaaattctttcttgaggaacatttgccattgtctcagagagcactttctagggagaactaggtttacgtaacctctgccacagggtaagcctaactgcacccttcgaggagtgcagctcgtcggtatttcttttaaagtcatcagcatagagtggcagctgcgtgcactgttcccaccgcaggagatttctctggaggtcagagaaacagaagccaaggttataaaagctttcctttcagcccactggacagtctgttcccccgtggactctctgtcctcctttcagcttagcaaacagtgagtgcctgctgtatgcacagaaggtggtcccagaaacaggcggctccatcctcaggaagcttagcactcagtgtgaccgcagttacatccaacacagaccgggtgggaaccccagacggagtgggggaggaatgcactctagctgttgatggtgattggtgtcatcaggagtggtggtgtcactggtcaggcctcacctgcagtcctggctctgcctggtctgcagtgctgggaaggctcccccactcacctcccgagtttgtttttcccaccctgctgctttcattacacccacctcccagactgtgctgggccttgagcagtgcgacatacgcagctggaacacaggcggtcacatggaacacacacaggaaacgtgtacttttccctgactcctgccttacagggtagaggttagctctaaagactgagattctattaggataattattatgcttctgcaattttggaaaataaccacattgcacatcctcaggtgcctgcaagggcagcagctatcagatctttgagaaatttgcagtcacgtgaatgcagtatctctggcaagttgccaatcacaacaggagaagggaacagtttcctcttggctttaaaagcctctgtcgtatcaccgggagaacgcacttcagaatcatgggcattccgtgaggacttgtgggtgagagtcactgaacgggtcccagctgggtgccgcagggcctcaggccacaacctatgggtggcctcaggccacgacatatgggtggactcgtgtgtgaaacggggacaggatcccccacagccaacggagagagctcacctggactcctgcactaggctcatggcatgacgcccttggtctcggttaaagctgatgaaggagatatttctacccctatttgggacacagatgtggccaagccatatagctagcaggcagtaaagctcagatggggaccggagtctccccgagaagccccagtgttgtcactctgttgtcactaccgatgcattgaagtccttaagaacacaaatcacagattagcctttgattttgtccttgccactgacttgaactttgcagtgatttgcttcctcttgtttctagtctcgaaagctgttttgatcttgtttcttggtttctgtgtgttgtctcccaggagcacatgcagacacaccaggccggcccctctttgagctcccagaagccaagagtgtttaaatgtgacacttgtgagaaggcatttgccaaaccaagccagctggagcgccacagccgcatacatacaggtaacggggaaggacgtgcttttgtttccttactctttgaagtagacatcatgggtgagaaaacataattccacctgtgcaatattcacgagcgatggaatgctttatttataaagcaaggtccacatgttccatttctcctgagttttgacctatttatcgtcataactaacttttcacatggaagattttgctgcttacattatgaccatatgaaacagaagcatcaggcaagcctcccgtgccgtgtctgggatgttgaccatgtcacgtccctccttcccttctgctggagcaaacaggcggcccccagtgcctgggtcccatgtcctcaatgtcaccggggaacttaatttttaatcttcctcttctgtcttaaaactttttttctctgctggcttttcctacaccacctaaatctgctcaaaccttttgtcttagagaaaaaaaacacacggaacaaagaaacaagctcttccatcttctgcctcttgactgtacacgatagctcgtgtcagcccttccgtctccgccctgccctaacaggacatcatcccgggctcatttctgttgtgatcatctgacgactcactgtgggcctggggttccgcaggctgcatccaccgtggcccttccatggctctctgatccctccgccccatctgctgggggtcgttaggacctggccaggctccctctggtctccctatggctcctccagccctttgttcagatgacagccaggctgaaagcctaaaagaaaagaggaacattcagtccctcttgttcatacctcagggtagagcccaggcatccactatacttttcttagagacattgacatatgccattttctgtacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggtgagaatgctgcacccgggagtgcgtgctgttcggtggcctgcgaggcaccctgtgtttcgcatacattgtttcctttagttcacacagtgattttgcattgcacgtggtacagcctcagttgtgtggactggaagcttgtgctttattttattttttgatttccataggttattggggaacagatagtgtttggttacatgagtaagttctgtagtggtgatttgtgagattttcgtgcacccatcacctgagcagtgtacactgcaccctatttatagtcttttatccctcacccccttcccattctttccccccgagtccccaaagtccattgtgtcattcttatgcctttgtatcctcatagcttagctcccacttatgagtgagaacatgcgatgtttggttttccattcctgtgttacttcacttagaataatggccttcaatttcatccaggtggttgcagatgctattaattcattcctttttatggctgagtagtattccattgtgtgtgtgtgtgtgtgtgtgtgtgtgtgtgtgtatttatgtatataaataccacagtttctttatccactcgtcgatttatggacatttggtttggttccctgtttttgcagttgcgaattgtgctgccataaacatgcgtgtgcaagtgtctttttcatacaatgaaaaagattctacttattttcctctgggtagagatacccagtagtgggactgctggatcaaatggtagttctatttttagttctttaaggaatctctacactgttttccatagtggctgtactagtttacattcccactagcagtgtggaagtattccctgttcaccacatccatgctagcatgtactattttttttttattttttgattatggccattcttgcgtgagtaaaatggtatcacattgtggttttgatttgcattttcctgatcattagtgatgttgagcattttttcatacgtttgctggccatttatatatcttcttttgagaattgtctgttcatgtccttagctcactttttgatgggattgtttgttttttttcttactgattagtttgaattcgttgtagattctggatattagtccttttcagatgtatagatagtgaagattttctcccactctgtgggttgtctgtttagtctgctgactgttccttttgccattaaaaagctctttagtgtaatgaagtcccagctatttatctttgtttttattgcattcacttttgtgctcttggtcctcgccgaagccaatgtctagaagggtttttccaattttatcttctagaatttttatagtttcaggtcttagtttttttaatccatcttgagttgatttttgtatgagatgagatatgaagatccagtttcattctcctaacgtgtggctagccaattatcccagcactgtttgttgaaaagggtgtcctttccccattttatgtttttgttttccttattgaggatcagttggctataagtatttgggtttatttctgggttctctattcagttccattggtctgtatgcctatttttataccagtaccatgctgttttggtgactatgaccttatagtatagtttgaaatcaggtaatgtgatgcctccagatttgttctttttgcttagtcttactttggctatgtgagctcttttttgattccatatcaattttagaattgttttttctaattctgtgaagaatgatgttggtattttgatgggaattgcgatgaatttgtagattgcttttggcagtatggccattttcacaatattgattctacccaaccatgagcatgggatgtgtttccatttgtttgggtcatctgtgatttctttcagcagtgttttgtagttttccttgtggaggtcttttacctccttggttaggtgtattcctaagtttttttttgtttgtttgtttttgttttgttttttccagctattgtaaaaggggttgactccttgatttgattctcagcttggttgctgttggtgtatagaagagctactgatttctttacatcaattttttatctggaaactgctgaattctttcatcagttctaggagctttctggaagagtcttttgggttttctaggtaaacaatcatatcatcagcaaacagtgatagtttgacttcctctttactgatttggatgctcttgattttcttctcttttctgattgctctggctaggactgccactgctatgttgaagaggagtagtgagagtgggcatctttgtcttgtttcagttctcagagggaaagcttttaacttttcatcattcgatattatgttggctgtgggtttgtcatagatggcttttattattgaggtatgtcccttgtatgccgattttcctgggagttttaatcataaagtgatgctggattttgtctgatgttttttctgcatctgtagaaatgatcatgtggtttttgtttttaattctgtttatgtggtgtatcacatttatcgacttgcatatgttaaaccattcctgcatccctggtatgaaacccacttgatcatatggtggagtatctttttgatatgtgctggattcggttagctagtattttgttaaggattttagcatctatgttcatcagggataatggtctgtagttttgtttttggttatgtcctgtcttggttttggttttgggtgatactggctccatagaatgatttagggagggttctctttttctctgtcttgtggaatagtgtcaaaaggattggtaccaattctcctttgaatgcctggtagaattctgctgtgaatccatctggttgtggactttgttttgttggtaatttttaaattactatttcaatcttgctgcttgttattggtctgatcagggtatctaattcttcctgatttaagctaggagggttgtatctttccaggaatttatccatctttctaggttttctagtttatatgtgtaaaggtgttcatagtagccttgaatgatcttttatatttctgtggtgtcagttgtgatagctcccatttcgcttcttattgagcttatttggatttcctctcttcttggttaatcttgctagtagtctatcaattttatttatgttttcagagaaccagctttttgtttcagttatcttttgtttgtttgtttcaatttcatttagttctgctctaatcttggttatttcctttcttctgctgagtttggttttggtttgttcttgtttctctagttccttgaggtgtgaccttagattgtctgtgtgtgctctttcaggcttgatgtagacatttagggctacgaactttcctcctagcactgcctttgctgtatcccagaggttatgataggttatgtcactattgttgttcagttcgaataattttttaatttctatcttgatttcatttttcacccaatgatcattcaggagcaggttattgaattttcatgtatttgcatggttttgaaggttccttttggaatttatttgcagttttattccactgtggtctgagagagagcttgatataatttcaattttcttaaatttattgaggctcattttgtgacctatcatatggtctgtcttggagaaagttccatctgctgttaaatataatgtatattctgcagttgttggatggaatgttaggtatatatctattaagtccttttgttccaaggtatagtttaaatccattttttcttttttgactttctgtcttgatgacctgtctagtgctgtcagtggagtattgaagtctcccactattattatgttgctgtctatctcattttttagatctattagtaattgttttataaatttgggagctccagtgttaggtgcatgtatgtttaggattgtggtattttcctgttggacaacgccttttatcattatataatgcccctctgtcttttttagctgctgttgctgatgacaatgcgactaagcaatgatatttttgcagtgaatttcccaggtgttctttgtgcttcttgtatttggatgtctaggtctctagcaaggccagggaagttttcctcgattattcccccagatatgttttccaaacttttagatttctcttcttcctcaggaatgccgattattcttaggtttggtcgtttaacataatccccagacttcttggaggctttgttcatattttcttattcttttttctttgcctttgttagattgggttaattcgaagaccttgtcttcgagctctgaatttctttcttgtacttgttctattctattgctgagacttttcagagcattttgcatttctataagtatgtctattgtttcctgaagttttccttgttttttatttatgctatcaatttcattgaatatttctcccttcacttcttatatcatttttttgatttccttacctttggctacacctttctctggtaccttcctgattagcttaataactaacttcctgaattctttttcaggtaaatcagggacttcttctgggtttggatccattgctggtgagcttgtgtgatttttgggagctgttaaagagccttgttttgtcatattaccagagttggtttttctggttccttttcatttgagtaggctctgtcagagggaaggtctagggccgaaggctgttgttcagattctttggtcctacggggttctcttgatatagtactccccgccttttcctatggctgtggctccctgagaacagagctatagtgattgttacctttattcttggtctagccgcccagcaagtccacctggctccgggctggtactaggggttgtctgcacagagtcctgtgatgtgaaccattcatggtctctcagccatgggtaccggtgcctgttccggtggagatggcaggggggtgaaatggactctgtgaaggttcttagctttggtggtttaatgctctatttttgtgctggttggcctcctgccgggaggtggtgctttccagagagcatcagctgtggtagtatagggaggaacaggtggtgggcggggccctagacctcccaagagtatatgccctttgtcttccgcttccagggtgggtagagaaggagcattgggtgggggctgggctaggcgtgtctgagctcagactctccttgggcgggtcttgctgtggctgagtatttggggtgtctcctgggtcctgcaggagcaatccacttccttcagagagtctgtgggtcctctcaggtttcctgatttattcccctagttgtttgggagcaaaaattcacaatgtgagcctcctcatgctgctctgtccctttgagtcggaggtgcagtctagtcctgcctcccatccgccatgatctctggaagcctgtgcttttgttactttaatagttagtgtttgcagttgttgaagttggctatggactgccccccttcacacacacacacacacacacacagagacacacacacagaatttgattagattaaatttatattttggcaagggcacagaaatttattggagtaaaatggcagcccagaacctgagcaagcgcagcatttctgagcagctcgtttctcactggacagagctttctgtaggggccttcagcacctggccagtcagaggcccagaatagcatctctgtctgtcttcacatcatgtctggaagccccttttcctgcagcatgcagttcaggtgctgtctcggtgctcaggggcacagagcaaacagaatctgcaccaactgctcctgtctgcatcctgttgacctggcacagacaacacgtgggccttggtttctctcttgattcgctaacgttcatgcccttcagagtatggatattggggtgtgatcctactgcttgtctgtcccttgttcacctttgtttcctacacagaatctagcagtggcatccatctctgaggaaggaatgataatagatggcctagactaggtttcagagggtggcagtagctatgcaaggaactagaaatgttaaagtctgagtagaccccttggtgtgctccatgcattttgcgggtgtgatttgattgttcgaggtggtatgctctgtgagatctgtggtttgtttggttgttggaggtgatgtgattcgtgaaatgtgttatttggttgttggaggtgatgtgattcgtgagatgtgttatttggttgttggaggtgatgtgattcgtgagatgtgttatttggttgttggaggtgatgtgattcgtgggatgtgttatttggttgttggaggtggtgtgatctgtgacatttgtgatttgttgttggaggtggtgtgatctgtgagactttgtgactttggttgttggaggtggtgtgatctgtgacatttgtgatttgttgttggaggtggtgtgatctgtgagatttctgatttggttgttggaggtggtgtgatctgtaagatttctgatttggttgttggaggtggtgtgctctgagttatgtgacttggttgttgaaagtggtgtgatctgtgacatttgtgatttggttgttggaggtggtgtgatctgtgagatttgtgatttagttgttggaggtgatgtgatctgtgaggtttgtgatttgttgttggaggtggtgtgctctgagttatgtgattttgtggttggaggtggtgtgctctgtgagatttgtgatttggtgttggaggtggtggtgtgatctgtgagatttgtgatctggtgttacggttggtgatgtgatctgtgagatttgtgatttgttgttggaggtggtgtgattcatgacatttgtgatttgttgttggaggtggtgtgatctgtgagatttgtgatttggttgttggaggtggtgtgatctgtgaggtttgtgatttgttgttggaggtggtgtgctctgtgagatttgtgatttggtgttaggggtggtgatgtgatctgtgagatttgtgatttggtgttggaggtggtggtgtgatctgtgagatttgtgatttggtgttcgaggtcggtgtgatctgtgagatttgtgactttggttgtcggaggtggtgtgatctgtgaggttcgtgactttgttgttggaggtggtgtgactctctgagatttgtgactttggtgttggaggtggtgtgatctgtgagatttgtgatttggtgttggaggtggtggtgtgctctgtgaggcttgcaggtgttctttggttgtttgaggtgcggtactttgtgaggggagctcgacggctttcagtgtagggaacccgagggcagaacactatattgtggggagtttttgaggaaggaaaaaggggtaattttttctctttaacgtctacactgtagtgcttcctgctttcctttttattatggaaatcatgtgtgttggttattgctcattcctgatgctgtgttaatgtagctgtcataggagtgcactcatatcaccagtgctgtgtgtgcgttcatactcctaacagtaactactgtcctgccggcagaggtgtttcacctgcagctcaaattactcttttttcactggaatgaaaagcaaattactttagaaattccttgtctctttctaccagaaagtctttatttaaataggaatcattttgtgctctggaaggtctgaggctgcttgtgttttctttgtctgcataacaggagctctgcaggagtctgcaggtcacccggagcaggacggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaatgtgattaatttttttcgtttgaaaatatttaagataaaacagtttggcatgtaaattaatttcaagttcagatatttttaagagaaaactttagtggtattttcctttacctctgtgaagttcagaggcgtttacccctgcagtgtccactggaaaggcttcagactttcaaaatcagggcatggctccgcgacagcgagccgtgggcgtcagcacagtgccctgtgcatgtgtcagaactgttcctgttccctttcatttgctgctttattcaacggcacccagtcattgaggaaccttttgaaagttcctaagtgttttgatcctgcttgtgtgctcaagtaaccatgaagcactgaagctgaaagaatgaattgcctttgcaaagataccaaacgtgaaggtggggtgcaggtactgaggaagcaggaggcatgtagcatgtgtggagtcccacctgctagataatgcccaagcggctgcgtttccatagaatggcaatagatgaaaatgaagacatgttttcaaacatgcagattgaaatgctaccccacccccatcaagctctactttttcccctttgaaaaacttgaggcacttagaaagtatctaaatagaggaaatgctatgacatggcatctgacagcttgcagccaggtcagtgggaggctcatcaaatgccactctcctcttcctgacagtgttctgctggtgggacatgaacatcagtgcttgtctggcacttaactaggggatgtttccttcgtgcatattttctactcccctgttgtaatattttaaggaaacttgatctttgaaattatagctagtgttctgtgtcttcctttgaactcatatcacatttattacaagagacgcatgtgttagcacagctacacaatttttagaagtagaagtggatttcttgtcttgctgtgggttttcctcattttagaagaatatttgtaactcattaagatacacattttaacatgaaatgaccatcacacagatttatgtttggaaatattcaagataaaatagtttggcatgtaaatcaatttcaagatttatgtacataagatttttaaaggaaataggtaagatatatagaactgctttctagtgtatattaaggctatctcatgcctgcttcttacatttttttctgaagcttatttcagaattaataccgtgcccttccctgactaaaaaaagttaatccaaggattgatcgttgcgaatgtatcccttttccaagacctactgcataggaagtaagtgaggcagagatgagattatgcggcggatacttctgaaggaagcgttctttttgtgtcacttaatctgtgttcacgtaacttaggcactttggattttttagaatgaaatttcaaaagcgcctacacgcaccacccaatttaatgtcgtatctgtacttggggcctctacacctttcccatattctaatgaaaagatcgtacgccaaaggccactgagctggcatcttcttcattgtggagaaagtgggaaccacagagcttttcgtgggccagatgcccacatattcctagcagagacatgttctttgtcatggtgtggcttgccacaacatgtcctgtttggtggctggccctctccgaacggattcccctcctcagacccccatgcacggatgagcacatagctcaccctcaccctcacacactcacccacacactcaccctcacactcacccacacaccctcacactcaccctccctacacaggcatcggggcagttctttatatggatgactaacaactaagaaaaaatgaagattagtatgaatggcaggagcaacaggcagtcagaagagatttttctatttaatcttttatgtgtaacactttacagcatgaagacgtattctatcaatatttgtatcataattgacaaattctcaagtgacatagggatttgttcttgattcaccactaaagaaaatttttaaagttaat

SEQ ID NO: 13243 - DNA, 12368 bp, Human
gtgcttactgggctcaacctcagagctctcagatcctgaccccctcaaatcagttcatgttcaaaaccacgagtttcctcctcttggccctcaccgcatggctcccggacacagttagctgcacaggttggggagttcagaactgctttggtgcagggtagaaacagagaaattgttgatgttcaatctcaggggtgaataattcagggctgcgcaaaacctcatttaaatgaaggagaaatgaccattctgtggtttaacagagacttcctgaagctgcaggtgctgggagaaagacgaggccaggccacctgggatagagtggtgcgagattccaccgccagggagaaaggaacttgtccttcagacctagagctggagctatgcatttggcctcccgccggtcgcgcttggggacaggagggcgccggatctatgcgccccttagcagcagatcgggatccttttgcctcctgccccttctgtcactgcttggagagggatgagttctggtggctgggcctggctgtaggagacaggatttggaccgtgcccctctcgcatcaccgaaatcacccccactattccaagagtggttggctattaaacgtgaagatttcctgagagaaggattgaggacctggccaggaatgggacacaagttccgccttgtgtcttcctgacaggagccctgcaccgcgctggacgctcaccttgacactcccagccagctggggtactgatcccacccttccccggccgctgccccgggagtggggaggtagagagagccacacccgaaacacctttccacgataaacttttattctctatcttattattaatggtggcggaaataaaactaaaaccaaaacgaaaacgagtactagtactaacacactaatcaatttgagatgacttccccctcattcccaaagctagaggaggaagggggctgaaaggggctcagagcagtggaaggtcccaggcccagctggggttgggacgtgtgtgtgtgtgtgtgtgtgtgtgtgtgtgtgtgtgtgtgtgtagaggggtgggttccgggggggtggtggaagagggccgaggggggaggatagaaggagggggtagagtttcagggcggggaggggggcgctggggcgcagtgacgggaaccaatgagctgccaactcgcgcgtctccggcgtgactgccgagattgacgtggaggacacgtcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcgacccagtcctgggtcctggagaagctgcattctcctctgatccccagccttcagggggcagttgagcaagtctgggaagggagtgttccaagtagacgcgctaaaagtcgcgaaagggcacggagggctacaatgcgccgcgctccactccgcggctcctctgcgcccttgcccactccaagccagacccaggcggtttgcccttggactccgagctgtctggggacccacaggtcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggtcagttgtggcggcctccgtagccttctattaaggggcagaacctggggcgggcaggcttgcaggagaggactcacactcgctctcctcccgggaccggttctggctcaggggagggctccacactggccagggaggctgggggtcctgggccttttgtaagagacctcggacatcttgaactttttatgacaaatatggaaaatatttcccaaatagaagagcaatcgccgaccacaaatttggaggcctgaaattgtgctttttcattcttgcaaaaagtatgcaagcccctgttgccaaatctaagggggaaaaaaacccgctcaattttgagaccctttctttagctctcagaatccttcacgatttcccaagggttctgtcccccactcccaggcccagtggctcttctgagttaaaggaaaagggatcttgtggtcgattgagtggcctacatctctaaggtcctgtggccttgcaggtcctggagtttgcggtgatggctggtggggctgcagccaccttcacaaggatttgtcatttatctgcaactaaagcttaacacactataggtcaagtgggtgacgaggaagatggggaaggcgggaggtttggaacaactttgatgcctggctgggaaagaaaccagccagaatcgggtctggatttctttgcgctctccccagctgccagcagctggccaggggatggcacactcttaggtgatcagactcaggaggagggcaagaagcaaaattcaccatagcctaggaggaaagagtggtggctggaaagaaactgtgagtgctcagctccagcagcagcagcgcctctgtggccctgctctggctttgtgtctcctggtggctctaacccagcctaaggctaaagcttcccatggaatggcaggggtctggaggtgaccccaccaagcctgcacgcagatctggaggtttcccttggttcctggcacacacaagggcccggggagcagctgtgtgcttctatctgacccgtggggacaacaatgttgacgcttcttttgggaaaccctgggcgtttccagaggcagttctcgtagaatcgtctccctgccctccagaggcttgtgcagatgttgagaaatcaatacaattttcatgaggttgctgtagctttgaactcggaagtttctgggagccgtgtctggacaatggagcggccgctttggccgagtctgcccaggctttgactcagcagcagcctcccgttcgtgggaaaccggttgaaggctaggaggaccgggcagcaggcctggctgcctttcctccgccccacccggagtggtgaacattccagtccctgccgcctcctggtggagtgtcaggccacctacaaattttgtgggacccctggccgtgtcttcagatacaaattgggtggttggccacacgtgtgcccagggcagattcggaggcaccttttaatccgtcctctctctcctgcaggggccctggctgggagcgaaggcaccgcttactctcccaagatggaagactgggccggcgtgaaccgcacggccttccccgccacccccgcagtgaatgggctagagaaacctgccttagaggcagacattaaatacactcaggtaaccaggaggcacgtgaggccgtgaccttaagtagggaagcagaaggtttgggcaagtggggaaaaagagagagaaagaaaagaaaaaatttccaggcagagagatggttgtatctggcagccggctagcaagcgtcctttctgtcctttcctcaagcgtactagtttgggagagtctgactttagaggggttgacttgcctttgccaagatagcttagctaaaaaaagctggaactccagatgacgaatccacagtcaagggccttctttctctaaatcccgatatgaataccatgaccccttcacatcgttatttgtaacagtttgagtgaattcttagaaatcactttgccaaagagtcctgactaggaaatttagaggccaggcctcgcatggggataatggatgggcacaggacgtgggggagcgataatggacgaaaacccccgtctcagtgatggcgtgggctagagaaggcaggattttctgctgctgacggtccctctctatccccacagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggtgaggagcgcagggagtggggcgggtggatgctggaagggttaggaagggtactggggagcgggtgtgagcctgggaaaagggagagcgggtggggaagaggtgggtcctgggcatgaacccttcttctgggttaacctttgagcatgtagcttcttggagcagattagttctgacaggtgtccctataaaggtacccgaggttgagagagactggccccaagactgtcccctccacttatgatgggagaggtgaaaggaggtccttctggcacacaggacgcgtgggtttggatccggttctggcaccttcgaccaagttcctgcttctttctgggtttctgtttctccatccagagacacgtctagcaggcaccctccaggctcacctttctgtagacctgttctggcacctaagccctttaggtggggttggacttgctagtggcacctaacctccatccccagacccttcccgtctctgccccactgcccatctgttttttccaggttccttagagagaaaaaaaggcgtttggattctttttcttaaatacacactgtgggaaagtagaggccatgtgaatcagtgtcctttactccaggctcaggagctttctgtggttgtgggtggtggtggtggtgggcgggtgggggggttctctctttctgtggaaaatgtgcctgggagtcttgcctccttttccgcttcctccttctcttccttttccataagtccacttcctgaaaagtcgaggaacagattttaggtatttcactgacagtcagcagtgtgagggggatcttctcacacaaccaggagggttccagtttttcctttaacttgggaaaagctcaccagcccttgagtcctcattttctttgttgttaaaaggaatggcttgatttgctaagttcaaacttgccagtgcttaggttctgagcaccagaaatttgcaacttcaaccaacctgggaaaggaaagggtcaccccaggtcgtcccagccccagcagagaaagagacaaggcacaaacctgggggacagcgtggagttcccagattataaaaggatttttactagctgctttgcctccacctgtccagggctggaagcgaggtggatgtagtggcaggtggcagtgggcaggcaggggacaggagggccatcctccttggtgctgcccaggcaaaaagtgctatttccaagtagtcttgataagataggagggcatgccctggggagtgggggtggggtggggggcaggaaggaaataaagatgccatccacaacagtgaaatgaagggagaaaaatactttttctatttctacctttcctagagcacagacatcctgggatattaggataatgttcacttgcctagttacagacaaatccaaataaggaaaatttataaaaattgggatttagagctcttttaaactttaagtttaatttaaataggatactatcatttactcatttatagaaaaatccaagtgaaggaaatgttaaaagttgagagtaagaactcctttaagctttatgtttaaggatagttaaggggtcgcagatgagcgcttcactcatcctcagcctccaatcaacctgttttctcaacaactgaggttatctgtcgaaatcgaaatcaaaataaaatttaccacattacacaaatcacttaaataagcaggttcttttgaattaaaaatgtataaccacagatttgaaatatttcactgggttcatcttaaggagaaggaagacttagaaaaaagacccacagtcttcagaggaatgcatttgttttcaatagagccactttgccctggaggcattttaagctctacattagacacaaattataaagtgcagataataagccaaaggtaacacacacagttcctaattctaaactacctgtcttaatttgtggtggaagttgcggggaagctgattttaacattaagcctcactggtgattgattttctttagaagacactttccttttcagaaatacagggtcattgaatggtgctggcataagtcccttttaccattatatcagtttcctattatgtaatatcccacctgtttttaaaagctacagcaataatttgttactctagttattaaattaataatttaattttgtggtcctccaacttctttaaaggttctaataaaagataatcagataacttggggacaccattagcaatgatttctcaagctggcatgcaactgtttgtgttcgaacaggaatgtagaaataatcattcattatctatctatattcatagcctgagaattacatacatgcttgggttatggatttttactccttactggtagaacagctgacttcaaagatctattccctcaacacaactggtctttggaaagacagaaaaataataagaatcactgccttttattttctgatcagttcttaagaaattaatatcttcaaagaaacctgtcccagaggacaatttactatcagcaattgttcaattcataagaatagtgagaatagtatttagtgaactccttttcagtaagaaaaaattcttctgtgtaatgaaaagcaatttaatacaataaatgctcagtaaaagcaaatacctttgatcacctaacacatacacaccacacacgcacagtgcaatatatatcaatatgtcctccaaattagtgcaaatgaacagcttaacagttaccctaagtgaaacttaatcaaatgtcaaatcgaaaatttagcatttaattagatattaattgattaattgtgttatttaatactataattcatttttttcttattttttaaaaaggtagtgagtctgggtttcctattatgtaggtaaaaagcatgatttacatttcccatcccctgaaaggaaactttaatttttgggaattgagaagaatagaaaaagtttcgcttaatcttcacttggagaggctgacattctaggaatctccacccacatccaaatgtcttttcatagccagggcacgaccatctccccttccccacccttaggtgacagacaccaccagatgctccctcaagacagctggtatttacaggatgttttcagagaccctcgaaacctcagggttttaagtccctcctcgtggggctctggaatgactaaagatttggaaatcaaatctataagatactgcatacgcacaaagaaaatgtattgcttttatttgttaaagataacttgcagcttcgctccagttacctctgcctcgggattggttcttggaagatcctaaaagtaaactttgtcaaagagcactaggtcgctggcattgtcgcacccggacgctggcaaccccggcctccgtttgacccagccccggggatcccttcccagacccgtgcctcccctcagcggtggtctcagagtgccctgcaattgcagttgaatatttaaaaaatgcctctccccattcttagcccctgaattaaatgagcctgacctaggccccggcctccgagggcccagaagtacccacccttgttgtcctatggagggaatggagggcaggaggggccctatgaggaaggatggcttggacagggctaaaaacacagcaggattcgcccctgtagggtgggatgcagtcttcctgggtgtttatttttcatgagttcagtttcttgcttgtctctaaggtaaccgtcccttggctgagaaacctccacctcctcagatgttttctaaacaggtcctcactttgaagtgtgtgtccacggtagaaagaaaaggtctgaatacttgttggctgggcggccacaactttgtttaggaaaaagagctgagagccagggaaaagcagaggggccgctctgtcctgggaaggtctttagacctctttaaaacctcaacgaaaccgtgtgttttcttttttttttgtgtgtgtgtgtgtgtgtgtgtgtgtgtcttgcacagaggtggttggcccagctctgcgcagccacagcaagttgcgcctgaggctgaggcgagggaagctgcaggagaaaaaaaaatccagagttccccttacttcaaatcgaggcgctccaagctccccctttaaaggaggacttggggaaaaaagaaaattgaaaataggcccctgtaggtataaacaaactgtggatcctagtgtaggagaagcagagtggctcaaggttgggaaaggaaaaacaggcttgcgcaatcgtggcgtcactttctggcttccggtggcaaaacttgggccccttcccaagcccctaaataatagagtaaggcgcagaatactgcccgatctggcaatcccactgtcacttaatccggaggcccacaggtcccaggacgtgctgtgcccacagtggtgagcgcatctggatccccggacctcgtgggcacaacgtagtctgccgctcacttaaagcgcaactgcctcctacgtcggaggaatccaggccgctccagggaaatctctggtggctcatttcccgcaagatttccccctgcccacagcgagctccgagccgcgggtgtcagcggactcgacgcattggctgctcttcgcacttgtgcgggcgcctggggtttggaaagggtgagggtccgcgcaacgttagagtcctgttcccttctgcggaagtcgccatcagacctgaaaccttcccagccctctgcgcccttcacttcctttactgagcaggtggtgagggggttggacggcaacgggaattgcacctggccagcggtcagtgtttgcaaatggccttgcgaggagtcccgcttgccaaggctctccttgcaagtggctctcctagcgggagaggaagggctggtcgcccacggaagcttggggtctctggagagcgcgagtctctgcttcactcttccagagccttcaagggttgagcgctcacgacctcgctctgcaggcgtcctgagtcccagtgcctctcgcactgcgcggcgctaggtagtgatccgacgcctctgtgcttcctcccgcagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtgtgtggtgaggtgagcaagtctgtttctgagcgcagagtgttgagttcttactccgtagctaccctctcccctgagttcctaggatgaacactatcaagggaaattatgcagaaaccaccttgaaatgcagttaattctgaaaagagtaaaatgggcaaaaggcaatgagccagaatggaggatttcttcagaacatttctagtattctaaaagctaaagaagacaatcccaggctaccaagtaatctagggggtttgcactacaaaggggcttccggctaattgtttttttttcctgcctctgtttgaccttctaaaactgatggaagagatttttgaattgaagttgctgtttgtgagtggagctgcctgcttggtgtgtgcactggtcccacctaggggactagtggtaaacagtttttgtttcaactctttttgatagtatctgttgaaggtatcaattataaaaaagtacttacttttttcctagagagactcttcttctcagattcaaagtctcttgtctttttttttttttttttttaaagtttcactttgtagacagtgttagtgatggctagggatttgatttattttctttagaccacatagcaaggtatgaattagagggcttgtgcttggaaactgggtgacactatctcatcagagaggcaggattgagacttggactttgagactgaagtcctcagccttccatggcagcatatcctgtagaagagcttgtcatactgataataggaaaaaagtatgacagagaagcatgttcccaagtcccccatcctctcagcctgtctccttgtg

SEQ ID NO: 13244 - DNA, 9999 bp, Human
gccctcactctccggccctggtgtgggggagagagtgaggggttgggggatcggcagttgggaggggcgctctgagattaaagagttttacctctgagataaatgtgaagtgtgttgtgagtgttcattcaacattttctgaaaccgaatggcagcgtctgattatcagtgaatagctgggggttggaattactgtgcccattttatttacttttttgagacagggtcccactctcgcccaggttcaagcgattctcctgcctcaacctcccgagtagctgggattacgcgccactgccgcccgggtaatttttgtattttcagtagaaacagggtttcatcatgttggtcaggatggtcttgaactcctgacctcaaatgatccacccgccttggcctcccaaagtgctgggattacaggcgtgagccacggcgcctggctttgtgcccattttatagatatgaagacacaggttcatggggtggaggagagcatcccagtcttatgtgaccatggaacccaatcttgaggaggtgagtgttggagacagagcccacatattcaccagcaaagccaggaactccagccgggagtcttctattataaaaggactggagcaactgggcttggtgcctcacgcctataagcccaacacgctgggaggccaaggcgggaggatcacatgacaccaggaggtcgagatcagcctgggcagcacagtgagaccccttctccaaagggaaaaaaaatggctggaggttagaaagcaggtggaacctcgtccgaaattaggactaggtaaacgtagtcccaccagaccactaccgaaagaatgctaacactaaataagacttaaacggatctgagcactttgggaggccgaggtgggcggatcacgagatcaggagatcgagaccgtcctggctaacacggtgaaaccccgtctctactcaaaatacaaaaaattagctgggcgtggtggcgggcgcctgtagtctcagctactcgggaggctgagacaggagaatggcgtcaacccgggaggcggagcttgcaggtgagccgagatcgcgccactgcactccagcctgggcgacagagtgagactccgtctcaaaaaaaaaaaaaaaaaagacttaaacagggctcactaccacccattttttaaagcttttgtcacgtgttagctcctttaatcgtcatggtaaccccacgaagcggaaacgattatcctttttatagatgaggaaactagaacatcgagggtgaagccaaagaaggacttaggggcgctgtcgggggcggaggtttcctcgactgacaatgaccatcagatgggaaaaaaatcttcctccctgggatgaaaattagaagtcaaggtggaaagaggcaaatctgctaacggaggatccagtccccgctaccggcctgagcctcgcgttgcagcaagagagatgaaggtcagggctgccgagagaccctgggggccgggagtcggggaagggggcgttgcagcaagagagatgaaggtcagggctgccgagagaccctgggggccgggagtcggggaaggggcgtggctgctgtgggaggaggccaggccccgccccccacgaggggacgagtcatttccgtccgccgaggaaccgaccgccgccggccgggttgcaggcggggcacctcgggcaggacctccctggtcggaagtggccgtgagcccaagccgcggtcccgggtgagtacggggcggggcggaggcatgtgcgaggctctctgcctgtacgctggaaagtggggattgcaactcggggagggatggagcacgcgtcgtcgcctgggaaacgggtcgacccgcggaaggcgagcgggtgggacttccggagcagttaatggtggggaaactttctagtggatgtgggaggaggcgggacttcctgcagcaaattggggctgtgcgccgctcaagcccgtttacctgctccccaggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaactcaaggtgagcggggcctgagctggagggggtgtggcctgctgcaaaagcgggaacaatccagagggacgcttggctgctacgcgggattgcagtggtgcagccagccccgaagtcggaaggtgctctctagggagtacaggaagataaagtttgtgcttgatttagaattagctagatcctttgggggagaggggatcgagccgatttagggaggatgttcactgcgcggatgatgctcaggccatcgggaaatccagaaacaggcgacgaccttcgtcaagagaaaaatgatcctgtggagaaaagtaaatgtcgctaggttgggatggatggtaacaggccaagccccggacctatatctagccacattttttgtcaaggaggaaaccaattctgtagagaaaagtacctccctgtcccttgcaaggaccagtgtcaggcaatcctagtgccactatctggctactgcatgtcaaggagccaatcccatgtagaaataaactgcctcttactccctggatgctatagcctgaagcaggccacactccccagaaatgagggacccaatcacacaaggatgcaaatcctgactccacccctccaatcctcagtggagctggtcgcagatcctgagacccggacagtggcagtgaaacaggtatcagtgcctctgcaagggccagcaaggcctggggatgggatttggggaggaattgcaagccgtcagtgaaggggtacattaggaaaatctgattggggccgggcgtggtggctcaagcctgtaatcccagcactttgggaggccgaggcgggcggatcgcttgaacccaggagttcgagaccagcctgagcgacatggtgaaacctgtctctctaaaaaattagcgggaatggtggcgcgtccttgtagttcctaatcgggaggctgaagcgggaggatcccttgagcccagtaggtcaagggtgtagtgagcagtgatcaccacactgtacttcagcctgggtgacagagcgagaacctgtctcaaaaaaagaaaagaaaaaatatggctgggagagaaggggatgtgtccagtaaagaaagaagtgttgcctgtttcagtggggtgggtacctgtccaagaccttagaaattggacaaggcggccaggcgcggtggctcacgcctgtaatcccagcactttgggaggctaggcgggcggatcacccgagatcaggagtttgtgaccagcctggccaacatggcgaaaccccatctctactaaaaatacaaaaattagcggggcatggtggcgggtgcctgtaatcccagctactcgggtagctgaggcaggagaatcgtttgaacccaggaggcacaggtttcaatgagccaagattgcaccactgcactccagcctgggcgacaaaacaagcctatatctccaggggaaaaaaaaaaaaaaaaaaaaaagattcggacaaggctgaaaacctgtaaccgttccaaagcccgttccaaagtgaagaggtggggcctaagggtctgatagtggtggagaagggctgatttttccgctgggtatttgattggaggaagctcccggtgggggcggagccagtcccagctcctccctctctttctgcagctgggagttaacccctcaactaccgggacccaggagttgaagccggggttggagggctctctgggggtgggggacacactgtatttggtcaatggcctccacccactgaccctgcgctgggaagagacccgcacaccagaatcccagccagatactccgcctggcacccctctggtgtcccaagatgagaagagagatgctgagctgccgaagaagcgtatgcggaagtcaaaccccggctgggagaacttggagaagttgctagtgttcaccgcagctggggtgaaaccccagggcaaggtgagggccacgccgagggctgtgggagccgccacagactgggacccaatcccacgtttgttgcgtgctctcaactttttagcctctacttacttttctgagaaatgggcctaatgataaatgcagggatcgttgtaagcagttaagcagtggggagaatgatatatgtcagctcctgcgttacccacagtgaccacccagtaatcagcaatgaccatgactgtctcagtaggagctattacgatgaggattttttatgtccagagagacttgagttcaaatgctgttaccaccacattctgagtcccatgtgtctcatctctacgatgctgaatccataaaaaaagcacgtggcatagttcctgacatgcagttagcacccaaagctttgctcctgcttttattttcacggttattagcccaccgaggtggtgaaggccaggggaagaaggaggctgggtaagacattaacccccattttaaagactgtaatcctggggctggcgtcataaggagtaacaggagacagtaaggttaagatgtcgggccccactcagaggcatcacggatgcttgagatggaggtgctctgtgactcggtttccccatctgtgagatggcagtgataacaccctgcctggcagggttggtgtgagtcagcctgtgagtgaggagggtcagaggtatcacagtgctgctgtttgtctttccttggtgacaccaggtggctggctttgatctggacgggacgctcatcaccacacgctctgggaaggtctttcccactggccccagtgactggaggtgataagaggcaaaacaagggagtgagtgaggcctggagtccacctctggccccgggtcacccctgccgcttcatacctgccgtaggatcttgtacccagagattccccgtaagctccgagagctggaagccgagggctacaaggtatgtgcagccgcctgtctgcatgggcacgtgcacgtggcggtccgaccgcagtcagaccaaggccctggtgagcagagcgtctggtgacaccctttgctccccagctggtgatcttcaccaaccagatgagcatcgggcgcgggaagctgccagccgaggagttcaaggccaaggtggaggctgtggtggagaagctgggggtccccttccaggtatggctggaagggaggctgggagctatgtgggggcacagagatccagagcgagggctttagactccagggtaagcggggcggaggcctcaggcagtgtgatgctgataggaacccatcatcagctacaaattctgggctggggtggcatccagtaggtgcttgagggggagctaaagctggtggccccctcccatccacaggtgctggtggccacgcacgcaggcttgtaccggaagccggtgacgggcatgtgggaccatctgcaggagcaggtgagtcttgcagcctgcccggcccccctccttttcctcactccagcccctcactcctgggctccccggcctccggttggggcctccttactcctctgtcctctctcgctccctccttctgttttttgctgtgacatcttagatgttggtttacgagaccagtgctttcagactttctacatcagagtagtagggaagctgttcattccttcgttcattcgtttgtgtgtgcatttgttctgaagtttagcgcattcttgagctgaaggtatcagtgagcgggacggcctgctccagcagggccctcacggcgagggcggtgactctaggcggatgggcagactggcgtgtaaaacagcaggagggagggagctggagaaagcaggcatcacccgtggtgggcagggatggcctctgaggaggtgacatcagaggaaaaggcctaaggcagggaaaggagggagccaggtggacacctggggaaagcggtccccccccttgtgggagtgacagcaagtgcaaaggccctgaggcagtccctagcctgggctagttagggacagcgaggcccatgcggctggctctaagcgagggaggggagagggcagggccacagggagggccccgcttttgccctgagggagggggaacctgggaggcgccggcacgccggaggctggagctgtagcagggtgggtgccctccggtggccgcgtggggaacgggaggaggtgaagtcgggagacctggagggagggggctgtgtggagagaccacggaggggggagggggccaggagcacggtgcaaagtggctggagagtgaggacatgaaaggtcgggggatgattcctgatgtggggcacagaccaggcgaagcagccccagggacccgctaccgctgcggggggacatttgtgggaagggcctcctcactaccgtctcccgtaggccaacgacggcacgcccatatccatcggggacagcatctttgtgggaggtaagggcctggaggctgctgagggtgggctgggacgcctccctccgagctggtgggaacggggtgtcccgtgtgttccagacgcagccggacgcccggccaactgggccccggggcggaagaagaaagacttctcctgcgccgatcgcctggtgaggcccctgccccctgccccgcgcccgagcccgaccctggcctgtgtctgatgttcgtcctcaacccctagtttgccctcaaccttggcctgcccttcgccacgcctgaggagttctttctcaagtggccagcagccggcttcgagctcccagcctttgatccggtgaggccctggggcgggggtgggggtggggatgggagggctcccggggatggggacggcatctcacgcgtgtcccccgcccctcgcagaggactgtctcccgctcagggcctctctgcctccccgagtccagggccctcctgagcgccagcccggaggtggttgtcgcagtgggattccctgggggtaagtgtcctgttcctgtgcgcgtgccctgagccccgcctgggtcctaggccacccaccgacactgccccccacacagccgggaagtccacctttctcaagaagcacctcgtgtcggccggatatgtccacgtgaacagggtatgaccaggcttttgccgccccaaatctattataaagttcccatctccacctctcaactggtttggggcggctttcctccatcattgcctccccgtccccgctcggggtcttctctccccctgggtctgccgatctgtttgtgacctctcgtgtccccaggacacgctaggctcctggcagcgctgtgtgaccacgtgtgagacagccctgaagcaagggaaacgggtcgccatcgacaacacaaacccagacgccgcgagccgcgccaggtagcgtgaccgcggggccgtaggtggcctgcggcggggtgggcggggcctgcacatccagctccttcccccacaggtacgtccagtgtgcccgagccgcgggcgtcccctgccgctgcttcctcttcaccgccactctggagcaggcgcgccacaacaaccgggtgagcccgctcagcccggacaccccccgggctgcaccccctgacccccctcctcccctgacccctgggcctgccgcccctctgatgttccccacagtttcgagagatgacggactcctctcatatccccgtgtcagacatggtcatgtatggctacaggtactgttggggatagcagggggcaggggcactggctgggccacatgatccaggctgtccctcactgttcccaccactgccaggaagcagttcgaggccccaacgctggctgaaggcttctctgccatcctggagatcccgttccggctatgggtggagccgaggctggggcggctgtactgccagttctccgagggctgagccccgcccagctcccctccacaataaacgctgtttctccttgagcttggccggcattttgctggaaggagggtggtccccacgggggaggggctccaggcctgccagtttcttacatggaggaggctttaaggacattttcaggtaacaaaaggtggggccctaccgaggggagtccagctgggacctggcatgagcactttagacattagccggggaacacacagggagggcgctgtgtggccccccgagagccagctggtgagcccacgagcctcaaccgaggggctggctcaaggccaggtgtgacccctgaggacaaaatccagctcaggttctgtgacactgaacttgaacccaaggcctgcgggtctggagattcgggggggaagagggtgtggacagccgagagccagacccagtgagttcccgggctgtccagcctgctgggccaccttagagctagggggctgcaaggcatcgggcagtgagcagagaaggcaggcaggtttttaaaaggctttattggggaaacgtagaggggtggggaccgtccttggaggcctcaggacaccatcctccatgttgctgggcagttgaagtccccaggggcccctgctcagaagcgtgtcacctgggggcaggggtgcagtgggggctgctggccacaggctcccaagcactgaccccacatccctgtgagcagaggcctggccccacccaggcctggataccacctcccatggccctgaggctgggctgcagtttcccgacagcctaggaccgctgggactgctgcctctccctctgctctgctctccccaaggccaaggtcgccctgcttctttcccaaccccaccccccccacatgccccagggtccctcctgtacatgacagggtcaccactcaccagtctctgcgggggcctcatctgtgactcctggaggggcccagcccggggtaaccactacccccccatctacggcgagaaatcagaggccagtggtgagcaggcagcgggggtggagggagactgagcagccctggaggccggccacctcacccctcgttgctgttgctcctgctccaggttccgctgcaggacctgctgctggttggcaatgacacgccggatgccgttgacaaagttgccctggtcatgggggatgaggccaatgaagattttcttctctgaagagtacaggagcataagcacgcggatctcacacgatgctttgtaggaaaagtgcacgcagccggcctggcaggcacagggcgtggtgtcaccagacagcaccacagggaccagcatccctccaaccacggcaccatgccgtgggctccatgagccaggcacagcctaactgctctgtcctcacaccccccacccaccctggaggtgggcccccttattgggatgacacggtggccaagagcaatgggtgggccaaaggccaacaggctctgtcgggaagggcccaagaacctgcatttcagagctcctgggcaggccaggctgtgtctggggccacctcaccacagccacctgagccaaccggccatggcttcaactcaggagcccgagggatctgcagcggccggcccagcacaagcaagggctgaggtacatggagcctttctgggtttccttgaggaaactttttttttttttttgagactgagtttcgctcttgtcgcccaggctggagtacaatggcatgatctcagctcactgcaacctctgcctcccgggttcaagccattcttgtgactcagcctcctgagtggccatcatgcctggctaatttttgtatttttagtagagacggggtttcaccatgttggccaggctggtctcaaactcctgacctcaggtgatccacccgcctcggcctcccaaagtgctgggattgcaggcgtgagccaccgcacccggcccctgagggaatgcttgaaattgctttcatgtaaaagcacctacacccaggccccccccacccacgaacagcttcgtggacagtttactcagactgagtcgaaggt

SEQ ID NO: 13245 - DNA, 10103 bp, Human; identical to SEQ ID NO: 11967

SEQ ID NO: 13246 - DNA, 15163 bp, Human
cgagctggagtgcaatggcttcatcctggctcactgcaacctccacctcctgagctcaagcgattctcctgcctcagcctcccaagtagctgggattacaggcgtgtgccaccagtcctggctaatttttttatttttatttttatttattttattattttttgagatggagtctcgctgtgtcgcctaggctggagtgcagtggcaccatctcagctcactgcaacctctgcctcccgggttcacgtgattctcctgcctcagcctctggagcagctgggactacaggcgcccaccaccacacccggctaatttttgtttttttagtagagacgggggtttcaccatattggctaggctggtctcgaactcctgagcttgtgatccgcccacctcagccttccaaaatgctgggattacaggcgtgagtcaccgcgcccggccaaattttttttttttttttttttgagacaagagtctcgctctgtcacccaggctggagtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgggcgttcctggcagggggagggacttggcaaaaaccaagtggcttgagaggggttgatggttttaaaaaacttggaatgattatgtcaagggctagggatttaatgtgttgacgacggactcctattcctcacttgcttcgggaccccagctatgcccttcctctctctgggcctctcaccgattccgtttttcccccaggtaatgagcacaagctccctttttcctccagactccccccgggttgggaggatccaccgagtggacgaggagtgataattcctttgagccaatcgttggtgcctgaagccccgccttcttccctacccgtgggccaattgccgtgttctccttgaggccggccgcttggcgagggtgggccaaaggctgcgtgacgtcgcttccggataaaccaatggcagcgattaggaggcgggtcgttttggtgatggacaggtgtttcaagacgcccctttagcgcggggctccccgggaagctttgaggcggtgctgggtgtaaaggggagggcattcctggtggattttgcccaatcaccagtcgcgcttcttgcaatagacgggcagttttccccatcccgggtcgacttgagggggcgggattctggacgccagagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcgggctccacgtgcgggacaaaggccccgcccccggccggggatgggcgcccaggggggcggtgagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttactctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcatatcctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctccccagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcaccccctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacgaagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctcactgcagcctcgacctccccggctcaggtgatccccccacttccactttcggagtagctgggaccacaggcgcgcgccaccacgcccagctgatgttcttatttttctgtagagataatcttgccttgttgcccaggctggtctcaaactcttgggatcaagtgatcctccggctttggcctcctgaggtgctgggattacaggcgtgagccaccgctcccagcctgaggacttttaaaagccagggttcactggttcttaggtagcagtggtgaagtccggccaagattggagtttagaccatctaatctgattttttaaaaagggaaactggctgggcgcagtggttcacgcctgtaatcccagcactttagggggctgaggtgggtggatcacctgaggtcaggagttgaagaccaacctgggcaatatggtgaaaccccatctgtatgaaaaatacaaaaattagccgggcatggtggtgtgcacctataatctcagctacttgggaggctgaggcaggagaatcacttgaacccaggaggcggaggttgcagtgagctgagattgcaccattgcactccagcctgggcaacagagtgagattccatctcaaaaaataaaataaaataaaaataaataaatgaataaatataaaagggaaactgaggtgcatggaagaaagcgagagggccgagctctggccctccgagctctcaggacacgctgttctccagctggggatatggggcccctcacggcgtctctgtgccattcttgccctaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcggggtgagtctccagggtggccaggcggggccgggcctgagggatggaggggagcccatcagggctcagggattggatggaggtgatgggggcaggggatgggtctcaccctcccttcttcctgggccctcagatcgagtgttccagtatctctgattatgcggtgaagatcgtcaaagccaacaagttagaccacggtgagcccagaaagaggatgggtttgtgggagtggagggggtgatgccctgcttccccagggccctctgaagagcagtggggtctacagatgaccacagattcagcagctcccaacccatggtcttttgggctgccggccgcctgagaatctgagtgtcaaaatcacaggcttagcaccgcagtcttaaaattagggcaagaagcactctctagtttcttgaatgagtaatagagtcacgtggttggccacggaaggcccacagtgagaagccttccctgtttcccagctgccctcctctgagtttaaccaacactaacttccagagaagtctggacctacaaacacatacatacgtaaatgcatttacattctcgtgcataattttcacgccagtagcatttcataccagcctcttgcccttggcttcttacacctgcttgtcatgtcgtttaacactttccaggatgttgcggcatccgctcttttgcatgaccaccatcataggtacatccccagcatttttttttttttttttttttttttgagatggagtctcactcttttgccaggctggagggcagtggcacgatctcagctcactgcaagctccgcctcctgggttcaagtgattctcctgcctcagcctcccaattagctgggattacaggcgccagccaccacgcccggctaatttttttgtttttttagtagagacggggtttcaccgtgttagccaggatggtctcgatctcctgacctcgtgatctgcctgcttgccttggcctcccaaagtgctgggattacaggtgtgaactttttttttttttgtatttttttagttgagacatggtttcaccatgttggccaggctggtcttgaactcctgacctcaggtgatccatccactttggcctcccaaagtgctgagattacaggcgtgagccaccgtgccatcctgaagtgatttttaaaaagagattattataatgaacgcacgagtccatttgaagcaaattcccactgtgatgtaattttcccggtaaatgcgtctgcttgtgtcttatctaatagataaaggctgttttgagaatgtgatcatgctgttacttattatatcaaaaccacccagttaaaaacaaaatcgcggccgggcacagtggctcacgcctgtaatcccaacattttgggaggccgaggcgggcggatcgtgaggtcaggagatcaagaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcagttctctgaactgaagtggggtccccaggctctagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaagacgaaaaccacgctcaatttttcccacagacgggacttactgtgggggcttagctgcaaggtgttagaaagccacagcccaagccaggtgtgacagaccctggagggagatggtgcgatgtgggggaggtcgtaggaacaggaaatccgtagcggcgcaatagcccaggtccttaggccccagcaggcctccccgggagaggtgaggtgacggagaggtggatgaagcatacggaggggcagccagggcaggtgtgcccttgctgcgtgtggaacagcagggaggcccgtgtggaaggagggtctagaacggcagcaggaggaggagtggaggtgaggggtgacagggcgtgtgcagattttgtggaggcttatgggaccccgtgcttttcctctcagagcagctagggagggtctgaggatccccagaacctccaagggccgggagctgactggggtgcccctgggtgccctctggcggccgtgtgggaaatagaccagggggcgaggggtgagtgccgctgcgacatgagggtggcccagaccagggcaggaggccacatcttggaggcaagactcagggtagtgttgccaggccccacccttcatgcctcgccctgcccctctgtaggcgcccgatggcctcatcttcccagaccgggccacgctgtatgtgacggccatcgaggaccggcagtacaaagactacaagatccactgtgagcgcggcccgggagctggcgggcggggcctcgggtgggctgctgcgggctcaccccctccctgcctgcctccccagggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccaggaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagtaagttgttgagtgggggaggagaggagactacaggggcagggaccccactcgggccaccctcctgagagccaggggaactggcgcagggtttaggttggcatttgtgttgccgtttgaagccatcatgttgttggacttgtcaaggggttggggagacagtggagtggggcgcctgcattctaggaggtctggacagagttagggtggcactgccaggtttgggtgttggagaggagggagcaaggaatctgggctcaaacccacatggtttattgggagccggataggcaggatgcagagtgaaggaggagccgaggctgggtgccagtgagggagggctagcaggaaggggacagcgaggtcacaggccctctgggagcttaagggagggaggaggggatgaagcgaggtggggacgcatcccggagctcgccctctcatgtcctgcaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagtgaggcggggcccacagggctgggggccgttcccgagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggggcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatccctctcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtctcaactgtctactaaccggcttcccgacagggtgagggtgaggtcgcatctacaaccagagccagcgcttccccgccgccaccccttttcttggaatcccgctgcttagctacctgcgggtgtcattggccccgccccatttccccacgctttgaagggggcgagtctccacagacctcctagggggatagacagcagctggtgtgaccccacacacccagtgaggtctctggagccgcggtgcgggaagcggggacccgggtttgaatcctgcccctctggtgtggtgcggcctcttcccacagacttttggcctcagtgttccccgcctgggaagtggggactggccctggtacctggctccagagctgcacccagaggcgatcagcccggtgcgggaacggggcggggtggccgcaactacgggccacggatcctgacccgccctgcccacgatgactatccacatcctcatcctgctgttgctcctcgccttctccgcccaaggggacctggacactgcagccaggtgagaaacccgggtggcagcagggacagggcgggagggagaccgtaaagggcgagcgccctctcccggccgcggaacgggcaggtgatctgtaagcctccccgctggtcttggagtgcttgggtgcccacctccatcacgctccatctctcaattcggtttgaacccggttttctcccacgctccctctccaggcgaggccagcaccaggtcccccagcaccgcgggcacgtctgctacctgggcgtatgccggacccaccgcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactcca

SEQ ID NO: 13247 - DNA, 11729 bp, Human
acaccttggcttcctcatggagctctggcctttaagtcctttatcccaaggtccctttaaatactttgtcccttacctgagtcccgcccagggcaggtaatggcaagttccgcccacctgccagaaacggggatcaggcctggttaccgggagtggggcgcccctcctccttatcccctcccctcttccctgtcccctttcacagctggctgtagctggccaaggagttctcgattaaagaggaaggggcagtgctcacatttctgggcaggtaagtgaatgtccctggaggaagagcctggcttggggacccaggcatcctggctccccgcccctccgagacccagaagtttggggctcctaggcccaggagtccagggcccctgcccacttaggtccctagacccaataatataactaatcccctgcctctgcctctctcgtaatctttgttgtctgtgggtggatgtgacaatgagcacagaaagaggcacaagtggaaattaccaggaagggaagactccagatcaccagtggacatgtttataagcatctgtgtcaggtgctgtagacacagtggggaaagaaagataagctgcctgctccttgctttcttctctggcggacactgccttcactgaaatcctggctctcacacttgcacactgtgtgaccttcggcaagctatattacctctctgtgcctcagtttcctgttctctatactggggataataataggactcctggtcgggcgcagtggctcacacctgtaatcccagcactttgggaggccgaggcgggtggatcacttgaggtcaggagtttgagaccagcctggccaacatggtgaaaccccatctctactaaaaatacaaaaaattagccaggcgtggtggtgcgcacctgtaatctcaactacccgggaggctgagtcaggagaatcgcttgaacccaggaggcagaggtcacagtgagctgagatagcgccactgcactccagcctgggtgacagagcgagactctgtctaaaaaaaaaaaaaaaaaaaaactcctgtgaaaagttttgttttgttttgtttttgacatggaatctcgctctgtcacccaggctggagtgcagtggcacagtctcggctcactgcaacctctgtctcccctttcaagtgattattctggctcagcctcccaagtagttgggattacaggcgcccacaaccacgcctggctaatttttgtatgactcctgtgaaaagtaaaatgagttgaggccgggcacagtggctcacgcctgtaatcccagcaccagcactttgggaggctgaggcaggcagatcacttgaggtcaggaattcaagaccagcctggccaacatggtgaaaccccatctctactaaaaatatgaaaattcactttgggaggctgaggcgggcagatcacgaggtcaggagatcgagaccatcctgactaacacagtgaaaccccatctctactaaaaatacaaaaaaattagccgggcatggtggccggcacctgtagtcccagctactcgggaggctgaggcaggagaatggcatgaacctggggggtggagtgtgcagtgagcggagatcacaccaatgcactctagcctgggtgacagagcgagactctgtctcaaaaaaaaaagaaaattagcgggtgtggtggcgcatgcctgtaatcccagctacttggtaggctgaggcacgagaatcgcttgaacccaggacacagaggttgcagtgagctgagactgtgccactgcactccagcctggctgacagagcgagactccatgtcaaaaaaaaaaaaaagtaaaatgagtttatataggtaaacagtatctggcacagaatacaggctgtgtaagtggctgctattattgccattcgtggaccacagaggccagtcagagaggcactgcctcattacccagggactaaggcccttgtcagctgtaacaaacctggttctaggtgtctggaaaatatgaggggccacccctctctgctgctgctatatatggcattaaccacctgcctggatacttcacccagtgaggagacagaccaaggtgagtgtttgggggaagtggcatccagacacttggcgttggcctccccctgactcaggaatgtttctagtccttcctcttccaggagtccaggacccagccccttcctccttcagacccaggaatctggattcccagcccctgctccttcctccaggaccccactgctttccatccccctatgactccagccctagggaccctccatttttctgtccctcatgtctttgggtccagaagtcttcctgggtcccccagaggcccagagcttcctgagtagccatacccggattccaagagccaaccactgggacctggagctgctcacaccagggaacctggaacgggagtgtctggaagagaggtgttcctgggaagaggccagggagtattttgaggacaacactctcacggtgagggcctcgagaccctggagtttcgggccctctctcttctctatacctgtggggaggttgcaggggtaggttctggccttcagctccctcctccttggtgtctcagaaatcaggatgggctagtttgggggtgtgaacctcccagctgaattcctgctttttccccttcttttccactccttccccctcaaggagcgcttttgggagagctacatctacaatggcaaaggaggtgagtgaggggctgaagccatcttgttctgtgcagctaaggtagtcccttcccagcgaggccaaaccaacgtcctccaccccaaattaggtacaagaatcgtctgccccccaattctgtgctctctgaagctggctgctaaaggagttccctcccttaagaccccagcttgcctgaggagccccccacaccttattttatttttaaatatttatttttgctttttttttttttttgagacagagtctcgctctgttgcccaggccggagtgcaatggtgcgatctcggctcactgcaagctccgcctcccgggttcacgccattctcctgcctcagcctcccgagtagctgggactacaggcacccaccaccacacccggctaattttttgtatttttagtagagacggggtttcaccgtgttagccaggatggtgttgatctcctggcatcgtgatctgcccgcctcggcctcccaaagtgctgggattacaggcgtgagccaccgcgccaggcctttaattatttatttttgagacagggtctcgctgtgtcacccaggctggagtgctgtggtacaatcttggctcactgcagcctcaacctcccgggctcaagcgatcttcccacctcagcctcctgagtaattgggactccaggcacacattaccatggtaatttttgtagtttttgtacagacggggtctcactatgtggcccaggctggtcttgaatgcctggcctcaagcaatccttctgcttcagtgtcccagactgctgagattataggtgccaggccccccaccacatcttattggacgcaagtcctgtgtccctaggaagggaaaagtgtcagtggagggaaaggttagagctgtggggcccgtcaggccttaggctcagaggggcaggcccacctgaacccttccctggtgtccagagtaagtggaaagaccagcccctccggcagcttgattgctggggacacagccctctagcaacacgaccaagggaggaagcctgcccatcctcacctgcccattttgcccccaagaaccccttctctgaggggttgccatcttgttcccatcttgttgccagccttgttgctaaggggggctgctccttagcaacggggcctggccaggccagaccagacgaagaagcctgaagcagtacctggctgatttcccctcccccacagccccatcccagcagctgcctggttgctaaggaggccttctccctagcaaccacacctagccaggctccaggacccaaggccttctgcccactggaggaccaccctccgggcctccgatgccccacccccttgtggcccggttgctaggggtagctgcaccttagcaacaggcctaggtctgggctggagtctcacattggagcctggttgctaggggaggtaactctttcctgacaggcctagcgaggcgtagtggctcctcgaatctacctgaaggtgcccaattcaggaggacctgccttctgaagctgcacttgcgccttttgctaaaggggctcaaaagtctgggggtttactgtggtcagatgtggtggctcatgcctgtaatctcagcactttgggaggccaaggcaggcggatcacctgaggttcaggagttcgagatcagcctggccaacatggtgaaacccatctctactaaaaatacaaaaattagccaggtgtggtgatgtgtgcctataattccagctactcaggcggctgaggcacaagaatcgctgcagctgggaggcagagtttgcagtgagcagagatcgcaccattgcactccagcctgggagatgtctcaaaaacaaacaaatggctgggcgcggtggctcacacctgtaatccaagcactttgggaggccgaggcaagcagatcacctgagttcaggagtttgagaccagtctggtcaacatggtgaaaccccatctctactaaagatacagaaattagctgggcatggtggcacgtggctgtaatcccagctattggggaggctgaggcaggagaatcgtttgaacccaggagctggaggttgcagtgagccaagatcacaccactgctctccagcctgggcaacagagtgtctccaaaaaaaaaaaaaaaaaaaaaaaaacaaggaaatggggtcattttgtcacccaagctggagtgcagtggcacgatgacgactcactgcagcctcgacctcctaggctcaagtgatcctcccacctaagcctcctgagtagctgggattacaggcatgcaccaccacgcccagatacttaaaattttttttgtagagatgggggtctcactgtgctgtgttgtctacgctgctctcgacctcctaggctccagtgatcctcctgccttggcctccaaagtgctggaattacaagtgtgagccaccaagcccggccattttttttttttttttttagagacagggtccagtcacccaggctggagtatagtggagtgatcctggctcactgtagccttgacctccttgggtcaagtgactcttcttcctcagcctcccaagtagctgggactacaggtacctgtagcaccacacccagctattaaaaacatttttttccagctgggtgaggtggctcacgcctgtaatcccagcactttgggaggccaaggcgggtggatcacgaggtcaagagatcgagatcatcctggccaacatagtgaaaccccgtctctactaaaaatataaaaattagctggatgtggtggtgcacacctgtagtcccagctacttgggaggctgaggcaggagaattgcttgaacctgggaggcggaggttgcggtgagccgagattgcgccactgcacgccagcctggtgacagagcaagactccgtctcaaaacaaaacaaaaaaccaacattttttccccaggctcagtgatggctcatgcctgtaatcccagaactttgggaggtagagattggtggattgcttgagcctaggagtttgaggccaacctgggcaaaaaatacaaaaaattacaaaaacacaaaaattagccaggcatggtggcacacacctgtggtcccagctactcaggaggcagaggtgggaggatcgcctgaaccctggagaccaagtggcagtaagccgcgattgtgccactgcactccatacagagtcagaccctgtctcaaaaaaaaaaaaattttctttttttttttggtagagcctccctatgttgcccaggctgggctcaagtgatcttcctgccttagcctcccaaagttctgaaattacagctgtgagccactgtgcctagctacaatgaataattttaaaagcgtattccaagtagtacatgtgacatccttttttttttttttttttttgagggcgacagagtctctctctgtcatccagcctggagggcagtgagtggcacaatctccccggctcaagcgatcctcctgcctcatccttccgagtagctgggactacaggcaagaaccaccaagcctggttaatttttttttttttttttttttttgagacagagtttcactcttgttgcccaggctggagtgcaatagcgcaatctcggctcactaaaacatctgcctcctgggttcaagtcattcgcctgcctcagcctcccaagtagctggaattataggcatgcgccaccgtgcctggataattttgtatttttagtagagacagggtttctccatgttggccaggctggtctcgaactcctgacctcaggtgacccacccacctcggcctcccaaagtgctgggattacaggcgtgagccaccgcgcctggctaattttgtaatttttgtagagatggggtttcaccacattggccgggctggtctcaaactcctgacctcaagtgatctgcctgcctcagcctcccaatgttctgggattataggcatgagctaccacacctggccaggacatagttttgtttttttggtttttgtttgtttgtttgttttgtttttttttattttgagatgaagtctcactcttgttgccctggctggagagcaatggctcaatctcggctcactaaaacatccacctcctgagttcaagcgattctcctgtgtcagcctcccagataactgggattacaggcatataccaccatgcctggctaatttttttgtatttttagtagagacagggtttcaccatgttggccaggctggtcttgagctcctgacctcaaacgatccacctgcctaggcctcccaagtgctgggattacaggcatgagccactacatccagcctaatctcattaggtttttacagtggggtaggggttatggttcccattttacagaactggcagtggagggtcagagaaaggaatgaggtgaatttcctgaggtcacagggctaggaagggaccccagctctgcctgcttccgggtccattctcttccctcagtgggaaggaattttgatgttggggtgggtggcagtccccgagacagtgtctccccttccctactttcctgcagggcgtggacgagtggatgtggccagcctggctgtggggctgacaggtggcatcctgctcattgtcctggccggcctgggagccttttggtatctgcgctggcgacagcaccgaggccagcagccctgtccccaagagtaagggggcttcagcgaggagggggtggtggtggagagcaggggagggaggaagcattgacctaaagggatgtgctaaggattgggggcaggcaggcactgatgaaagacctaaggacacagtcatttggagagtgagtctgtgagctggcttgtgtctggttttggcgactgtcgctctgtctggatcctcagtacctggcccgcagtaggagctctgaccacttttgctgccagcctgtctttgcggtactgagattaccagtatccgtggaattacgactctggatattgtatctggtgaggctgcgacggtgcagcctgtggtgtcttggtgtctgtggtatgtcagtttcagtggtaacaggtgcagcacctgagtgggtgtgggaaattggtgaggagtgcgtctgtgttgtgttcctgtctatatggatgggctgagttctgtctgtttggtgtgtgttggcctgcctctctacagggctgtctttttttttttttttttttttgagatggagtttcactctcattgcccaggctggagtgcaatggcatgatcttggctcactgcaacctctgcctcccgggttcaagtgattctcctgcctcagcctccagtgtagctgggattataggcgcactccactacgcccagctaattttgtatttttagtagagatgggtttctctatgttggtcaggctggtttcgaactcctgacctcaggtgatctgcccgccttggcctcccaaagtgctgggattacaggtgtgagccaccacgcctggcccttttttttttttttttttttaaaaaaagacaaagtctcactctgttgcccatgttggagtgcagtggccggttcacagttcactgcagcctcaatttcctgggctcaagaaatcctcccacctcagcctcctgaggaactagagctacaggtgtgcgccatgcacccggcagggctgtctttttctctattgctctgcctgtatctggtgcacatgagtgtgtctgaataagagtgtgtctctgtggttgctgatttctgtgtctacctgtctgtgtgcagctgcctgtcatttgaggcgcttttctgtgtgtaaggctaggctgaaggtgaccctccttttctgaagtccacctcccttccagctctgtcccagtgtcaccctgagtctccgtctcctagatcccctctcttcctccctagtctaggtatcctgtaagttgcctctgctaactgtacctttgctgtccccagggccgggctcattagccctctgagtcctttgaaccctctgggcccaccgacgcccctgcctccacccccacccccacccccaggcctccccacctatgagcaggcgctggcagcctctggggtacacgacgcacctccacccccctacaccaggtatggggcgtggcttctgcccgggggcggggcgcagaggggtgggcacgttggaggaggaacctgggctcaggggcgggacttggaatttgggccttcttacctggggcggggcttggagtgcgggggcggggccccatgcaatggtctaggggcgtggcccagcgttgtatgtgtggagccgtataggagggtggggcctgtgcccagagggtcctggattggctgagacgccaagggcggtcggagtggtcctggttgaaggggggagaaaaacagccagatctttgactccctagtgtgcctttcctcttgcagcctcaggaggcctcactgaagagctgctttcgagacccggctctccgaaccgtgcccctgattcataccggattccggaagccgctaggcctcatagacgccgaagctggacttggagtggggaatggtgggagtaggggtcatccggcccgaggcctgccctggcacacgcgtttccgccgcgtatggatatacacatgttttcggcaacgtgttcccgtgtcctggcccctcacgggcccccacactctcctgaccgtgagggcactggtcagttccgcccccgtggtaggcagacgcgcggggaaattcggacccaggagcccagccccggctgtgccatcttgtgtatgggcagatatgacctgacagccccctccagtgccacagggtacgcacacgcagagccccgcctgtgcacacgcgtgtcttcgtgcactccccgtgcggtacaggggcacttcgtaacccagggaaagggcggggggcatatttgcaagcgcgctcggtgcgggcaggctcgcattgcacccagggagctggagttgagctgttcccctaaataaaaacccttcggaaaggagaccaaaaaaagcagaaataatgcaaaaaataataatgaaatgaactgcgatcccgggcgcatcggaactggttttctgtgcaaacgcgccctacacccccaggccctgctcgcgctcagtctctctctcactctccctttttttttttttttttttgcatttgcacgggattgtgggaggaagcggagcgcagccagacaccccgccgcccgcccccccttccccttccccctcccccagccgccttgtgcaaagatggctgcaccgtgagcgcagaggaggaggaggcggcggcggcggcggcgagagagcgagcacccagcgcctgcacccaccccggggccgcccgggacgccccctcccgagcgcgcgcccccccttttctctcgcaagcgccggggcaaaggcggagacagcggggtccctcctccccccttccctcctctagggggaaccccccttcccccttccttggctcagcgactgcaccccctcccttgcccgcccctccgcccctgccccctccctcccccgcccggggccttcccgcggttcggcggctgcaaagaaaaaaagagagagagaaaaggggggaaaaaaaagcagcagcggagggagcggcggcggaggagacggcgcgcgccccctccctccctccctccctccccctccccccaatttccaccgcggccaattcatggacaggaactaccccagcgccggcttcggggacccgctcggcgccggggcgggatggagttacgagaggtcagcgaaagctaggtaaggagctgagggtggcctagagaagggggccaaggggtgggagcccagccgggccgggccgggccgggccgggcccgcccggcgacgcgtgcatcgcaaactcccctccggcttgcaagggagcggccttcctcggtttgtaacaacgccgccgccccagtttgcaaattgcaaactccgccaaagccagctccggcatgcaaagggagaattgcagcgggaaaatgggggtgcaaaacaatttcggacgggaaggccttgggaaggtgggagggactggcgaagcaaggcctggacttccccccatccttggattcccggcttggtgacccctcccccccgcgccccaggcactgctcttgcaaaggtgggaagaagagaagaattagaacgcagatctggggggcgcgaaccccctctcaggtcctattgttccgggactgtgcgaggccgcgccactaggcgcccccccaagaattccgcgcgcagagtgggcacggggccccgcccccttcctaagctggggttgtgtgtgtgtaagggagggggtcaggcgtctgggacacgccccctttaatgcccccacccccaaaggcagagaatcctagttgatcgcaaggagtggagcgtttgccctcttgagtctggccacggactggtgccgttgcatgggaagagtcggatgtttcccgggtgtgtgtttgtgtgtctgagcgtgggccctgtgcgtgcgtggctggcagcgtgttcacctgtgaatctgcccctttcctgttgcttattggtgtggcgccctcacacttcacctatccccagcacctcccccccaacacacctggatttcccagcagggcataaccccaagtgtgtcaggattttccgtgtgggattcctccgtctatatcttttcttccccacgggtgagttggatacccgtttgcacacatacctggcattgcatgggcccatgcatttgaacctcaacccccggggatggtcggtgttcttgttcacacttgtacctggtactttccccaggtcttattccctcttctctccaccccccaaaccgttgccgcttgggaaccgatcttcctcctgctcccaacttgttctgcaccaccccatgaagttcagggcctatgtgttcccgtgtgtctacggaagaggaggcgtccatgtggacctctggcgttggcc

SEQ ID NO: 13248 - DNA, 12313 bp, Human
atcacatatctcaattttcacattaacaactaatatccatgttatatatttaagatgaatttccattaattcttctcccccttttttctaattaattagggatcaattttgtcaacatattgaagaaatcatctgaggaaaataagaatcacatttcctttttactattagactgctatcacacattttaaaagatcattctttgtatttgcaattcaaaagcagagaaaacaactaatttaattatcatgcaaagtatatataattttcccgatttgttaatcaaagtggctttaagaggattctgtcacaaagatgctctgatagtaacaggaaagtaagcacaaatcctcactgagactctgttaagtgaaaaccaagtgtttcaagcttccattgctccccctaatggtaggaaagcagaaaacatctagacgtatgtatttcacatttgtcaactaaatactttacagaaaccttcctccatgtgagtatgttcaatattgtgttttatgtaagttcagaaaacaaactaaaagtaataaatatatcagttattattaaatttctggtattatatgaaagactccttgctattctaagtaattattaaatgtttggatttaatcgctttgcttaagttttgggtaaaggtgaaaaagttaaactcatagattgtataatataaatcaattatctataggaaccaatcctattttttctcaactgttactacatgattgatttatttaaaaattaaacaagactcagacaactttacattcaaatattcacatctctaacagcactgacttgtcaaattaccccatgtatcttgaaatgcttactacaagaagaaagttttactctaaaaggcattttgaacaattttcttttgagaactcagacaaagaatgggtatcagtgtaactcatgaaatacatgaagactatcatagaaaagtgactttggtgaatggtggttatttaggattgtctcctttccaaaagtacaatctctttttttatggtgaaaagagtattataacagggaaagaaagccgatgcaatagtaaaaactgttgagaagggaattatacaaagagtgagacatggcatcaagaatgaattcaaaaagagcagaaaaatataggcataaaaagagataatgtacagaaaaaaagtcagtgatacaacaacacaaatttttacctgctagaatgtaagtaatttagagctggattttataaacatgaaattgtttttctaatacattcaaccaaaagtcagcacacatagttcagtcatctctcattacttacaataaaatattttctatttgttaggaaataatatcttattccctggatctattatttctttttattgattttctttctattctctaaacttaattgcttaatttttataactgattctctgtctctattccatcttattccagcatggattatttaaaacctgtattagttttggaaccactaaacatttgctcagaagtttgaattaccagagaagcaccctaactcttcaagaacttccaagcctaaggaatcactgatttcatgcattcatcctggagattttccttaaaaattagaaataacagatctcatgtttcacaaaatcaaaatgacaacttttggagtgggggaatgagaagtgggaaaaggatgatactgggggttctttgtcagtatgctgtatgtatgctgtatgtcagtgcagttgaatgactccttctgtgcgtcagaaatccaaagcagcagcagcagcaattagggaagatcgtcactttcactcaaggttcagaaatgggggaggagagcaggggggacaaaggaaaaggggaggagaaagcagggcaaagaggggagggatggaggtgaagatagggcacatcctgcaaagataatgtctgtacaatcaatgacatcatcctcctgcttatatatataggggaatggccagagcacctctcatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcaggtaagcaaaacagaatttcacaactccctgaagtgatttcttttttctcttttgcagtgtgttgctacttatgttaatgtatctggggagaagagttgctcccttttattcaggatttaccttttagtgacagaaactgagtatctctttctctgcctttatgattactgagagatgtattttctcttttaaaatctgcaaagcaataaaagggatttcaatgaaacactgcacgacctcctttggaattcaacaactagagggaaaaaaaccctacaaaactttcaattaggctgatcattatctaatgagaaatacagaggcagtggctgtcaacctgcaaacccatcattaaatcccattccattcaaaatgttttactctcatcctcattcattctcttaggaagcggtggccctcacgcccttgtaatagtccccgtattattttcttgtttgtgttaagataacaaataaagtgaaaattgatacttagtgaaaaatgaagcattatttgtagaaaattatttctagaaaaatacaaaaatattccagatcctttttgagaacagaatttgcatagtctaataagtgtgctattaatataactgtttggcattttttccatgccatttaagttaatacaaaatacaattggaaaattggtattcttatattgatggaaattatttgactttagagtgttttgcatgtggtttgaaagaagttatatagtcctaagtatctacgaataactcactttgaaaataagacttaaattgaaaggtataacatgaaatattacaaccattgcaaaaggctctacttaatatttaagaaatattacaatgaacacttcaaagggaaaagaacacattaggaagcaaatgcagcaaaaataatttaacctgttctgtgcttttatgtatcataaatatgacatggaaatgtttaactcaaactcatgctatcatttgatttaaattatgaaattaaaatctaagaagatataaatgtgatttatacaaaattttaaatttattttaatcatcagaacataactttcagcttctactttttaaatcttatgagaaaaaacaaacttttctataattatgattttatctgaaagttatatgagattaaagattcacatacttctggaagaaaaactgggttattgattaagcactgtgtttattaacttgaaactacttgttgtaataatgcaatagttataaggattttggtatacattgttcataaattcctaaaacagattatgtctctaacaaatagtgagaaaagatctcttgtataatttaggttctaggtaaaattaagccaatgggttctccaattgtggcatttctttttactgagtgtgtagtacaaggaagatagagtcatttttaactttatttttattattgtatagtattttccaaattttccttctctgtaaaatattcattaacagaaacttggatagagttttttaaaaatccagagatccattttcaatgctgttgtacatgtgttgttgaacagctccacttttgctttaaacaatttccttaaatgcctatgaaaaaattaaggatacataattttgaattctcttaaagtacaatacaattctttcaacgtgtgttttgtaaaaaacatctcaagttaagtaaacctcagtatctttattattctaaaattatcagtaagcaattccctttggttttgtcttgaaaaagtctcttgtatagtcttcattatgttgtgtttttaaatgttaatatgcatattttctatatatgtaaactgtggctggtaagaaataagctactctagcatatttggtaaaatatgtgttatacaatgtaatcacatttttaaagcctgaaattcaaagattaaacaactcccagtgatcaatagctgtctgaaaaataatcatatgcttattttcttagaagtgcttctactattttagcttcctattatgctaaagtataactataatttgttttttaggattactatttttaagaaaatacataagaaagacactaacctctaagatttttttttagattaacctaaaatctgtagattatgatataattatatgatatgtaattatagtaaacctgattttgattttactcagattcagaagaggaaatgaaagcattagaagcagatttcttgaccaatatgcatacatcaaaggtaactttttcttttctttaaccctgagttgaagaacatatgaactttcattataaacatggtatccttttcccatagtaataacttctcatcaagattgaaaagttccttgagaggcatttcctttttgaaaaaaaaaatttcttttagttaaaagaagttaaaggtgttgatatgacaggcaaagaaattataattctatcaatcagcatgttgcaattttaattaattgccacacatatttacttgcctgtaaatgtttttaaaggaacttgcttccatgccttttacattgggtatgatgaaaggtatattggtctcaagttaaatgaaaacaaagtgagctctttgccttttttattatattgggggaaacaaaaaggtgttcctaaattagaaataaaagttcatgacaacctgcaaaagaaatgtagtatagaggggatagcaatggactggtaagcaggagcattgagatctaatcctgaaacagtgacttattaaatattttatctttagcaagtggattagttcaccttgcttacctgtgtttccttgtttttaaatgcagggattgcagttcgtaatcttctagacatttaccgttctacaatgtatttaggaattactaaactgtactcttcattgtatgtctggatttaaattctccctataacaaacatgttatttttacatgttctttttttttttttttttaattgagccaaatacaactttgtatcctgggccctattactcctctattggggtcttgaaagccagtttttaaaattccaatctgtacctaggaatacgttctggggtacatgggcaggatgtgcaggtttgttagataggcaaacatatgccttggtggttttctgcacctatcaacccatcacctaggtattaagcctagcatgcattagcccttcctcctccactccaccctctgacaggccccggtgtgggttgttccccttcctgtgcccatgtgttctcattgtttagtactcaatcagaataccaatggctacaacctcttcagttcaaaaatagacaactgaagttaatagtccgtgttagaaaatgggataagttaggtgtcttggtgtcttggtataggtttacctaattcccagatgcaagttaatacatgaaggttctatataatctgtgatgctacccataacaattattaatgtgtggaatgcattactagcctcatactttgtaattgtccacatttaataataccatctttgtcactgctccattacatgttaagctgaaatgtaatagagacagaataattttttatttttaatttttcatctgtgatatatatatcatttatatatttctgccatcattttaatttccttgctttcttactttgctctgtgtgtacacacataagtgcatgtatatgtgaatataactattgcattttattaaacagaagttatgagatattggcagtatacaactttgtgaactgatgttactaaataaataacactatatttattagactggagtagcaattagaccctaaatgtgatggtttagcacactaggaattcatttcttgctcatgtaacacaagttttaattgcaggggtttttttaatatatttcagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggtatagcaataacaaaatattaatatgattatagttacactagttagctctcatttatattaatttcttaaattcccaatcataatcataacaagaagagttacaagtattgaagaagaacaagccatgttttgaagtcaacattgcttcagatcttcaaagtgtccttcaaatatttgaaactcagcaaaatatgtttttcttcaatattaaaaagaggatatatcttaaggcagatttgatccacatgtttttattatgcttaagtggatggcatgtttagacaatttttgttgttgtaggtggtggcatgtctaacaaatttaagcaactcaaaatgttgtcttagaaacacaaagtcatatgtagtgatctataaacaaacacagaatataaagtttccaagtaaaactggaataaaacataaatatttgtatttaaatatattaggcaaataaaaatatatttttatgtacataaaatatatttttatgtatattttaatgtacataaaatatatttttatgtatattttatgtacgtaaaatatatttttatgtatattttatgtacgtaaaatatatttttatgtatattttatgtacgtaaaatatattttatgtatattttatgtacgtaaaatatattttatgtatattttatgtacgtaaaatatattttatgtatattttatgtacgtaaaatatattttatgtatattttatgtacgtaaaatatatttttatatatattttatgtacgtaaaatatatttatatatatattttatgtatgtaaaatatatttatatatatattttatgtatattcttatgtatattttatgtatataaaatatattttatgtatattttatgtatataaaatatattttatgtatattttatgtatataaaatatattttatgtatattcttatgtatattcttatgtatataaaacatattcttatgtatataaaatatattttatgtatcttttatgtacataaaatatatcttatgtatattttatgtatataaaatatattttttgtatattttatgtatattttatgtatataaaatatattttttgtatattttatgtatattttatgtatataaaatatattttttgtatattttatgtatataaaatatattttttgtatattttatgtatataaaatatattttttgtatattttatgtatataaaatatattttttgtatatttttgtatataaaatatattttttgtatatttttgtatataaaatatatttttatgtatattttatgtatataaaatatatttttatgtatatttacatatatttaaaatatatataaataaaatatataaaaatatattttatgtatataaaaatatagaataaggatatattaggttagtgcaaaagtaattgcagtttttaccatcaaaagtaatggcaagaaccgtaattactttcgcaccaacctaatatatccctattattccagttttatctggaaccttttgtatttgaatatattaggaaaataaaaatattttttaatttatataaaggtatatatagtaaggatatatatccccatcatttcagtttatttggaaacctttcggttctgtgtttgtttataaatacacacaaaacttagtgtgtaataatgtacttgcaaaatgctttacaatttattgtcttcaatgatatattttgctctgaaagataaattacagctttggaaagatatagaacaatgtcaggataaagaagagaagggggaagaaaaataaattctttaacaaaatcaaaacaaatttttaaaaattttcgacaagggaaacatttctttcaaattaacctctaagagaaacttggtcaatattttatattctggatttacactaacattggggatctgagggtgtcttccctgctaatttaacaaacttgcgattgactaccaaagagctaccctgtggataagaagaagtgcaggcagaatttctagtgtttattataactggtaagcaaaaagataatttctaaacaaaaaactgaaaagaccagtttttaatttactattgattatttaattaaattcctggtaaattgtttagtatttaaaatatgttttggccaggcacggtggctcacgcctgtaatcccagcactttgggaggccgagacgggcggatcacgaggtcaagagatggagaccatcccggctaacacggtgaaaccccgtctctactaaaaatacaaaaaattagccgggcgtagtggccggcgcctgtagtcccagctactggggaggctgaggcaggagaatggcctgaacccgagaggtggagcttgcagtgagctgagatcacggcactgcactccagcctgggcgacagagcgagactccatctcgagcaaacaaacaaaaagtttaaggtcaaagaaacttgaaaaatacatattttgatataggaagatgtccattatatgttatttatccaaaaaaacctcagtaaactattatgtagaccaatcaagtgcaaataagattaaaacttttccctattttaaatgttattgagtgatttaaaataaaatgataatttctgagcatagtacaagtaattacagactatgcacaaaaaaactaaagattaagaaactagattgtctgacagtagctgttttttctcctctgaaattgaatagctgtgagttgaaataaaatacttggttgtaagattttattcatatgcattgcaatttaaaacttagtcccctatcagtatttgttatagtgacccctcaaattagaagacaaccaaaaatacaaagaaaatttttatctttaacatatttttaaagtttctgtaaattgtatattaaactctggacagatttcttaaatggtaactgaaatttttgagtcagagccatattcttagaaaaaaaattatgcttaatgttagaatggggcatactcctgcctcatgattttaggcaagattctacatggtgcttaactcccttaagttattgaatctgagcttgctttagtgactaagcaccagcatctaaagagatcgttatcatttaaacagagctttcccatatgttgatttctacaactgacgaagttggataaagcaactttcatccctctattgagaattagatccttggaatggttttcatgtcaaatcagtaactgacttaattgaatataacattttgttacctttgtggccaaacttggtttaccagatcaaaaactatatttattgtaatatattatatatttcatccttttggtgtttccatcataaattgaagcctgaaaagtactcaaaggtctatttgatgcttttcttcaaagggctggattagtgtacggccttgaaatatatagttagtaaagtttatagaaattttttaaaagagctagcctggtgaactaggaagaatactgaactgagtcagaattaccatgttcttatactatttcagccactgaatggccgtctctcctttgaaaaaacaatttctttgaacttcatgtatctcgtatctcacctacatatgtcttgctgtcttaacagcaaatgagatagaatgtagaaaaatgctctgaaacaaaagagtttattcatgtaagtttcacttattttatctctatcttgcagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcatatgtttctctacagatttagttctttatagaggtactttttatataatttttccccttttgcattttgatctagtaaataatagttttacttttaacttcactgagatatttgtgtgactaacatttttctcaattgggaggacatatttgaggcaaaagctatgcttgaaataacacctttaaattttctttaagatcacacatacggtgtctgaagccctcaaagcctttgcaagtcatcattagtagtgactttcttgactctttcttttatagtggtctaggaagtcctctcctcacaaggctgcaacttatcccacagtcatctatgcaggataaatcagatcttgagttgttctagtattaagaagcctttacaactccatatccctttgagaatattgtccctccctgaggattaatattactcttgaaagaagttaaatctatagatctctgagattttcttgtaaaatcacaacttctcattactactaccccaccatctcttaccatcccattagtctcataattgaaagtgcccaaagtcctgcttataagaaggaagctatttcataatgattaaaagtgtcttctctgcagctagaatgcctagattcagctccattacgcactaagcagtattggacaacttacttagcctccttgtttattgaatcataaaatgtagacaacaatcaggtttgcaggaggatgatatgagctgatatatatatatatatatatacatataaaatgcttagaatgatgccttgaatatattaataacacactaacagttattagtagtaacagtagtgccaactttcccataagaaagtactcatcagatgatatacttccctgtttacttcattagttaacaaaagttcaaatctactaggtcatacatcatcatcaaaactctgttctaagccaacacccactcttttccaaccctttaaatcctttcattggttattctatgaaattcatggtcattgttttcttaatagctttttcaatgcctgactgacttttacaatatgtggtaacattatctggaagtgaggtatgtattctggtcactactataccatttttcctttcccttttaaaaactatggattatttgaaatatagggcataagacaatttcatctactgtgttttgaataattattgttctctcagtttctgaacatcttcacctccaataacgaacatttaaccttttcatatcaaccagtcacttccatggtcatatcacagaacacttcactaccaataaattcattcttttcaaaatctcattttcaagcactctattctggaaacatcatcttgtttctccagttcacataagctagtactctcactacagcatctatgattctgcccaacccattgtcccacgtctttttactcttcgtcttctaattatgaccttatcttcctctttagttagcttactttgctccaaaattaaaatgactcccttgttaccctcaaccctctgtgttaaatcatataagtttctcaaaacattagcagttaaacttaaatc

SEQ ID NO: 13249 - DNA, 264304 bp, Human
ataccagcttcagcagttttaggtgatattaaccctttcaatacaaaacagtcttactgttcgaatacatatttcaaaattgatttaatatttttagttagtcatggctcaagaatgtttcactcagatccttatttttttcctttaataaaaatgcttctcactgtgccgtgcatatttccataaaagtcagcaagttaatttatggcttaaaaaaagaaaataaaaggtctatatttaatatgtgaatacattttacagtggaaattggtggtggacagtattaaatgactccagtgtggaaatatgcaggtggtcattagtagctgactatgagatttactgaagattttgatattaattttcccggcatgcagtactatatataaatctaactctgttctcaaattaatttaaatggatgataacatatgaataactccaggcatatgaggctcattgtcttctctctcctttaggaaatatattgtttgcctcattgtgaaactgtattttgactactttttcacctgactagtttctctattgcaaaagaattattggttttctactcataaagagtgtatgggaaacggtaccaaaatacttctggaataaatgtgctacaaaaaaaaaatcacatatctgcttgactaggtatattaaataaagaccatagagaaaaaggaataaggttctaaaagcacctacttcagttttaatttttttaaatgattggctttttcacttctgataatagtatgtttggaaaatatacccatcttttctctaaaaagatgcaagaatcatttagtgaaaaatattttggaggaaattacttcatcttcggctctcagattcatgattgtacctaagattctaattttaatcattttgtagtttggaaaaggaaagatgcttctccttttagcacaaaattactttaaactgactttcaccagaggaaaaacatgccacttaaagtcacccaactgaagaaaatgaagtccaaacgcccaagaaatgtttactttgtttttaacacctactatactttgaatcctgtcatggtaatgttttatgcattgttgatctttagaagtcaaaaaaaaaaaaaaaagctcaatccagtgaactttatgttgaggcaatttctcttaataatgagagtatatggagatgtaaagtaggtaaaaaagaatgtcacgcttaattcagagttccttatctgctactaaaacccaaactgcatgtattaatcttgcagcatttgaataatgttcccattttgtctgttttgtggtacccccttaaagcacccattgagtttctggcttctctttagctcagaaaaccatagcaacctcagtccgcacttctccaactcaggatagagttcaagttgttctcctcaagccttcttgccgtgaaaatcgtggggaatcctgatcaccaactaggtgtcctaagacttcttgccacagataaagggcgggggagggggcgcacacgcacacacacatcctgcgtcgtttaattgggagagagaagggaaagtaacaacagaaaaggtaaaaggactttgagagttctttaaattgtttctgttagcatctctgagtgtctggggaacgtcggtttggcggccacgcactgccccccacctgccccccactaccccaaggtaagtcctcgtctttatcacattattcctaacgcgttcggatttttcctccttttccagcccgcacgttcacagacgggaggtgggggagggaggaggggggagaggcggggcgggaaggtagccgggtccctgcaccgcgccgctctcatttgcggcgctccgactcgggcgaagttctcgcgcagccggctcgccgcggccggggccggtcccggcgggcggcggcggcgggtgctcggagccgggcggggcggcggcggcggcgcggggacgcgcgctgtctctttaagggagctcggtctggggtggcgctttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggatgcaggaaagacctttttctctcccccccgcaataatccaagatcaactctgcaaacaacagaagacggttcatggctttggccgccgcgccaccatctttcgggctgccgagggtgttcttgacgattaatcaacaggtaaggaggggaggcccgagcgggccgcggggccgggggctgcggggggcgcggggggcgcgggcgcccctcggccgggcccggggcgccgcgacgcgagtgcagcgcccgctcgtgtgcgcgcaaaatgtgggcgatcgcgagcggggagccctgggaattaaaagtgactttctttgaaaaaaaaaaaaaaaaaaaaaaaagcagagggagagtgtgcagaaagccaagcgcaggcttctcgggtttcacatgcattttctttcttcctttttgagcgtgtgatttctttctttctttcttctcttctgctccctttttcccccttcctctcctccttttggtgggtctgaggcatctgagctttggaaaccagcgacttcaaactgcagtagcccctggagtcagcagggtcaagttcagccgccggggaggaggaaaaacaaatccccatttgccaaaaaaagaagtttcaggccggtgccccctccccctcgcagccccactccccctcgctgtctctttctggctgattttaattctctcctaccgggcgcagcggaggagctggaggtggttggacccgaggggccgccgccgccgccgccactgcaagttttctgggggctcgtgacaagcggggcgcagactaggcaccagcatgcagagtagtaagttgggcgaactcgggagggtcgggagggtctcagagacgggcctccgtatggtctccaaagtgggaaaacagcacaggactgcctttggctttgaagagtttgcaaatgcaggcttcaaacttttttcccttaaaggcccagctgggctctggagaaggcgggtgtcgcatcccttggtgcacccgcctcagagcggctcaggacagcttggccgagcggtctgtgccctgtccgtaccatgtggcagggccttgcagcccgggcgcttccgtaggggctgaggaaggggcagacttcctctgcgatgcggttgatgcgccatgtgtcgcgcgggtcaggggacactggccggtgattaaatgcctgacagcggtgggacatccaagcggacagacgctttgccttctgtctggttcctgtttgggatctagagaaacgcatctttgaaaggccaaggcaaacatcgctgtccctccaaataactccaggattataggaccccaggaataatttgagggtgaggcggcggtgggagctgtttgaagtgtaaagctgtttttgtggctgggaaagctttttcgttagtacctgtctgagatggtggtgtttccccctttccccagggaagtcagcaactgttttatggccccaggactctaaagcaatttaagttagagggtgagaaggactggtgggtttcagagggaatcttggacttattaaattttaggaccggctttacttccctctatctttttaggcctcatatttgatgctttgaaagttttttgagtaagccattgatcttaatgatgaatctaaattatgatagaatattcattcttatgccattttggaaaatcacggctagagtttaagcgaggtaagtgaagtgagaagctcagcggaggagttaaatctgagacaagttaggcctattcattgaacttttgtagattcattgaacttttgtaaacacaccaggtgaacaggaaaggaaagggtctgggagagataataagtacaaaagaaaaatacagatagggcctgagacaaaattacaaagaaatgataactctgggcctggttgttggctaaaacttgattgttcaaagcaaaaataaaataggaaccttccaacaattcttcaaagtcctccagctctgaagctaaaacctatggatcttgctggcatcatgttactttcctgctggttttagaaaaagttgatcatttagaaaaggctgccagagttaaaaatgcaagggacagcagaggaaagtcatgcgggcagccagttcttgacgtggacaaaatgagaatgaaagtttctgaactcactgttgtgaagttttacatgccgctcatttgcttagaaggctctctcagatattccaccagttaacgtataaaagcaaacaggatctaaaatcgtgtgggcttttttttttttctttccccaagtatgccagggttgtgaataaatacagggtttgtatgggaagatgaagcgtttcctgtaagttctgatgctgacaggacagtctggaaatgataccaacattttgaggattttttttttttacctttaagtgaaagtttattaatgatatgcttaatcttaacaagtcaaacatattcttagagtttctctctccttggatttcataacttccttttaaagctacacctttggataaaaacatctctagattcagttcaatatacagggctagtaacatgctaaagtttgacgattatttctggatgttaataatgtgaaaataaaactcctgaggggcaaatagagccttaatgccaacattataacttgatttctctgaatgtgaggccttctgaagcttcattagtactctgttggcgaagtattatttaccactggcgagctgatgtttatggcttcctgatatgtatgttatatgttaggatatatatgtgtagactgcttttccatacataatacctaagtctaacacttttcaaataagtggtggaaagtagcaagttactaacacaaagtttgtcactcctttgaattctagatgctgtaagggtctgtgctactatttaggttttgtcctttgtctcttaaaggtaacgttaaaggtaaggagaaaaatgtcataatagctgtgaagtctgagctgaatttagaacttagcatttcgatgactaatattttaaatgattttataaaattttctgcatacgtgtttgaaaaccagtttaggatcggaatcagtgtgctaatccgaaataagttacacatactactaccatattttcagtattatttaagtcacctaccactcctgagtttattctgatttacatcatatagatctcttcctataaggaaatattcattcataaggaagacctttaaaacagggaaatgcatgcatctgtagaaaagcagcttttacgattctagtatttcagtgacggttctattatcactactattattagatgtatatgtgtatgtgtgtacagacatacaacccacaatatgtgattaatgatgtgtacatttttattaagaaagcaaccaaagactgtagatttttataaacgcttgtcttaccttctttgttgtaaataaacattactgaaagtttccagaggacttgcagcaaattgtttttgaactagaactttattccaaatttgaaattggaataaatgctgataactgacctttaaacatttttcataacatgaatattttagaataattatattttaacttcagttcttcttttgatagcaacaataatgtaacaacactatgctattacgtgtacaacaacacagactttaagaaagttatgggcaggtgtctataattgatttaaaggaaagattatttttgtaataagtgatgaacttaaaatgactggcttacattaaaacatattcttattaagatttctctggtgtgtaaaatgaagccattcattcaacaggctgacaactttccacttggtatttgcctttccttaatttagtttccgcaggacagctagtgtggtagtctgcatctgtttttagcaggcatagaaaactataaactcagacagttctgtcccaaatattgcagctcacaagttacaatcaatttgataaaaacccgcaagttttatgggctcgtattttgttgttcatccttgctaggtcaagctttcaggtaataggtttctttttctccctcttttgctgatgataactgctaataccattgataactaattctgagtcttgtttactcatttatcatccttatttaccatttgttgaagttttgggaaattaatgacagcatacgtagacttgcgtttactttgatggcttatctgtgaaaatgacatttatcttttgttattatacagaaataagtaaattctttgttaccataatagttatgatttatggaatttttgagtcccccttagatatagcataaagatggtcttctagcctttgccaagtagacatttaatctaattgtttaagagtgcttgtcatgtatagaaaagactaacatactttgcaattatttacattaaaaattatgtagaggtttgttttagtgtaattttaaaaataatttgtctcccaaaagctgtaaccagtggattaaagtaaataagctaaaataccaaatcttgttttataccattgttctatagcaaacagtgctgcagaggatgtaactactttttaaaatttatcctccgatgtaagtagggccaaagtcatttgtttgtataaaatattctattaattatatatgacctttataaataatatcttcgattttattattatgatcactttttgagctatcacagtgctcagttgttctcctattcctgagaactgaatttggcctttagtttggttttctgatggacacaataatgtagaacttgactttggttagaaagagatctttgagcttcaggaatctctgaaggtgcagtaggatctacaggtgaaaaccatttgaattgttaagcattagttaggtgaagaaactctactggtccctgcagcatatagcagctattatcgtagcggtctactttttgctatcccagttttttttttttttttttttttccttttccaagagcacaaatccaaatagcaaaaatgaaggtgaaattatctatgtacttcaaatttggagcatcatttgaaatcattttctgattctaagctataactgaaatacaaatataacattaagacaccccaaagaagacattaaggatacacttgtcgttcttaagtgtgtttcactaaaaataataacaaaaaacttttaatttttaaaatgtttctagcttttaaaaacctgcagtaaatactttacaagtggctagacaccttccctggtggtttagtttatacaagcaggaaactttctctcctactctttctctctctctttcttgttttctttaaaccaactgacgtaatgccaaactttgctttaaaagaacagacagaagtaattggtagcttttaacttttaataatgttctggattggttttagtggccaaaatgccatttaaaaaaaaaaaaaagttcaagtaagaacgggcttgtggcctgaggaagaaaggctctgttgatgcagttatttttattcttgtttttcaatctgttattaaaaatctttcctgctgagcactgctggatttctccaattgctctttgtgatggctggtgcatttcaggttaccgtaacttaaacagtttttgggttttggggaaagtgggtatttgcgttgcattatttctttcttatttggaaaaaaaatccatttgtttttgtttcaatggagattaattaattaaggttatcaatggccacaggtcaaagaatatgtttatataacgaatgcgacacctgttagcaagagcctaaaatgtggaagtttaaatgtgacattaatcatttttatgtgcagaggaaggaaaatagatgaaactttacgaaaatgcatttttagattgaaaacattaattttaagggtcagtgcgtttctacaggcagctctttttttcttacaattttagatgataattttttaaccctatttatcaaacagtatttatagtttccttttttttttttttttataaatagtcatttctttctctctgactttgcacaggcaaacagaactttctccagttaagagacatcttggtgatgttgattgacatcagggcaacttcagaagctggcaagtaggaaaatctttttagggggcaaaaagatttgtgctagtgttctcttccttgggaaaagacactccacccagaaattattgggtttagtggaaggccctccgccccattcggtggctcagaactaagtactgtttcgacttttcttttgtgaattgttcctgaggtttaaatcttacggttacttgtcgtggactttgcttttaacccaaattcttcctgatagattttttttttccttctttacctagagcacatttaaggaataatatatatagtgaaaattaagtgtcacacaaggaagagtacagtctttaaggcatttatgactataaaaagcattccgcaaatttggggcattgaagtgttctctgcttataaatttgacagttttgatttacttgatatgtttctcagtttttcttgcgagagttacagactctagttcaaatcgtaggcattccttttttgcttatggcttctttagttaaagatttgtttggaaaaactttaggaacttaatgtatatgttgttcacatcagcatagtgcaagtttcttggagtaagtctagattcattttatttattacaaagttttcaaacatacatttcatgttatggctgcatctgttaataaatttttatttaatgaattttgtttgttgcttcaaaaatgaggaaaagcaataaagtttagcaagaaggaaataaggcaaagggaggtgtttagagttgcagtcccttaatatcgcagattgtttactggtaagtggtggggaggggttggtgggaggttttgtggaagatgataccaaaaaaaaaaaaaaaaatccatcaattgcgcatatgctcccctccccttaaggtttacttaaacaatatgtttcgattttgccgcaaaccattctgcactacttctgctccaagaatccaccactatcttggttcctgagagattaaggatgatgttttctgttgtataatgaacagcagtattatttgaacaaaggtaacactttttgatttgtgtaattttttagtagcttgtcataggatacctataatatgagaggagttctagcaatgtaattgcctgcaaatgtttgaagtactcacgatagctttgctatgtttgaattattgccaatatatgtgcatgctattataggtgtgttttatatgtggaatgtatgtagaccgataatacttagacacatcttgatggtggaatttagaatgctaactattaactctgtgcttgaaatgtgaatcttttaaggagttaacatgacctacattatgaagtctaaaagtttgaaatgagtatggagtttaaacataatgaatcaattgttatcataatacttatatctgctctgaatttactaaggaatttttttaaatgaaaaaaattataaatcaaaatgccacctttcagtgtattgtaagaaatgcttctgagatcattttttaagtctcatttctgttaagaggagcagttaagggacaggactgtttgtgagtatatcactttatgggctaccactttatagtttacaattctatcatctcaaaacgttatgtagaaataatatggaacatgtaaagactctgtactatgacccaatgcatttttccctagggtgatggattctgtgcgtcacccaaatgtgatgctatttgccaggcttgtaatactggttttgagggttgatctatgtcctatttcatcaagcaacacaatacaacaactttggtatctagggtaattgacacagtcaaaatagtctctggaaaacattccatatacttttaagttaagtcagaagttaatgtacatattaaatttatttaacatgaataaacaaatgatttattgttagctatttgtctaatatactagatagtgttagaaggaaatatacaagtatttacagtttatgttccatttctttttttcttttttgaggggagcatggttctcttgtttgcgttcataatagctttatctgttaattactttgtattcatgatagtgagtagtatagtatcataaatcatagtaaacatgtttatattatctgctatatatgtcccaagcttggaaaaagcattaatattactagttgttaaattgagtattatagtaaccaggaatgaatccagtaccgtataagacaatagataagacatcaactgctatttaaacactaaaaataccttagctgtagaaaaagaaagatcaaaaggatttcagagctgtttttacttgtagaatttggacagaatgtataaagcttacaaatcaataaacattaataatataacatgtgcttcctgattagattctacaatacaatgtgaattgctatttcaatttctctacatatcatatggaagatcagatatgtttataaatagtgtaaaaatatatggcagaaattagtttgtggaatctaatttctctattacatgatacacttcatgtacaaagggatcaagcattactaatctagtgttagcttttgctctctgagctatgcagaagtggaatatatgaatttgtggcttcatattaaataagtgcgtacatgtacatgcaggatagctatagtctcacttgcttagaatgtttttacattacaggcactacatggaattttagcatattgcatattttttgaaatgactttagtctttgtaatgcccattttaattacttaatgcatcccaacacctatttgagggttaatttaattgtaattttggttctgaaatgagagcatgatagacaaaacaaattaaaaaccaaattctacttgtgcctactttgtgatgtcattatctgcacatcatctttagctttgcaagatgtggaaataaaatacatcagcccattttctctcaatactcttaagtagctctgaacatataaaagttcctaaaagaaagttttgcatttgtttttgctttgctttttgatgccaagttaagacaggtcatatatatattaattttaatcaaggcccatattactaaatttttcaatacatattcatctctttgttgtatgattcataattctttatcgattattttttgatatacctttgagatcttttaaaatgatatgttttacctgtgtttggctgctgaatttttatattagtaattatatttaaattataaattaaaaaatacggaatatgttaagctgtctttaaattaatattggaagtatacctttttagaagattattgcaaaatttgctcctcagttctgcaaacttagggaagttttagaaaataatttacaagtagtcagtaagtagttacacattcaaggattgaaaaatatgaaatactattttctgtagcttataaaccaacactaagagatgtttctcctttgtatttataatgcatttgaattacattatttggatgtatgatgtggtaaattactgtaagaaactcactgtcatctaaacctcaattataataaactattttactctatcccatcactgtttattctatttttaaagtcccgtttttaagaaaacttgtgcttttgaaggaatgccctcattatttataacatattttgctttttctttttactttgataagctttaagaaagctgccagtaagatgattttaggtcattggtaaaaataataatgtacacattttatgtgtaaatatgtgtacacaatcttgcaccttcactgtgtctaacattcagctttttagtgttatacatatttttattcaacattacacatatttgtgtacatttagtgttacacatatttgtatttagtgttacatgtatttgtgtacatttatgtacatcatgtactttttactcccagaataattcagtatatcactgttagcacataattatggacatacatattcttctcacttcctgaacgattcagtgtgtccttggcaatactaacactttaaaaatgagagtaataatgattagagctggagaactgggggtagatagtagtattagcaggtttccctccttttaatttttcccattttcagttccttctttaaaagagagatgtatatatatctgaacagaagggggactaggatactgtataatccatgataacataaggaacggttgctgcatatggctttatttatatatctctgacataaaaaactttgacccctttgcctgttgtacttgggaattttagataaaccccactggggtcacactcatcagttccggctttgcgtgactcaaggcattctctagcttctggtgcgctactgtgctgttttccttcaggagtggaaggtcctgtaagttcatttggcatttggaagcacaactagatttcttcctttttgaaaatcctctgactgggttacagaagagtaagcagagatcatgggcagcatgatgtcgttgattttaggatgctaaagaaaattatgctgagaccaagcatgcttcctctggcttattctgccctgctttatcatcatttttttctttttttcaacttcctacccctcttccccctacactgtttggggtctaatattttagtttctggaggagtaaggatttgccttctcagtggaaaaatgtgtaagctgcaggatttttacctacctttctttataacttttccattctggggacagtgtctaagaagaggaaaaagcttacatactttattttattttattttattgtttgctattgagtaggagtttgctattccatttctatgtggaaatgcgttgcatggaattaaataaagttgtataattttgaaacaattataagcaccaactgtgacatagttctggcttttaaaaaaagtcaattttagttatgcagtacttccaccaaactctctattccaagtttataaatgtgaatttgaccattcgaccatggatgatgcttgaaagtcatgttttctggatttagggcagaagaatacttgaaagattctcaccatcagtatgttttagattcccaagaggtacaatgccaagtgtcatgttatcaactctttgaggtctacagtaaggagtttacttgtttctggtagcttataaattcaataacatcagtcacaggcttcttaacgtatttatgagttgagctagtgtagttcaataaatgattgtacttccatcaagtcgagggagtaacgcaaactagaatagtagccatctattaaggatagttctgaggtttggaatttgtaactgatttttaggagctacgacatgaatatcatatcaggtagaaatactcagagtgatcaccttttatgaaagttagttctatctttcatgtctaggaaaatataacagtgaatgtttgctttttgtatgttttgtctccaagcagaggaaactgacagttttatgttttaagtgccgaaagttgtttttggctaggcagttccagagttaatcactgggatgttaacttgaatttttgtctttaaaatgttttagatttttaaaacgaaatatgcttccattatttccaaactgacaccttgtgttctggattagtttttagagaaatgttttccaaattctcttggattacttgaagtccattgattttgaaatatttagtttagtttttttcttttaaagcttatcagaaagtagaggaagtactttatcttttcggggttttcttattccagaaaccttgttattgcctgtaaaatgcaaatgaattttgcacttattttgttttattttctcttgtgttttcagaaatgttttgatgcatcagaaattgagagatcagtgatttcagttctcctgtcacacctttttatgataaaatattttggtcatttctaaggagtagttagagggaaatcctttcataaatcattttcacttcaaaaaaacagtgatgttggaaaatcatatagtattctttgtgattagttgaaaattatgaatggtgtaaaataatatgacatttaattgtttctcatttagacatgatgcattttatatctcaaaatttgatgggaggaaaaagaaaaaaaagaactcacaacttttaccaggtttgaaactagcttaagatagttctgtggaattctccaaaagtgataagaaaatttaaaatactgcccagacacagggttaaaaattaaatctgtatgtagagtggagactttaatctgacatattttaatgtaaagacattttagaataaagaaagctttctctggttttgtcggctgtttttgtttttcgactgctttgcatgagacgatcggcattcttaaattataattatgtgtaaaaacaaataagctgctactgtaaaaagtaacagctctgcacatatatcttgaatactactagaaaacattttcattagaggaataaatgcattaggccctaaataaatttaagataccaaattgcaaacttagtatctctaatacattacccatgctagtccctgcaaagtggaattgattctgagagagctcattatttccgttgctagtagagtgtatttaacaatattttggtgtctccaccggtagaaatgtggacatttcaaccagctatccccttgtttggttcctgtgatgtcaggcaaacattttgccaaaatgtttggtccgatgtaatcacatcggtgttgtgtaattaagataatgtgctgattttgaatcttgttaacgtgttattttgaaagtgtaattttaaaaatttgcccatttggaatacaatagaagaggcaggatgatgtttttagatttaattcaaagcctctatgtacagataaattatgaaaagttcagtagctcttttcatcttttcctaatatgggagaaggtgggggtttattttcataaacaccattgtaaaaataattgatgaaatgttttttgacaaaagatcatgtacatatatattaactttctgagctaacagaatgtacattttatttcattaggttacattaataaaaccatgtacaaaaacatacaaatggaagaatagatgaaatcacctccctggaatcagatgtagggtaaatggtgtagtctctgagatgactctcttagttctgtgatttcaccataagagctggcccccatctattctgctttggacacattgtgccaaagtgtacaatgttcagcttcccacaaaaggagaaaatacgggtttaggcttaagattcttctaacattctgttatggagaaatagaccttggccaaggaaacacttcttttctcaatgatggaactttcttcagctggtcagtctaaaatctgccattcaagtttggttttacttctttgtttttctttacttcaggtatatcaaagtgaacattgggtcatgttttattctgagtgacagaacggacttgagctactatccattctagcatgatcttattttacaaacaagaaaactgaagataaaagtgacttccccctacttggttaaaggactgaactagaacttgggtccgttcaccatcctcattcatatgtgaaacactaggtgattttgatgtttgctgaggaaatctgcccactgtttaagattcattagtctttatttttccttttgcacatggatatgagaatagaattaaaatgtcatttattaggatgcagtgagaaattgatgatcataatgaatcagttgatatattcacattatttctttatcagtactttagatatgggcatcaaatgtttagaagctatcacagaaagttaaagaattactgtgaaaaatctaggcttaatgcttttttcagacaccttagcaatagtaatgttggattcatttagataaaatctaattggtactgaaaaactgcttatgaaaatggtcactaataagaagctagtttgtattacttttccctttagcttaaagcagctttaacatttatctatatagagagtagtatttttaaaaatagtccatttgaattaaggatatttttatcttccatgaaatggatgtttctttattcataacagtcatagttcccttggcaggttgaaaaactgtagatggcatctgtgagattaggcttgaaatgtgcaattagttattaaaatctggctggaaaaaccataagtggtgttttacataaactcctcagcatttataaaaaactaatgaaagaaaaataaaagaacctcatttattttaaatactttccttatgaatcctgtcttttgaatgataaatttcaacttcaaatgtagtgaaaataatttaaaatatacatttaatgcctctatttttcttttaaaatttctcaactttccatttttagccatgacttcacagtacaatatggatgcaatttatgtttattgattatagttaagctaattttaatcatactttgttggagtggaaatacaggaataattctctgtcttcttagacttctgaggtattttacttaaatcccttgtttcttatctttcaaacctaatagttatattgtatagtccaaagggtgaatgcccacataagtgaaattcacacattacaaccccaatgctattgtcattttcacctctggattttaaagaattgtggtaaataccatgcagaaagatgttgaacctaagacagcccccaagctctttcagagcatagctccagaagtgtctttgaaatgctggaggaggtggaggaggaggtgtgtcaggccctggaaaccgctgggctggtccagggtctgtatttgaaccccgttcagttcatcttgagtcgcagggtgaagaagacattgtacttccatttgcatggattttccgctctgtcttttagccagaaggcagccttgtcttttttgttttgttttgttttcttttttggttgttttgtttctttaatgtttctttcaggtgaaaagccttttataaatatcttgtaaatagttattcctttaaatgaaacagtttgctggtggaaaataatcttactcattccgtcagatataatcaattaaatcagaaaactatagaatgatctttaacattaaaaagcaattttaagatgggttaaggaactattttgactagtatgctgatcatcccacgtaaaatctctttcttggtgtggtgagcatactatatgaagaaaggctgaaaacttccattattattacataatcatctgtttttttcctccttgtcctgtggctactatctctatatagcaaaatttatttttcacccagactgtgaattataacttaccattcattgtataccttatagaaccataggaaaccctatcagtgcttatgagccttagtttttcttaatgattttgttaatgttatttattttttacataattctccccctgtatgtaaaatatctcgttttcttctttgactttgagagattggaacctttccatgtactcttggcattgcagatcaaaataaggcaaaatagctcttattctgggctttgtttatcagaaaacaccgttttttgttggtttttataacaggtgatatccagataaggtttaaataagatgagttgctgtattttaatgtttatttccacctcttaagggatttgccctcctgataaatcagtatacacttaactgtattttaattcccctgaatcacaactatgctaatgtagtcacctattttggaaaactccttttcagacattctttaaactattttatacttgacctcatgaggcatatttgtgaacacagactatcgtggatattttatagaagctaattaaatagcattatcttctggctatttggattataatccagttgtagattgattacggaccattcttggaatctaggaaaagtccaaatgcaattctgtagcttatacatggctaatgaagctgagagatagattaggttttaagcaagggatggattttaggtaacaacaaatattgaatatggctcctttgaaagtttagaacaagacaaggtaaaacaaaacaaatggctactttttatttatttccagatggatttcaacttgcaggtgacatggcataaagtcaaaacgttgcttgttgagatttattaattagaatgtttttaagtcagatacggagtttgttctgtttcagataaaagagaaacctactcagacataaaaataacctcagagtggagaaaatattgaatccccaaatctgggtttcatttcatgtgaatctccatttctcaactaagcgatatctgccaaggcgcctctgtttgttgacattgctgtattgaagtcgccagtagcctcatggaagccaagccccagtggtctttccatctgactgcatctctcacgtgaattggatgctgtcagccattctcttgggtatctcttctggcttggcttctaggcactgcatctctgccacacttgttctagtctatcattgaatgttctcttaatctatgcacttttcttggagggttttatgcttttaggtttttatccaaatgaaataacttctgagccttcacctctagacctaacttggttctgagttcccatatcagtggccttcagcctccgtaagtacttgcttttaaacttgtttatcatccttaatttggcattcaggacccttcagtttgcccccaatttaccagttccaaatgtactacatcatgtgtctatccttactatagtgctttctagtcctagaacattctcacaccgacttttgttcatattcttccctccttatgaaatgccttctacgcaaccttaactacagggattctatctgttcctcggcatgttcacttctgtattcttcttcctgaaacgctctacctccgctcatttaggttaaaacatccccgccttgtgctcctgtttatgtgtggctttagcatagctcataccagaagctaccgggcatcatgaacctgaggagagtgagagcatacgtaattcatttttgttccctttacaaatgacttggatgcagtagttctcaaaagtgttgcattaaataggaacataggggaagaacactttggctggcaacatagactttcaggtactgagaaaattgtgaaattggtttgtcaggtttcagaggaaaataaagattatctggtattgcataagttctagatgtttcttgatgtttgccctaatatatcgttcctaaggtaggataccactggttgcaacggagtatgttgtattttgcagtgtgcttgcaaatcctgccttttatcgattaatgtcatttagcgaagtgggacagtgtcagtgaaactaaggcaaaggggaagcctgaattcatttgaaaagtataaaaaaaggagaacacaggcagccttgtactttactgatattatatgtgagacactatgaactaatcagagatgcaagatgatacatggtgtgtccttaattgaggataacagtgttaggctctaaggtcatgagtcagaaatgtgcctttttaacgtccatgttttgaatgttctcaggcccaaaggttgtgttgtgatgtttgaggacaatggcttatgtcttggcttcaggatgaaagttacttgtaagtgggcccaatgcttgcatgctgagggggcaagggtgatttagagtcaggagatctaacatgaatattgatgagtagggttaggagctgagcacaaccataggtaatgttgctttgagatgcccaggtttatggcagcaagaggatattggattcctctttgctcaaatatttttaatattcacgtttccctcagtgatagccaatcaagtgataactgaataatagctgctgagacgtttttcatgttggaacaacaatgcctctgagatttctttgaatgtttgatttttactaatcacttttaatttcatcttaaaagcctgggaacaattttgaagtttaagaacttttttttttaacttaaaagaattattttatctgacaattgggaagtccctttgatttaacatttaactctgttaagcacctaaatattactttaaacagctctggaaaattaagccctgctattattgtacattcccaatctctatggacatgggaccatgaaggagaaatcaaggagatctatttaatgaatttctttgcttctaggacagttcattacttgtaggacttgcacttatctatgccttctttaaaaacaaaacattccaaagcttcctagaaaccttagctaattgcattataccaacatgcttttctgatgtcaccttatgtctgtaagcaactttacaaatcctttgaaagagatagttggatttttaaaagtaatatctgcttggattttgcaaattaagccacagtagaaacagtttcactgtagagtacatgctagttaataagtaggggtttttaaaatcctctgtacttttccacaactgaaagggtgcatacttttggttgaaagtgagtaggcgaaatttagacctgctgttctggtagccctagtggccatttcataatccctgatatgattgtccagctctcctgtttgctaaatgcagaaatagaggaaggaaatggatgttttggctccattaaaatgttccttatcagactgtatgtaggagtggatgctgttgaagatgcctctattgccagctgtacagcatgtgtgctgggctagtttcctggctgctaaagctgcgtggtgccctttaatgatgggaaggaggacattaaatgtgttgggcttagtgttttcacttgtgaacatcagggagcagagggcatgcaaactttgcccaaaggctggacacggtttgcatagaaatgagctgcgtgtagtaataactgacttggtagatgcgcagctaagcactgattactaagtaaaagtgagtgcaacctcaggccataggtgagctaggttgaccagggaaaggctgcgttccaagaggttcgtcttccattggggccgccttaaaatgctgatcctgattcacactggttgagcagtgtgctgtatgttgtcttcacttgagatagaaactgctgtcatctttattttatagaatggagagaactgggtctcaggaaagtataataaattgcctaggctacaacaggtagcaagtagcagagtcaggatttcagtccaggcagcctggccctaagagctgaggctccctctactttgtttcttatctggtgggtgaacaagatttgagttgctgtatcttccaaggtagtattataatggtatttcaaagactagctgactttttaatgttaacagtgttccaatttgctttctccttaggccctaattcattgtcagagataaggccatcacctttatatatgagacatttaaacaaatgtttttagtaataattcaggaaacatacaaccggtattctttctgtagcgatatctgcagtctcttgttataaaaagaactctattagtttaagtaactgtctcttcttggccccattacagtaaaaagtctgtgatcagcaccctcttggaaggggaagttgttgaatgacagggatgtggtactgtcctgataatcctatggctttgtatttcttagtttatttatactcctgggtaactacccctgctccacatggagtattgacagctttgaatctgaggtagcttatgtgtgctacaaagacaaaaaagaaaaaaaaaaagaaagcgtggtttgggttagacttaaaaaagtactttcatcagttattatccagcgtgtctgttagatttttaagtaatttatattttatgaaagagctttaaagacgcagtgtgctttagtggatagtgtagcgagagaaataaaataataataataagggacattttctttaaaaaaatttttccttttgtttttaagaagaaaaaagaatcagaactgcagatcaggaacagaaatagcattccattttcttttcacggattctggagcagctacggtgagagtgagttggctgagtctgggaaggaggctgctgtctgcggccctgcctaggcggcagcggcgacacgacaggagctgcgtgtgtgtcgctggcgttcgctctcgcaggagccccgggcctgcggccgccaccacgcgtgctcggcgcccgggctgtgggcgtgttatcgcaggaagtcctgcggaagcagttgtgtgcgcccgttccctccggttacctctctcatcctcggctgctgcgcggtgcctgcagcctccctctcctcctccctctcccagcgctgcctgccctgccagctgcgtggaggccgcctcctgcccgcttcttcccactccctctgccctgtcgcgtcgcatcccctggccagcctgcccttctccccacttcccaacttggcttcctctctccataaactctctttcctcttgtcttctcttttgcttcctctttgctgccacccctccttgatttgacgctctgatttcctcttgccagatcccaaattgggttcatcagcagctactcatccttaaatcttattcacctgtgatcattgggcaaactgtaagaggcatgagattaatgcaaaaaagggagttccttactatgggaggaaatctctggctatcaaaaagtcatgcttttttttttgtcacatattaaaattaagcactaatgtaaatacaaaaaaatttaaaatgatggcataggttattaatgagtccaggaataaggcaaagaaggacaatctgaaaaaataatctcaaatgaatataacaaaattgcccattttttatggagataactaaaattgtgataaagtactagattttattaatgaaaatattattagtctttaagttagtcatgtactttgtcatatagcgttttcaaggagctgcttaaagtgtttctgatattttgaagtatatttacttacacaaacattcttgagtagatggaagtgtgtgtctcatgcattctcaatcagaaactataaataaagtcacttaatcaaaatttaccttatgtaatagtttcaaaagcacatgaagccttttggagtgactaaggctatatatgtatataaggctactgtatttttagcattctgggaactgaggcctttatgtttttcttaaattatgaactttaagacagtagctatacgtggatccctatcaagtttttgccttctttacatcatcaagcttatttttaaattaattcttgttacggacatgctttttacaccctctgtattaatttccttttctagaagtccatattagtaaggccatatcatgaaaattagtatttttagtagggctgttctgaaatttttccacaagagatattttgcaatgactgagctatattgattcatataatttgtatccaactgcttcattttgccttgagatttccagtgtacctaatattaggtaaagaaaatagttgatatatgactggatgtgaggtggccattttaacttgtaggtgacaggatttatctcttgatttcttcgttaattttaaaataaataaacaaaaaacaacataaggaagtttagatccttctttttaatttgtaacacttcaacttctagtattgctttctgtaggggagaatttttcagttgataacatgagttgatttcataagttatagtatttaaaactagagatgttttgtcacaaaaaagttgtccctttaatatatgatttagcacggcaactctttttaaagtaatatgtttaagagaaaaccatgaccttatgataaaaataatactaaaccaattattaataactacagtttgccgtcaaacgtcttagctaaataattaccttattagaacaaaggtattgaaagcacagcaccagaaacactggctttaatattcaagtaataaagactttaggtccaccatatatttttctcatggctggaggagcaagtcctagagtatggggggcatacttattacttcagttgtcataaatgtggatcacagtattttctaaactttttgttttattttgcatttttctataatttgagcactttgacctcttttcaagtttatttgttctccagatatgtacaatacaagttaaaagaaagttcagtcatcacagtgccttttgggacatgtgattgtctggaatagacttctgtccagctatggttagaagtcccataggttgtagctatgttttcctttttgtgaagtggctctgttggaataaaaccagtcttaaagtaattctataatttctctagaatgcagtcttctcacccataggctgtgagtagtagtacctgggcacaggttttggggggaagaatcagtttagataaaacatgtaaaacaggtttggtgaatgtcaaacgattgaatatttatttctataaataatgataatgattgttctgtttctaatctttgtaatttctgtgtgtcattaactatgggagtgcttagactattcaaaatagtatttctaaggccttattttatttttaattttaacaattatatttaggatatttacggacaggaacaaactgagcattctagccgtcagctattgtagaaagagtggcattatattatcccaaaaggctagctcagtgtcatcctttggtagaatacatgccttaaattcaaaagctctgttatgtttgaatttcagttctataagctttggtattcaatagtgccgagttcaaggtctaaattggaaaaacttgcaagaagtatttttgcattgttttttcacattgtacatctttgccttgttctttgggcctttaatgacatgtgccatcattttttaaaaatatttgtattagtacctaattttaatacatgatttaaaaaatatgactttttgatacccagggatttcctcttgtagtaacttttttgcattaatttcatgaaattttttcctcttcctcaaaatgagcacacaattcctcttcaaagttaatgactgtcttatttttcagtaggttgttttaattttgaatacctcagaacctttcttgaggggtagtattttagagataatgttttgtggttctcactggatattttagaagttttattttgattatgtggaatatatcctacatgatcataagcacttcgttaataaaaatggtttgttattactgagatcacccagtttttcggcaggagaataataaatagaagttgtgtgattccatagccactgtagggtgtactctagagcagagtgattctgggttataaccacatatcctaaatttcaagctaatagtgtgtatgtgtgtgcgtgtgtatatatatgtaattacctcgttttattgcactttccatttattacactccacagatgttaccttttttataaataaagatttgtggcaaccctgtgtcaagcaaatctatcagcaccatttttttcaaaaatatgtgtttaccttatgtctctttgtcacatttggaaaattcctgctatatttcagaccttttcattgttattatattatatctgagttggtggtctgtgatctttgatgtcactattgttattgttttggggagccatgaatggtacccacgtaagatggcaaacttaattgataaatgtgtttgttttgagtgctccactgtctggctgttcccttgtctctctggtgctcgttggtcctccctattccctgagacataatgattttgaaattcaacctattaataaccctacaatgacctctaagtgttaaagtgaaaagaagggtttcatgtctctcactttaaattgaaagctagaaatgattatgcttagtgaggaaggcatgctgaaaaagagagaagccaaaaactaggcctcttgtgccacatggccaggttgtgaatgcaaaggaaaagtgcttgaaggaaattaaaagtgccactctgttgaacacacacatgataagaaagcaaaaacagccttattgctgatatggagaaagttttagtggttgggtagaagatcaagccagccacgacattccctcagggcacagcctaatccagagcaaggccctctgtttgattcggtgaaagctgagagagagataaagaagttgcagaagaaacgtttgaagctagcagaggttggttcatgggttttaaagagatatgtcacatccataacataaaagtacaaggtgaagcagcaagtgatgatgaagaagctgcagcacattatccagaagatctagttaagatcagtgatgaaagtggctacactaaacaacagattttcagtggagacaaaggagcacattcaaaggacaggctgactagttaggggctaatgcagctggtgacttgaagtagaatccattgctcatttagcattccaaagattctgggacccttaataattatgctaaatctactctgtggagctgtgctctataaaaggaacagcaaagcctgaaggatagcacatttgtttacagtatggtttactgaatagttgaagtgcactgttgagacctactacttggaaaaagattcctttaaaagtattactgctcactgacaatgcacgcagtcaccccagaagctctgatggagatgtacaaagagatgaatgttatgttcatgcctgctaacacaacatcctttcagcagtccttggatcaaggagaaatttcaaaattcaagtcattatttaagacatacatttcataaagctatacctgccatagtgattcctctggtggatctggacaaagtgagttgaaaaccttctggaaaggatacatcatttgagataccattaagaacattcatgattcatgggaggatgtcaaaacatcaacattagcagaagtttggaagaagttgattccagctctcatggatgacttggaaggcttcaagactttagtggaggaagtaagtgcagatgtggtagaaatagcaagagaactagaattagaagtggagcctgaagatatgactgaattgctgcaatctcctgataaaactggaatggatgaggtgttgctttttcttaaagataagcaaagaaagtggtttcttgagatggaagctattcctggtggaaatgctgtgaacattgtcaaaatgacaaaagatttagaatattccatcaacttagttgataaagcagcattaaagttggagatgattgactccaattttgaaagaagttctagcgtgggtaaaatgctatcaagtggcattgcatgctacaaacaaatcattcatgaaagaagagtcagttgatgtgggaagcttcattgttgccttattttaagaaattgccatagacacccccagcttcagcaaagacctccactgagcagctatcaacaatgaggcaagaccagcaaaaagattaccaattgctcaagactcaggtgactgttagtattttttagtaataaagaatgtttttaactaagtgtattttttaaacataatactattgcccacttaatagaccattgtgtaatgtaaatgtagcttttatatgcactgggaaaccaaaatattcttgtgacttgctttattgcaatattcactttattttagtagtctcaaactgaatctgtagtatctccgaggtgtagtatctccgaggtgttatatatatataacgttaaatatatatatttatatatatatatattttttttcacgaagtaagcatgcttttattatcagataaaaacattaaccaaatatgtctttttggggaataataaaaatgattaaacttactaatgtttttgctggggttagattatcaaagcatttttttaaacactgacacagtcattcatattttctaggagaaattaccatgcacctttggagtcattttttgatagaaaaggtgtccctaattgagagtaccaattttaaatttttgttggcaggtgctgctattgaattgtatttggattataaaattcacaagtttcataattggaggcttatggagtgtattgatgagatgattagaattactcttttggttatgtaagtttttaaataatggaagaagttctagaaatcatacaaaaatttccaaaataagactttcagaggctgtgaatgatactgattttctgtcatctttgtcatttaaacacagttctgtattatttttttgctcagcaataaaggagtcagtaggtccatctgtgtgtttctgtttgtattcatatcgtatatatgactattatgtatgtagtgtcttgaatgtgtatgtgtgtatatatatatatacatatatgttttcttttcttttttttttctttttttgagatagggtcttgctgtgttgcccaggctggtgtcctgtggtgcgatcatagctctctgtagccttgaactcttgggcgcaagggctcttccagcctcagcctcctaaatagctgggactacaggcacaagccatcatgcctttgctaattttctaattttttgtaaagacggagtcttgctgtattttccaggctggtcctgaactcctggcctcaaggaattcttcccatctcagtctcccaaagtgctgggattacacatatattttagactttggaaattaggaaaactgaaaatggagttttgttttgttttgttttgttttgttttcgagacggagactcattctgtcactcaggctggagtgcaatggtgcaatcttggctcattgcaacctccgcctcccaggttcaagtgattctcctgccttagcctcccgagtagctgagactacaggcatgcgccaccatgctcagctaattttttgtactttagtagagatggggtttcaccatgttggccagggtgatctcgaactcctgacctcaggtgatccacctgccctggcctcccaaatgaaaatggagttttcatttccatatatcacagttgtttttcaatataggtcttcagtgactggaagccattgctataggctggtaatttgataacccatttttgaaatgtatttattgagctcattgtaattcagtatgcctctggtgaaaggcgtgggatggtataggttgaaagaataatctgtggttgttccctacagagacgctgctgcccctttttgggcagtcatctttaacctggcacccactagtgtatttgctaaaatggaatattccaaaatttaaatgatgtcacatttgaaagcaatgccaagaaacaatgcggcagtttctaaattttgtgaagctaaaatccctggttacaagaaagagtacatgtcacagatgagtagttagtaatgacttcagtttagcaggaaaagagcaattcccatatgctgattctagtctcataacaaagaatgttatagaaagattgcacagtatttaacaagctgtgagttaatgtgacagtgtcggtgtatctagttccagaaggataatcactttaccatatttcttcaaaaatattttaagttatattccaaaacagaaaaccagatacatatgaatccagactgttccctgcaacacctccccacccccaagttaggtagtaaaatcaggtttaagcaattgaattgcttccgacctgctggctgccaaatacctgaataaatgtagaagttccattgtcagactctgaacctcagaggcttacctgttatataagggagagtgggtataaatgagagtgttacatcttgaactgtaattatccaaaacttagttttcagcgcttcagtttacctctaaccaagagcctctcctaatttgaacatagactacgcccttcaacacttacggatacgttaggagttgagaaaattaggtaaagttgtattgctttcagtcctttggaacacatactggatacaggcattggtactgtaggtgtgttagttaccagcaattcatttccagggtttttcccaaagacctgctgttttatgcgtgttcatattagtactatgatttgcttattcctgtgaacacgaacaacactgacagataacagttttgaacagtagacctgtgtcttttaaaagcttaaaactccatgcacatcattttgtcgttgcaaagacttctaaaggcaggcatggggaggcattgtggagtagggagaggatattatgtccttcagtgatttaaggaaatgcatgttttccatcatgaaagaaaagataatcattatcaaattcagaggagattgttttatcattcccataatgaacctgtgtctcttttaccaattaacatatagatggatattaggagaaaccaggttcaggtagaaagaggtacataaaattaataatccatcacgaggaatttctgcaaagtgccttttatagagaattttttttcttggaaatttttgaaattatcaagtataaagttgatgcttaaattatgttttaatctttcttaagactttctctggatgcagattatggaattaaggtgttttgatactgtgaaagtatgtgttgctaatactgtaacatactgtacatttactatactgtcaataatatatgtaactactactgagtattgactactttaagaagttaaggtctctcagtttgtcacaagagacattagtcttatatcaagggtttacctcatgaagtgacataggcaggcgactgacattccactaccagtattagactttttatttatttatttaatttttgagatagggtctcactctgttccccaagctggagtgcagtggcacgatctcagctcactgcgacctctgcctcccaagctcaagcaatcctcctgcctcagcctctggagtacctggaactacaggcatgtgccaccacgcctggttaattttttttttttttgtagagattgggtttcaccatgtcacccaggctggtttccaactcctggactcaagtggtccaccgacttggccttccaaagtgctgggattacaggcgtgaaccaccacgcctggccattatttgatttatactgtatttttagtgtacaagctgtttaagagaaacattgatcttaaagcataagagtcaatgattttgaaaaatgaaaacaagggaaatctggtcaaatttgcttttatccttccacccaaaattgtttggctgcctgcattttgtaatcatatagtgattgactgttggacatcgtggctcacacctgtaatcccagcactctggaaggccaaggtggcaggatggcttgagccttggagttcgagaccagcctgtgcaacacagggagacctcatctctacaaaaatatataaaattcaattaacccagaatggtagtacatgcctgttgtcccagatacttgggaggctgaagcaggagaattgcttgagtctggaaggtcaaggctgcaatgagccatgatcatgccactgcactctagctgggacaacagagcaagaccctgtttcagaaataaataaataaataaaatcatatagtgattgaattgatctgtgcagaaagtacctctttctcccaatggatgctggcatcttcattcagtatatatagagtggccactttgtgtgctacctgttagcagtttatagtctaatgggggaaggataggaggaatataagaaattatagcacattgcatttacaatctatttcagtatacattatcttattcatttaatttgtactctcttttctgtttattccctttaaaaaaaactttgtaaaataggccaattatacatattactgtgggaattaagaaagtaaagatgtgagtaagctcaaaaaaaagggtaaaaaccccgccaaaaccactgttggttttggttaatgtgcttgcataatcctttgaatctgtgtctttcctgagtgtatgtgtaaaactctgtgtgtaagtgtgtatatttctgtctgtatcctgtccaactttggcaaaggggtagttttgcccaaatttgcttttggagctaaaaggagatctctgcccacaccttttctgtgaggtctgttacctcacacttgagaacaatgtcaatttttggggccttaaaggcagtgttggcttctgcccaaaggtaccttcatgaccttaacacaaattcacaaatcaacctattttattcattgcactcatgtcttcgggctctccactgcagagtcttaaaggaattgttttggaatggacacaaagattactaacctctgtggaaaagtaccctgactttacagcgttcctacttcaaaaacaaactctgtctggatggcaagtcattgggagacttgagtgattaccggggagttttggtgtaaaatggaattttagattaacctttagcacctaaatctgaggtctgtcaagtctccgtttttatagatctgacttgaattaaagaggtgtgttgtgttgaagccttcctggcccttattttaactactgatttacatggggtgtatagtggggatcatcactgagttttgaccaagttctgggaaagctccctgtgggactgggaaaatctggctcattttggaaaacctaaatttatgtttttaaataatttggaaaacctggtaaaatgctacaggtataagaacttaagaattataatggatcaggataaacggggctagaataaaacactaagtacagtcaggcagtcaatggaaacaaacagatgggtgtcaagagctaagttagtgagttgatcagctctatttttgtcttttcaataagtttcatgaagcttgttcagcaaacatgagtaacttcaataagttcatgcagcaaatatttattaagcagcacctactcatttatgggatactgtactaaggtgtgataatatcaatatgaatgacaacaaaagaacactgtccaggcaagaatacaaataatgtaacagataaataaaatattgatagtcataactccaatatagctatataaagatgatcatagcacataaattctggaaaaatccagtatcattaatgtctccattaatgtataccagtcaccccatctttttatctgaacctgtgcgatatttctggggttttaaaaattccacttccttttacgatcagagttgaagatttgttttgaaacccatcacttttcttcattttctacctttcccttcttccgtctacatgtcacaccacatctagtttagttttcctaatctcttctttttagaaacttcaagtggcttcctgctttctccaagtggtccagcctcatcaactgggattcaagattctgtcttattaaccttggcaaccacgtcttccatgtgagccatttggtttaaacctagcttcttctctgtttcttgacatatgttaatattgttagcaaccgtttgtttctcttactcctgtttgctggaatccccttttctgtcccctgtagctgtgcaattcttacttctctctcaggataatcttcactctcatctctgttaactgtttcctctgccattgaccacgttggttattttattatgaacgaaagaaataatagaaatattaataaaagatagcaaacatttagtacttactgattacttttttgtgtgtgttttttttttgctttttttgttttgttttgttttttagatagagtctcactctgttgcccaggctggagtgtggtggtgctgtctcggctcactgtaacccccacctcccaggttcaagcgattctcctgcctcaggctcccaagtagctgagattacaggcacccgccaccacacccagctaatttttgtatttttggtagagagggtttcaccatgttggccaggctggtcttgaactcctggcctcaggctatcctcctgcctcaggctcccaaagtgttggggttaaaggcgtgagccaccacgcccagccaagtacttaactgattactttcaagggaatttactgtttacactgctcattttggtgctaaatcatgtctcctcctgtattattactgaaatgtttaatgtgagccttgtttctttaacaaaggtagattattgcttcttagagagcaataattttctcttcgaatttaaatatatgcccaataaatacataatatatgaataaattaattgattggatattttagaagtctgaaatgcccttgcccataagaagaatgtatgtatgacatttggggttgcattggtactttattttccagcctgatggacaagagtgattttaaaaccatcaatgcctctgcatctgtggcgcagtaaacaggaaccctattggaaattaaatgtgtcatcttgtgcttcatagccagactattaagcttttaggaagagatcaatttaaaataaattatatgtatgtacatatacattaatatgtaatatatagaatataatgattatatttacagggttatatttaattcctgatgataaaaaaaggacgattggcattatcttatcagaaaatgaaaaaatgcatcaaaatcagacaatattttaaagaaaaaatttatgtcatttcagtaatgcttttttacttgacataattatgtaggaaaactatccataatccagtagtaaacattatgtatgaaaacttgatgtgaacttttgtcaatacatatgatacattattatctaatgttttcaggaaaacaaattttctacaacatttatgtgttaatcttttatttcctggaattgaaaaatttaaccaaacaccacagaaattgctaataccactgaacttgtctcagttcccttaagaagccacattctctcttcatctgggcctttcccaggtctcctgccatttcttctgttggaatcactcaatcctctcttttcacctggccagtttttgctatccttgtttgtgttcttcctttttacccccagaaccccttgttgttataccaaactgggattagtcactgctcttccttgtttatttatttcttttctctaggtagactataagctcactcagggtaagtttcttctctgccttgttcacagttgtatcctcagcaccttactcaacactttactcaatgcctgacacatagttggccctcagaaactatgttgaatgaataaatgttacgtgagttttgacttaggagcatcagttatcatatcacttggtcagtttgcaatatttgcccaaaaataggatttagtgcaaaatgagtgctgatgccagcagatatctttgaccttggtttctggggaaaaaaaaattctcatatcagcttgtttggataattgcttgcagagtttccatgaaagggaagtggtagatgcacaaatggataaagtgtaggactttttgacaggactaactgcattctaacttattgcatcaaagactatagcagtcatctctcaagcagtattctggtcatcagaaaatattcttgaacagtgctatcttttaactggttagcactctccaaagtatttcatgtggttttttcactgttcataccctggactacatggattacctgccagggttcatctattattttagcttacctggactacattggtgagacttcatgaaggagaattccacttttatttcagtaaaccagggcaggatattttgggacctacaacaacctgtcttttctttcttctttttatcttttttttttttttaacctaagaagatggtaaacacttagtaggctgcaattttctttcttaatgactgtcataatgtctcacatttaatataacttgttctattttgatgttaaaacagggcattcttaatgttacaacaggattaaaagtactgtttggtactctcatgatatgttaactcttttacgaagtcatttaaataacagtattgtattttctgaatagcaccctggtttgcaggctcaataaacaagttatctttagcaggtatgaagatggtgataataccaccagataccagtactgtttaggtgaaatctgtagtaatttgcttttgaaataatcaggtaaaactgttactatgaaatgctgttttgcaaaaagttcaaaagactaatggatgtgattaactttaagttatcctatagagtgctactttttcttgggtattatgttgcttctttaacaaacatccttttctttccatgtgtaggcttatttcctgtagagagcagtaaaacatgtaaagcattattcatgctttgacttctagaacatgtaaagcattcatagattggggatcagtcaactaattcttactttgcttaaacccaaagttctcaagcttgtttaggtgactgtagtcttggactttgtgattctgtctgagaaactccgtggaatagtgttaaattatcatatcatacaaagatggggcaaattatgtgcaataaaatgtgattgtatcatatctgtgtgtacctacaaaacaaagactaaatgccacatgaaatagttttaaggaataagattttcaagttttcttagcacatttgtgggctgcctttttttttgttgttgttgtttgttttggttagttgctagtacacattagaagccatttgatactagaagccaaagtcttaagaaaatattaaccaggcataaagttgaaaactgatggcattgtacctattaacttatgttttttatgcaaaataagaaaccactcatcattattctgtttgtgagatgggatacctcggtctactgatattacatagatttacagcaaccaccttagatgaaggtagaatctagcacacacttcatgtaaacacagcatttattcagccttataaaaatattcagaattttagatacatgaatcctctgaaaaaaccacagtattgttttatttgctcatctgttccctccggtcttcttgggtaagcaggttaccttaaccccctttcagttccagtttcctcatttgtgaaataggactactaaataactatcaggcttttggtgaaaaccaactggggaaattacgtgagccagtaagcaaatggctggtcataataagtactcaagaaatattagttctcttccacctttatgtagcttgtctttgtcatataatcaaggtagtgcatcctcatggaacatttaatatctacagatgtgtgtctgtgcttgtccttccaccaccaccaccaccagcagaatcacatacagagttcttatcctctcttctgtttgcctgtctctgattatcttcacccctgttagggtgtctgttgctttcttctcttgtttttgcccttcatctctcttttcaaacccctcaccctttgaaatcccttttgttcagaacgctttcttttcaatttctcttctcttccttcttttaccacctgtttgcctgctggggcacatcctggccctttctcccgtacaattcagcctgaggcgtcaatgacccattccactccattggattgcttgatttgctcatcaaaatatcgcagctcaaaggtttctcttcattatattactccatgctctctgcagagcaactgctgtttcactgaaaaatcgcacacacactcttaaactttagctgaaaagtgcacagatcttaagtctgtagctcaatgaattattacaaaacaaatacacctgtgtaactatcactcatgtcaggaaatacaatattgccagtactctagaagccctttgtgctcctcctggtctctttcttcgtcctccaggaatcagtcactctcctgactgctaaacactttagatagttctacttgtttttgaactttacacgtgtccatatacattgaaagcatgcattcgtttgtgtctgccatgacacactcagcatcatgtttgtaaaattcattcatgttgtatgtagtttgttcatttgtattgtaccatagtattctgttgtatgaacaggtattgtattttataatcatatgccacaactttaaaaaatctattctactgctgatacagatttagcttgtttccagtttgagaaattcaggaagtaatactgtgagaattggtgtgtgtgtgtgtgcacgtgtgtttgtgtgtgtacgcgcattttaaaattaaacttctggttttgtgtccttctgaatgttttaagtttcttggcgtctaatccagatgtttgaggcttttctgtattctttttatgttccaggctattctcttaaaagataaactatttattttttatgtattatgctacttgtatagtatattttgagttttggaatgttggagaatacagaatgaaaaatttgtaaataaaacatatgtatatataagtgcatatatttatggtaaacattatatatttaataaacctattacataccatatgatgttcatgtataaaacatacataatcatccaaatatacaaacatgcaaattcattttactgattatggtactcttattatagaattatcactatatagagaatgtgccactttttaatgaactttcctctgtgtaatcagtctacagatatttttgatgtgtaaagttacacagacatttatggaatctaaatcaaaccaacatggctgtgatttaccattttaaaaaataaattcagtagttcttatgtctcacgacttgtacatttcttgatctgtgcccatggacctagagctatgatatctgattcttttttcagccgaaataaggagaaaattaatgccttgattccttggatgtcgtgatttggtttgttattatgttgttgagacaactttagcatttttctagctgttagtttcctgagcctatttaatatcaagagattcagactttccttgaagacaaaagcaatatatagaaatttctaagtgtgtcaacatccatccatccatccatccatccatccatccatccatccatccatgcatctaataagaacgagtgccttctgtgtcataggcctgtcactgtgaggaagggcatgttagtatcacttggctttttaaaaacttgcatgtcccttgtgccaatatgctattatactttattcctctgcaatagtcaccatcatagtctgctagtgctgatgatggaaatgagcctcagatgtgttgcacctggaaaaaacttgagatcactgatgagatgtagctatttatatatattgaattattttatatcaatattttgattagtatcacatatatgaatggatagctgttaatattttgaattaacaacaatgataatataaatcataatatattttctggtttgaagagtttcacagtctagaggggtagcctaaaacataaacacataattctgtgtgaagtggcaggtaccttgagagaagatatgcacaaggtgccacatgacagtggagaagactaagttttgcttgtgaaaattgtagagggctttgtagaagtgaatccattttagaggcatgtagtttggtaatgttggtgatgtgttaggcattatgaggcagattcgaaagttaggataatctggtactctgtgagaatattgggaagattgtatattcattcacttgacgtaactatagaggcagacaaatatgtttgatagcagcctttgtaacatggcgtcttgtagattgtgttctcttgtaagtttcttaaaatgttatcactttttgcattggttaactgttgttaaagtgattatgagaaatgcattgggaaaccaagtggtctttagattccttcagacccaacttgttcatgtgctaggtctgcacctagacaagcgatttaacttctccatgtcttagctgcattatctgtaaagtgtgaatgataatagtacttaaaggattgttcatccaaattaaaatcaaatgagataatgcactcttggcacagttcctggctcatataataagaacatgaaatattttttattagctagaaattcaggttagaatatgtatcaacactgaagatcataggccttaaaaaaacctacctctgacttttggtttctttcaacattcaattaaattctgaaagaactatttgtaaaacacctgaacctggaattatatatgtgtatttcccttactctgttatgataggggtccacaacaagattgatggagaaactaataattggggtgcagatggtgaaaatcttttctaaaggtgtgtgtgtgtgtatggctctgtgtatgtttagatagattcttaagtttatactgaatttgaaagtgaagattgacgagattgcctatacaaaatacttaacaagtgagctaatttctgcccgaattctgtagtcttactcctgtatgtcacatcactattcttcctctcatatgtgaatgtgtaaaatagaggctgtgtgggatgggtccagaaggaacttgtggtcatcctctcaggcttgaatctcaccactctatctggctttgtgtttacaattaatttaagtttaattacctgtttcagttttactttgacatctacctaacctattttttgctttatttctttctttctgatcttttgttttaatctttgggggtaaaataatgcaataatgataaaacaaaattcaaaagcctgtaaagctatgggatctgcttgggattttcaagggtgagatagggtctataatagacatgtgtttactgattgtgaccccaggcattggttttctgtccttcattgttaggataggtggatctggggacacagactgagtggagtggagaagaaaggatttattaataatcagggaggagcatgtgggatagatctgaggtatctgcaagcatttgagaactactgattgtaactatatgaactgaagatggctcagtgcaatcctgggtctttccacattccatatttaattaaaggcctttgccatatcttggttcctggctcaattttagtcagataaaatttaagttattataaaataataacaaatttggcatataaggttttaaactgatcacggtagctggacagcattagcaacaatagttgaaaaaatagagcttctttatgcagtgatatctgtataatctatttagctcaaagataacattgagtttatatccacgtatgtttatgaatgtgtaatttggacacctgggattttattgtatgtagatgttttatccgttccctttttaaaatccaatgttctatctgtaatgctctgccactacacattctttcaaaaaaattctgattctaaatctttaatgatgatatgcctcaatcttcttttaacatagatagctcttctggaaaaaaaacaaaaaaacaaaaacaaatccttcaaaacagccctcttcataacaaaacatcttagtctttttgccaagttagtgaaggaatactggttttttttgttttttgttttttgtttttttccttaactacgcgtgctttaaaatctcagttaaatttcttccttgagcattactttcttagagtggcctttcccactgtgttcatcagaacattagttttgttggctaaatggcactatgtgacataaagccaaatgagattgggaaatttcagtctagattggacacacgtcaccctctccaatccctaggacttcttagagctgtaaacgctaatgtacattgtggatctctgggagggatatgtattatacagtttccattaaacttaatctgaccaaggaatctcctttcattttctttttttgaagctaatattatgggaagagtctagagacaagtcttgggtttcttgtcatctatgcttaaacagttaccgtattaaaatcccaggcagagcttagctaaacttgcagtgagcatggcagaatgttctgaaataccataatattttttcagaaaaggttcttatagttgaagctttctaagcctgttacttatccaactccaaattatgaacggattatatgtttactttttttgcccatatataaagcttttcatatcctagaagtcaggaaaaagttatttaattttattatgagaagttgctttcaagtatatatatattttaagatcagttttctttggaacatttctccatacttaacaaaagagagaaaatgactcctgtgtgtgtgtgtgtgtaatttgtttttgtcagagggaaaaatgatgctaattaggttaaaataaggagttggcactaaatagggtggtagctaaaccaaattttgtattttgtaccaaatttctaaatcccttttgttgcgtgaatggattagctggttcattgtaatgtttgtgttatctgttggatatgtctatggttgtccttagtccattggttctcagatgggtgcaggccatttaaactgctccctgtggtagagtaggagtgagcctagtgctttgtgagttgtttcctagtttcatgaggaagaactattgcatatgaaggcacaaagttacttcccttcatttttagagatacacacacatgcacatgcacacatacagagtatattacaggtataagttctcagtatgtcttcataacatctggttttaatcttatattaaatttggcacttttaatactactaatagtaataaaacttactgaatatacttggcttactggtgctgtgaagacagcgagcattctaattgcactatgttatctttatggtaagcatctattagattcactatactgtatatgtgtgtcagtttaccaaatggatttgcagtgattgacacagatttattaagggagaacaaagaaagctgttagttatattggtggattgagttaataattgagattttcttttctattgattaacaggtaggaaaacagaaaaaagcaacattagtacataaaaatattaaactacctttactattcaatgatagttttcaccaaatgctggcaacatagtcaaagacattcctacaaagcacagcactcgttatttttgttatgagtgaaaatctaatttacatataataaaatgtcaattcacatcataaccatcaagataaatagaaacatttatactcttcgatgagctactctttttgaatttaagtgctgtgcttggctctttgcccagagaccagttgaaatagcctaagtttaacagagaagtagggatgaagttgaaactgacttgtgtgcaaatgtaaagtcagattggcctatgtgaatcaacagttgtcattgcagatattttaattgtgtgtgtgtgtgttttgagaggaaaacaaaaggaaaaactacttttctgcagggaaacaaatggtaacatttctcaatttgcacagtgaaattatgatcttattccaatcagggattttaatacatttgcctctcactggttatgaaaggaaaaataatcaattccccttgccttttgaggctccatgaggtattcttgctctattttagtttccctagttagtgaaataggtgcattctttttatatatatacatgtgtcctacagtgtcattgtgactatagcctaaagtctttgaaaaaagaaagttttgtaattttcttataaaagtacagtggttaatgcattttttctttaacatgtatttggatatatgaagattcatttaggcaaataggacatttattacttacttaccacactatctccttttacctagacaagtgcatttgaaatgagatatttaaaatctagagaacatagcaagatgaaataaaagcctaataaaatgtgtttgggctagcatcaaaacctttgaaataggatatctaaataatgtgcattttatctcagagggcttttggttagttctagtgtccagatgactattaatgggcttttgtgctctgaagcatatgttaatagaaatgatcattttggattagtttgatgtgaattaataagagatttatttggtggaagttgtttgaaggtgttgacatttaaaactcaacaagatttaagatgttcaaaaatagctttaaaaatttgggaacagtcaattcagagagagcaaattaaatagaaatggataggaaagaacaggatctgacattgagtttacgaagtttgaagcagtttataaaaaaagcgatctaccattgaagtattgccttggaatctgaagaaatagaaaacatctaaactccttcagtgattcttgagtttgtgaattggataaacaatgttctcttgcattttatagttcacttaagcaatctgattttgatctgtatatatggagtagacaggattcaagtgttttttttttttccctaaaccaatgagcaaacacatatgttctttcaaaactgaactgtatacattgttcatatggaagctatctagtttgctctaggcccaagatttgaccttccttttattttgctatcacttgcttaattctttaaattctttgtggggacttttgatcaaaagaaacattttttctttcttttaaaagtttttttaaaaataaaagctacatgaaatgtgtaattaataactcagtactcttatgctgatgtgtatacaagcaagcatggaagaaaacatactttttaaggcgaagaccatcgatgacttttctttttgtgttaagctttgatttcaaacagttgaaaagttttataagctggaaaaacaaaaagaaaatgtcatctggcattacatattatgaaaataagaactgttacttataattaaaaattatgcgcaacaagatttgaaactgaggtccaattacaggatcttgccctcctgattttttagagtcttgttcagaatgtgatgtgtgtgtgtctgtacatatatatgcacacacatatttgtttatgaaattatatttagaaagatactcagaagtgtcagttttccttgaggagttccttatagtcattttctttgctttttaagcatatctttctttcttaaattaatgacaaataataaaattaaagtcatcttgcttagtgtgtttggcacataactgaggttggatatatttactgaatgaatgaatattgggggaagtgagaaattgaagcaaagataggcttcggtggtatttaaaccacccttggcgccggtggtttgctgttctgtagtctttcagtgcaattgggcaaactttttaaaggtaaaattgaagtgctattaaccggaactattgtagagtcacagaggtgggggaattttagaaataatttattcaaattcccttattgtacaggtaaagatggaggctcagagaagcaaaaggacttgcccttgatcacacgagcaggtgatttaaatcaggtgtagaaactggatatgcaatttccatacgatttttactcatgttttgattctttactttgcttagggtcaagatactacaaagaatatagaatttatagaatttacacctcttaccttcaaagagtttctcatctaatggaaataaattttagttcacctgtgttgagctgatgcgtgatctaagctctgtttttaaattactgtgatagttgatttatttagttgaataatttatttgattatctattgcaaggttagttggagtaaatatgtcattaaatgtatgcatgtatatatttatatataatatatgaaatataactaaaacactagtggttaatttacagtatctagataatgatagaaaactcaaatcccttttgctgtgaaggtgccctcttgagaacatcagtcagtcttttacaggagaagatttttttttcttatgtatttaagcactttaaatagtgagataaaatagttagaattatttttaagctctaatgctgattatttctactgcataaatctgtctaaattatacggtaacagaaatagtgcactcctatttttataaaagtaaacacattttctaagaaagcaaagcatttagatttgttttatttagaaggaaatacggttaattaagagtagaaatttatgatttttacagatggaatgtcttatatctcagcaatgaaaattaatacaaatagaatattttgggaaagctacatatatttttaacctgcctaaatatcttggcgtataatatgcattctcattatatgggctgttcaggtggagaataatgtaatgtaggcctgctcactattacatagccccagaggtcaatttttaatctcacaattaaatagaggacttaaaatagcaattttgagctttgctgttctcctttaaattctttacctcctctttctcaacttcacttttagcccatcatctaaaatggcaattcatagtagacttactctaacgggcattttgaacttttccaggggtaaggtagactgcatgaaggatattgctatgtagtaggatgataaagtttaaaatagagttgccaaaactaatgactgtgttcattgttgtgattacgtattttaattgctttaagattttccctataaaagcatttgctggtgtttacaaattaagatcttttatccccaccccaatgtagttaagtattatggtcattagggttgaaggggttttagaggttaaataatttcaccaacatcacagtctgttatgaaaatgacttatgtcctgtaaccttttatatcatgttcctccttctcttgttgctttattaaaaccctggggagggagaggatcttgctccagatttgctcatgcttttatatctttcaggcagcctatgatgccagcatattaatatattttaggtgtgatacatgaaaatatgtttacatcatttaggaaggaaaatttttcttttgctttgttttgcagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaagtatgtgatctattttttcaagtgaaaatgttaactggaaaagttcttggcacacagtaaaacatcgtgcaatctgttatttgtcttagagataataacttgagggtggctatagtcttatggtatctaacttacgactcgctaggggagtttcttccacttagaagtatgacaaatgtgcttatatttacataatctgtcactctgaaaaattacgatgatataattccagtaaaattatttcttctatagctacttcaaagtatagtcaactaaattaagcacatttttttaaaaaacagcaactaaagaacatgcccccgcccccacaacacaaaataaaacccaaatgacctttcagagatttctttgaagttttagcagtttaacagtctttgcaatgtatattattaagggctctattcagcataaggagtcatgagtcataagtgttctaagtatctgttcttgggtagaagaaggaactgaaattttagaaagatgataatttaattaagtcatattttctcccagccactaaagatgctggttgagtagtctttaaactatgacccattatatctcttcaatgtaacaataaatcaactagagctaaagcttctttttgttttgaaaaataagttaatttttaaaatactaatgtatttagatctattcacttttaagtattttatcttggttcccttgctatttaaaatgttgccattttcctaatcgctcaccctggcgttaacatatgggcataaaccattttctcatcattttgatggaaggctaaccttaatgaattagattatttcttcctcatttctttgtgagtcctgtcttttgatataggatttttatcttttttgtgtgtgtaaccttattcatttcatttaggtgattcagtgttaagttctagtcatcttaagaagaaactgttaaaatagaaatgatatagttattcagtaagggaagattatattgtaatagttagtgaagacattatgtgtaatggaaaaaattaacaatcaggaaattctggagggaaaggtaagagaagttgtatcaaaccttcacaattttatgtgtaggaatgtttgattacaacctaaaatatccttttctgtagaccaagttaaaaccatgcatattttgctcaaccttatattttaaatgataactaattttttcagtttgctcatttagtctttctttccctgttttccctttattgactactagtaaaattgcccttcggttttctgcatattttcacacattcccagggcttctttagtcacttctgacaaaagaatacaggactcctaaaaggttgacataacacataagacattgaaatgcaaacattaaaaaaaaatagtttaccagtgtttccttttttaacagtggttatcaagttttgttaattttagggcctaatagaatgacaccaagatgggaagctcatattccccttctttcctccagaagtcagtcaggtttacattgcctcaacgccaacactttcacttgaaacttcactcttccatcctatatatgtaattttgttccaagagggagcttttataggtatttggcgaataacattattgatgtgtaagaagaacagtgtactttctttctttttgtttttgtttttgcttttgtttttttttttgagatggagtttcactcttgtcgcccaggctggagtgcaatggcatgatcttggctcactgcaacctccgcttcctgggttcaagcagttctcctgcctcagcctccctagtagctgggattacaggcatgcaccaccacacccagctaatttttgtattttttttgtagagatggaatttcgccatgttggtcagctggtcttgaactcctgacctcaggtgatccacccgccgtggcctcccaaagtgctgggattacaggcgtgagcccctgtgcttggcccagtgtactttcttaagtaccattatgctatttttcacattattcactgtggcacatttttactttataaatgattccttatactctagtgcactatccttgttcagtgattcatataaaaattttgcatgaccagcttttcagaagcaaaggtacacttgtctatccaaagccagtgtggtacttcagtacttgtgagaaattatagatgaaaatgactaaacctcatgttattaatttagattttctcagcatgttttggataattgcggtataactaactgttagtccttatggcgaagtcaactaacaaagaagtcttgtttaatcagaatgtcacaggtggaattttccaagagacatttggggtgatgacttacacagcactcgacagctttttaagctgagtgattaagaaacagcagccacggaacccagtcctcgaccagcctttgttaatgcattctttaattgacactacacaaattgtttcttagtttattttatattcttaaagttctgactcattctactccagcagaagaatttgttccagtattcttcttttgaccccagtcactgatgtcactaacttaacttgagagacatggttgagctaatgtgtaaaggtgaaccatagcaaactgctaatattttgctgttttgaactacacaaggacaatgtcatatggttcagcttaatcttctttcttagtcagtttccagtgtgctcccagtggtggaacaggtactgttttcaccaggctgcatatggacacccagagcttattaggttccccagcatgctggacagagtcctaggaaaacctgatctgaccactgtgatgcatagcaggtctttcttctgactttcaggcaagccccaaatgtggctcaaagaaatttgttggtaggtcagagctggaacgtttgtcatcctccgcttcctgaaagtgatgaggcagttttcactctgtttataacatagctgtttctgtctttttgactatgaagatattttgtttgaaactatatttacaacccggttacatagggtaacaatatcgaattccaatttatgttatttatgtatacatatatgtaccatataaataaatgtgatgtattctataaccataaacacatatatgtattttataaacataacatgtgtacatgttatatataatatagaccatatataaatatataagcatgcatatatattgttagctacaatcaaaggaagaaattgggcaaaaatatattttcaggaaagaataagtaatagggagggtaaacctagtaataaaaataaatccttcattattcctaaaaccaccttaaaataataaatgagccagtcttggttacaaaagtaattctaaatgtaaattgtttgttttagtctcaactttttgctgtttttagaatgggtttttttttttttcctagaggaagcatttgattatgcaccttaaaaaactcacataagtaaaatattccagattcaactgtatctctgtaactttcagataacactgtatctgccttttccctttatctttgcagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtttgtactttgtattgtctctttgtacagaaaaagttattagaaatgaaatgtgaattcttatattcatgttaaaaccaaggtcccagtaccagacaggtagcctgctagatctagcagaagagatggacacactccatagctacttcatacaagtatattcagagttgtctaaagacaacttttagcctcttattgtggaaaacaatcctagcatttttttaaatttgggaaagtcttttcatggaattagctaagcttcacaattctgggcatatgtcatggtaatttgatgttttcacagtcttccaaaaatgttactaatctttatggttgcacatgataataattcatgccttgttccagttttagattataaggcttttgctataatctttctttcagtgaggatatttcctgtatcttggattaggatttgattttatattcatcctgacggttcatattgatggttgcagagatagtcctgaaaaggcaaaataattgcaaatgaaaactgggatataacattttatgttgattagaaagaagtaaatgttattttaagtattagggacagcagaatgaccttggtaggggccaataaagcattcctttctgcatttaaggaaaatggcaataatttatgaaagcatttagtaataatttagatttttacttttattaaaaacagcctacctttttgttctatctttctgtctttagtttatggcatatgtgaaatggaaaaaagaaactgttaccattttgaatagaacgaaacatggaactgagtctaaataaatgtatacatttaattttagtaattttagcatagtcaaaattcatggtcagcttgagaaagtgtattagtttttgttacagtttgtagatttttattgtattataaggccagggggatttcaaaacatattagctttactagtaactttttttaggaatgattagaagtacccagagaactaatgaaataaatcccttaaaatatcagtcatttttatccacttgatagctacagctcatttgtctcagacctctctattgacctaataccaattaagaaaagcaggcaaagaggttgtaaataacaggtagtgaacatattttgcaatacttgtaagaagaatcagaagagaaatttcctggtcctttaaatgtcagaatggcaatcttatcactttaagggagatataaagaactcttaaaacaccagtttcatcttggtaaagttctctaaaaattccatcttagtttgtgattttccacagatagaattatttctgtggagcagcaaattaacccaacatagttattatgcatgaaagctacatgctttgaactgctgtctattaaagatcatttcactgtcttatgtcagatacactctgctgtcaaactatgattgggaagcaaatacttgttttagataaaagggttggaagtgaataatgtcagtatgtgaaacagtgttttataattagcaagtaatatgaagttaatacctggatttccggcaggcgtttcagtctgttcactctagggacaacttctgagggaagctgatctaggctgtcagggaaaactctaaaaacgaaaattactaaggcctatagtttggaagaattcagatttttaaacacacttccatttcccccaaacagttatttgttaggttcttagttatttatagtaaagtttatgtttgggtagaaggagctggacacttttcctgggcagtgattttagaagtaaaacagatgtgtgagctatctgagtttgaactaatagaactagaaataaaacagctgatcctagactatgctgtctgctaaatccttgcagcacacaccgaggaagacaaaaagtggtaggaaagagcatgcaggaacataatcttgttaagataatttttttccaagataaataatactgttaaaaatagaaaaaagtaatctgtggcaacagcgcgtgattatttcaaacaaacaattggattttgaaacgcatctaaagggttaacttcaatttgtgaggataacactgaatatacttgtagatcgaatgctaatcttgaatgctttgcacatatgccagatactgctgcagaaaaatgtctgaagataagtaacttattagtatcttcatgctgaaataaatattgaacagtttttctatatgcataaaatgaataaaaacgcatctgaaatttccttttataccaacaagtttatgttactgaaatgctatttgagagattctttccttggtggttaaacttcgtggaggctaaaagctgtgggagataaaatgctgactatagaatttctttaatgtagttttgtcagaaatatatagtaagttaatggcctgtgtgtattctgataaaaagatgttggtaaatatgagtattacagacaatcgttcaattttaggaattatatataagtccataatttaagctaattgaagtaatagatgaagaattcattaatccttttcaattaaacttgctttttaaaaaacattcagaacagttggtggttaatgatagatttatgacattttaggccaaaaaaaaaaaaaaagtaacagaagccaaaagcaaaacactgaaagaactctatggctttgatctatattttggtttgacatggatggttttaaataatttgaatggacttgagagcaaatatgagatatacagttgggaaaagaagtacataatttaaacaaattcgaagatttcccggtttaagtgcaagttatttcaaatatacttggaggaataattgaaatttagacatgcttgtgctgataatatccacttttgtataaattagatcacaaatgactaagtcaaagaattacaactttgtaaaaatactgccaaataacaatgtttctttgtgctgcatagaagatagagccccagccggataatggaggtcactgtaaatagccatcagaaagccaagactgtcctttctgagtgtggcatttatcagattctccccccaacaccttgaggtagcatgcccagtcctaaaagcagaagacatgtaaattctttaccaagaaaacaagagaagctataatggctagcttagagctaattgatttgaccaggatgttagttttccaatttttcatttatccagcatgttctatcagttgtcatgcttaaatttgtaaaaatcatagatgcagcatgattggttagcttttcatgtaatatttactatctgtattcggccatagaggctcacatggagaccaataatacaagagatcgagttcttaaaaaagtaattacagcttctttctttttatttttttctttttctttttggagatggagatctcactctgtcacccaggctggagtgcagtggcatggtctcagctcactgcaacctccgcctcccaggttcaagttattctcctgcctcagcctcccgagtagctgagataacaggtgtgcaccaccacgcccagctaatttttttgtatttttagtagagacggggtttcaccatattggccaggctggtctcgaactcctgaccacccgcctcggcctcccaaagtgctgggattacaggcgtgagccaccgcgccctgctagcttctttctttttaatctgctttattatgcttatatttaaaccattactgaatggaggcctgcattaacaacgcggcctttgctgtttcattagggtgtaatgcgctgtgcattgggtgtttgcatcatctttattggggagcttttagccctcagatcaggttataaaagtaggagtcttgtcaagttgtgcttcccacgggaaagtgtttatgctatcccaagttcagatgcttatgatatatatgttgccttttcatattagtgaattctttttattactgcattattcaggactttaagaaggtagctactggtttccagctattaaatttattttggcccttaatgaaattctaaggctaatagaagaatcacatgattaacttaccaagtactgtcttatgtttgagctaggagtgttacatttctgtgttgtaaatatttttatcagagttgcacaatatgtcatgttagaagcaggaagaacagattttagagagaggaagtcatcctttggatttgtattttcaacagatttaattgtatgagtttatagatctttaacatgtatcagtacaatcgtttgagcaggggattacagtttggtttgaaaaaaaaatcagagaccattaatcttactgtggtttattttgacttgtcttgaattttacttctaaacatttattttttgccttggcattttctttgatctggagtaggagggaagttgtagatcttagcaggttctgtttctttgtttttctgagttgaggacaattgcagtttagaaaaactggtgaatgagacttttatcaattcagactgtctatagaatacagaatgtttggcatatgaacccacacttctttttcaggactgtgtctccttaacaagtaataaagtgtgcaaaataagacatatgctcacctcaaggccataaagcaaggcaaagttctggtatttaccaggttattttcatcagtggagatggcagagctaaataatgtagccaccctagtagaatagttcaactatcattactaatccctttacctgcatgacagttaaatcttttttggccttgttcatgacagttggtatcatctttgatttttggtttatttgttatcatttaaaggaacatgtataattttgttgaatatcagtatttttctctatgcagaatgtttaggagaataaattgtggttatcagtggattcaatcaaatttagcattattcaactcctaagaaaatcttttacctctcctatggcctgctctgctaaccatctcaagtcaggaggttactcagtgtttttttatttcttggatcattgtaattacagcatacgtgcagctgttagaaacacagatatacaagtagtgtgccaatacggggaaagtttggagagagaaagttgttctgtttcattttctgatttcctttgtagagtctgattctgacagtcattagaccatagatgtcttgaattcttcatcaggcgatccacatttgaggcaaatgttatacgttttcagaatatcatacaaacccttgtttaattttaattgaaagtcaaatgtaaaatttatttttctgtcttacatttaagttgattcatacttctttcatcttttagtttacataatcaaaatttgtacagatcccttatttttttccaattttggattcacatctaataatagctaaaatttactaagggttcttatgtgtgtatgtggagctcagttttttacatgtattaatgaactcatcttcataatagccctagaagtaaacactaaccttatgtccatttaaaaaaataaggaaacagcatatattaaagtatcctgcccaagatcacagagttgcataagtagagagaatgggatgtaaaccatgatagacaggccacggaagcctgtcttcacaaccacactgatatatggcctggccaaacatgagtctgagtttactgccaatagcaaagcaatagaaggtaggccaattgcatgtaagggaggagatagaagacataaatcagagctctttgatgcagtctctctgaatgaggttgattttggggacttgggtgatttctttgagattatctgctatctgctccgtgtagtgtaatgctaccttatttgaacttactaagcttctattcgaaatcagtaaaaagaaaattaaatttgctgactcatctttttaaaattacagtgattccttttccctggtacttttgctgcaggaattagttctggtagagcgaataaggtgcaaattttgatgtaatcaattaaggatgtaatgtttgatccccaaattaagggacatttcatccaggtgtttgactttttttgtactcccctcatttagaggactttgttttaggaatttattatttaaatgatggtctgaaagttgtcttatgctcttctagttaccaggcacaatttaggttgttttttttccatgcagattacatgttaaggagatacactccattcccatttatgtcctccaaggctgtgtaattaaggttttatcctccgcctacattcagtgcaggaatgggtgtggaagcagagaacaaatcagaatgcctttagagtgtccaatttgagtgtgctggattctccagctgtgcttggagctgtgtgatttcattgaattcagaaagcaatagacgggtgggacatagtgaggagtttgggaattcacagagtctcctggcctagcatttctcctttcatgtttagttgaactgttgatataagattaaagaatgcctgcatcctttcatgtgtccaggaacatatctgggaatcttataataaatgatggtttgttccaagacctgtttttccagctgatgggaagctccaccttggaattcattggcacttcaaagtcaacatatgtaaaagtgaagttccccacaacaactttctttttgcctcctttcttctttactcctgttttcagctaagtcaggctggaaatcttggagttaccttggatttctgtttgatatcacgccccaaacacttgagcagtgtgtcccattgttcccttctttattcttttactgtcacttctttcaagtaaatccttattgatttcttttctgttgttctagctttatcttcccttcttgtctcttcctttcccttctcttctcacctcctattctttcctcctcctcctcatcttcctctcctttcctttgatttcttttttgtgctctttcttgtcttcttctgtttttatttccttcctcattccttcttcttcctcctctcttttgcctcttttttctgttcttttcttctgtcctccttcttttatcttcctttctccttctctttttttcatcctccttcctttctctttttttctcccaccctctcaccttcctttctttcttctttcctttaatttttaaaaattctgtttattgatcagttgtcctacattttatagcaagtatgggactacttctgttgaaaagcatatcatctaattatacttgcttatgtaaatatcagctctccaataagacattaactttccagattaaatctcactattcttccagaaaggataatagtaagaacaaggctagcacatttatattacttattacatttatattacttattacatagcaagcaccgttatgtaccatattccatttaacgatttgataatgcctcggccctcctcagtatttcctgagagcagcttgcattgtcttactctcgctgttgattttactggttttgtttccttcacctgaaatgccctttcatgatcactgcctttgaggctaaccttcacatatcagctcatctgtccacagctcagttgttacttctgggagcctttgctgactcctcagtctgggttaggggctcttcctctgtgttgtcatggaacctgttacatgtctcagcagaagcatgttttccattgttgttgtctttttagttgtgagctttttgtgctaaaccatagacatgttacgatttttgactatgtcattctttttgtatttccagtgcttggcacatagtagatgtgttaaaacagcaaccttccctggaggaaggatgttctatattttcggagattagattttctcttttcccattaagatgctctttagaatacatgtgcaattctgacatatctccattatgaaccagcagcacctgcaggttggatgctgtagaggagtgctatggggaattcacttagctttgtaacccacttgaactgcattttgtcttgtttatttttcctataaaatattgtcttccaatttattaagatggactttttttttttttttttgatatggagtcttgctctgttgcccaggctggagtgcagtggcatggtctcggctcactgcaacctccgccccccaggctcaagcgattctcccacctcagcctcccgagtagctgggattacaggcacctgccaccacatctggctaatttttgtatttttattagacacagggtttcaccatgttggccaggctggtctcgaactcctgatctcaggtgatccgcccgccttggcctcccaaagtgctgggattacaggtgtgagccactgtccccggcctattaagatggactttaagatttattggtactctgtcatctgaaataccagataatatagaaaaattaattcagaattatactgagtaaaatgagaaaaccagtttagggtaaactgtttattgctattatgcaaaaagccaataataaaaatctgcataatgaggaatatgcagtattttcttcttcaatgtgcccagtgtaggagtttgagttttggtttcccctgtaccctcccctgccgttggttggctcttgtattataaatccaaataagggagttgttacagtgtcactgataggaataaacctcagaaataagctatggatggcatgagagtcagatgatgccatataatttgagttgttattgagattctgaaacatttattctccatcaaaagtatatcactgaagcacactctatattctagaatgtttttttgaagcactatacatgcagaaaaattcccgatgtatataagcagattaattctggctgtagttattttccgctaagatcggcccttacagacttttttcaagttattcgaaatatcagtatttgaacagtgatttttttttaacaacttagctttttatttttaagcttttacctctttgactatcagcccataacctcaagttctcttaaattagtacccttataattgtctctgttgctatcaattatagtacttgaaaatgaaccacaactgagaagaggtttgtgtttagttcaaacaactctttctttgctgcgttgaaaataagtacatgtgttgaagtgtcattttaagagctctgaggctttaagaaatattttcctttgacatattattttagatattattcttgttagcttttgctccatattattgggaggaaagaaagaaactgagattaatgaccttgaaagaaaccaacccttttatattcttcacttctacggtaaaacatttttgtgtgtgtgtaaaaagacatatgtaaataaattataaatgaaagccatggaaaacacttcatggaaggaatagtttttaaaactagggctaaaatcaagtataaaaagccatgctagtccttagtcagtgaaaaagactttaaaatactcttttttgtgccttaattgttttaggtgtttttatataactttaattcacaatcaaaggactccatagtcagtcatttgcttgtggacaaaagatgcattttgtagtttcttgaagaaggccatgtatgccaggtcaagtcagtggtgagggtgccatgaagtactgtggccagcgaatctcaggtaactcaggggccttggtgagacattttcatctgcttacatctcccttcgttcattcattcagtcaaaatgcattgaactcctgctttcttctagatgtgaataagactattcttgtagctcaagaaggaatataaacagaagtattatcttagtaacagcagattgaacctttgcatttacagctaagaatattgatagtgacaagtgtgtgagtttgtcactgaatgaatttaccacttcccttctatgtaatctctttatcccatttgcaggaaaaatttacttgaatgattcattttattaaataataatcctacctatgcacatgttactgttgagtgtgctatctaatatggtattccctaacaaaatgtggctatttaaattttaggctgggcatggtggtgcatgccgtaatcccagcattttgtgaggccaaggcaagtggctagcttgagcccaggagttcaagaccagtctgggcaacatggcaaaaccctgtttccacaaaaaatacaaaaattagctgggtgtggtggcatgtgtctgttgtctcagctactctggaggctaaggtgggaagattcacttgagcccaggaggcagaggtgacagtgagcggagatcgtgacattgcactccagcctgggtgacagactgagaccctgcctctaaaaaagaaatttttaaaataaatacatttcagttaattacaaataaattagtgaaatgctgagaaaaatatatgaaagtaaatttaaaaaacagttcttcatttttactaagcctacttgtggctagtggctaccatattggccaaggaaggctatggaacatttttatcatctcaggaagtactattggacagcacaaatccatagttctcacttgatcctcacgataatcctataaaatgacaagttgtacagtattgtatccatagaggccaggagactaaggttccaagaggttaaataatgtatcttttcatagaacttgagctagagaacttcctctagaagcaaataaatacaggcagatgtaaatacaaataaataaagggttttatctacaatttttaaatcttacaatgtaagtatcttgaaggcagagatgttgtctacctcttcaatattatatgcctaatatctattgcagagtctgacacaagccgaacacttagttactactaattagagggataaatacgtgtagtttttggcccaaacagaaattacagtttaatataattgtaaaaatttggatgtctttaccaaaggaactgctgggtttaaagggttataattaaagttctggttagtaaaagaaggaagtttgaaagctctgctctctattctgcttgcactctctttttagtatagtcacagctaagaagcagtaaattttcctactccgtgatggattcagccatttgaaaagtttgcaatattctatgaatgtgtaggcactgtttccagacaataagtttcaataaaccattgctgaaaacacttattttgcataattgttctcactgtgtatttgtttttaccctagaaaagaatagatttaaaatagcataaatggggcatgcaaataaaatgagtatggtcaatagacaccagtagtgtctcctaaaataataaattatgttttattgtagaatggcatttaaatgttgtatgtcatctatatttcgctatgacttgagtgtacatctaccagtatagaaagtataaaaattgccacaaatagagcttttaggtgttctttttgaaataaaaaaggaatagaacactgtcattatgttttccaaaactgcgttttaaaatatgtgattctaatattatattagcttttaataatatataatactaatattatttaccgatattaaccaaaaacgcaaatatgtgacctatagaagtgtcattattgttcttgccattaaatgagatccgtgagttttcattttttagcttggcttttgaaagagcagtcaatagtatgaaggtattcattcttcagcataattaaaatatatagcccttaaaagcttcttaaataatgaagttggcacattttccctgggtttaacaaaaaaaaaaaaacacatctagacacgtacaccaacttcaaagacctaactcgttttttatagcttagttaatcctaaaccaaaatgctttactgataatttttcacaaagttgccttctttcgtagtcccttctcctgatagtattgattcgtagcctgggttttctgacttcttaggttgtttttaaataacaacaacctttttagtatgttgggatgcttagtaataatttaaatccacttcagaatcatatgtttagggatttcttaagtatatgtatgctctttgttcaaccctttcagtgtgatcatggcacatgaggcttaaagattgcaaaatcaaagaaatagtgatgatgcctggtggtttcttgggaatcttgggtcaacaagcagaagttcaaagcattttataatagggaagcttggcaaggcagatgcaatgtgaaagcttaaacaagaaaatttttatctctagattttgcatactttctttctttgcctgtgttaaagaaggggatacatctgaatttatcccttttgaatcaagtttaagttccggaacaaagaacctgattgatggctatccatttaaatatatatatgtattttttttttttttttggcaaatgaaccttctctttacctccagtgaattgggaaatatatgtagagatttttacaatattatgaattatatttcagtattatgaattatatttcagtgcaagttttagttgctttagtcacttaaatgctagattagagtgttctgtgctgtatccttgagtgtatggctttgaaacctctcacaccattgaatgattgtcaggttgctgcctggaagggtgccccattcttagctttctggctggttgatgctctgtcattgacagactgaaatctatgtgattggggttctggttatagacattgcctaatgtgaaatattacatcctttgattaaaggctgtggaaaacttctgtaagatcctatcttaatgtacagtaaatgttgagttgtttatatattaatgcacatttcttagaactataatactggacataaatttggaggttgccccagttgaagaagctattggccagagagattaagtaatttgatcaaggtcacatctctttttaatagcaaaaagaatacttcaatcttagtcctgtacaatagaggtacaaacatatctctcagtgtactacagcaatattatttgcatttcaaatagagcctttacgtgattttgagatgcctgagacttttctcatgcagtgatttggatatgaacagcgatcacacgtgtcatttttgaacagctgttgaagaaggcagaagatgattatgccacttgcttaatatattacatctggttgctgggaaaatttaaaaattccctggtggttggaagagaaattgttttccctttttggagtatttcattcaaaaactctattttaaactctgaattttggctgctcagtggtggcttaattgtactgcctattgaggtgcacactgagaatggaggaaggattttatgcaaagtgccctttgaaggctttcatagtcctgattccatgtaatttcataatttgggaaagaaagcagagttgtagtgattttttatggtggaattattttattttaccattcagacatcatgacctactcatgtgagaagttgggagccctttgcaatgaaacagaaccttaatcaaataaggcatggaagatttttctttttttttgtttgttctagatggggaaacattcaaaattctttatttacacggttcttctttgctagtatttcctgcatactcaattcatctttttgtttgtttcactgtgctttaattataagccattttgggtggtcattggagcacctttattttacctaaaacagagacctcatctttgcctgcagcctcattgctgtaggaactgaacagaatatttccttggagaacatctgcattgagtaatttttgagcaagtgcctctagttttgacagtaacgcttcaccttttgaaaagaaatcccatgtgatttggatgcttctgtaggaatgtgatttgaaggaggcaatagtaaaatgtactgtgttgaaaattgttttcttagtttaaaaaatgtattattaagtctttcaaattatagtgcatttattacttaccttcacctgttactttggcctacagtgtataacataatgagcctctcaaagagtagctgttgagaaatgaagagtgaatttatttggctctgattattcaagtgatttcataataagcaggagtactattgtattttttgatgtggaatacttggcagtaccctccccctcccctgcagagggcccattgaattaatgacaccttggaagtaaagtccatttcttctgttctccaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggtgaggcatggggggtggggtcgggaggaatatacaaataaaataatagaaaaaatccatagaaagagggctgaaccgggaattgttgagagtgattccaatgacttggggaagttataggagaagaccacataaaagttcatcacagatttgcaggtgatatagttacagctgtgatcactgtagattttaatttggttccttcttttggactgtatgctcatgtttcatacttgtgttataccatttactgattgtctttttaaattcacagtgattctaataatgctgatgagtttactaatttaccgtagtccatttatttatccttactaaatatgactccacatcctatatttttttgacagagctaaatgaaagatgctattgtaaatatatcctattctctattctgcaaaaaaattttgagaacctgttgctcatttttattttaaaatgagattatatattcttctggctttgaacaattctgcaacatccttgtttagcatacaaacagtaatctaaaggtgagaatttttgtactatgtgtgattttggatgtagacttgctcctccaagcaggtaaaactgcttgagttattccagattcttaaatggatgtgggatgtttgtgttttccttctgctttcactctattctctttataaacattaactttcccagttaatcttttataatatctagagataagcataggatatgtatctttatttcatgtatgcattcattctttaattaattgatttcaaaaatcctattgtaccaggcattgaatatacaagagaagacatagtcagtgccctcatggaacttacagtttagtagggaagatgagacacttagatgattacaagagtaataagtgtcataaaagatgaagtacaaggcagtgtgtttgaatataatgataacataacctaatatggtagattaggaaattacttcctcgggaaggagcatttaaactgagacttggttataaataggaattagttcagcaaagcattggtggtaccctgcgtttaggtattatttagtgctcattgggtactttctcattattatgcctttcagcatcaaagtagaaagctttacttactataccaatatgctagtctaaaaatctattcaatttctacatcccatgatattaaacagtttcttccactccttttaaaagttttgtgttagtgcaagtgtgtgtatgttttttcagtcaccagtaatgaagcagttcatgtccaacaataggctcataatgtgagatgttaatttgaagggcatcccaatgttcacagtgaatcaaaatgttcaaaaaacacttacttgagatttacactgtttaatttataaggtcagccctgggaaagacacagtcctgcatcaaatatgtgttcacacttgcaatgagtgtttctggctcctctgatgttagctgcatgttaatttatttctgaggctcgcagacatcagctgctttctgagctttactagcgtggatatgtgtgtatgtgcacattgtgcatgtacatgtgttgagtgatgtaaaaatcagatagtccattctttttttgaaaaggacaaggacaactttttttttgagaaatcttcatgattttctttaatcatgaggaaaccagccagaacacacacacatcttggacctgcacacccacgtatgtgcgcacacacacacacacgcacacgcactcattctgatacatctagataccagctcagttggacaagtggtttttctattgatgcagctgaggcattgcttgagaatgtctgggaaaacagggttttcacatgctttaggtaaacaaaataatcccccaagaaataaaatatgaataaaactattactgaataatgtcagaatttagttaatattcagtgatgaaagtaagctctagagaaaagagaactattcttttcttgttcaccactgtatctgcacgatttaacacagtggcaggatgcctaatgggagttcaatgagtatctttatgtaaatgagatccctgtgagtttttgacttcacagtagttatgaataagctgagatttccaggtgagttacattttaatgcttcactattatatggtcttggaacccttctgaggacctaggcttccatgccaaatgacagttgtctgttcattttgaccttaagtcaacttctcagcattttattagctaaaaattgaaatagcacttgtccatagggcattaaaatattcttgcacttatgtttaaatcctgatatagtttggctgaccagggatcctttaaggtgctgagtagtttatctctaatctgtttctgagttcttatagagatatttgaaatttggagccttacaatttcagaagtcacagcttagtagaaaagataaagaaactcgactgaaagctgaacagtaatagtggccccagagatgtgaaagaacatagtcacgtggatgtttagaacttgatctgctatcaaagcattttctaaaaatgctccccttttaagataaaataagaggacaagtttaccttatcacgtagtatctttataatttaatttgtttactcagattattcatgttgggaaacttctgccataattctgtgttatttctgtgaaatattctaggcttttgagtgctttatatagaagacttaatggtgtagtaaaaattagcataagccatgaactgtataatatgtgaaatcatttagctataaaatgactatagctgagaagcagaagagtttatctagagctctgagtgaaaaacctcagtgtcgattctgttgcatgggtgctttctttaagagctaagttaaacttggtggaactgcaaacatgatctagtcagcaacagggacttagtacattcacttaatgtttagtatttacctataatacccctaactcagactataactgggttattatattccacccatgaatggttttctcactgcatttcttttattatttatcatttaattcaactgtgtacctgctctctattaactgctacttttcttatcaaaattttcagtgttataacttaggtttttggcacgagtaggaggattacttccctacaaaacaactatactagataaaacatattttgtaatgcattgccagacttctacaaagtaagaaaaatttttggagcctttgttctccctttcatcaagagtgcactaaacacagagtagggagaagtgaagggtaagcttggaatgtgaggttacactgagggcaaatgccaatgtcgatgttgcatttgatctgaagactaagcctggagttactcatagagagaaggggacgaatctgagttttgctttaagcttagatcttaaaggtggctaggatttttacattagttcttcctctgacttctggcataattaaacacaaatttgtctgtagaaaagtactccaaattttacctccaagatattgatagatgcagataaatcttacatgagctcactattacgaaaattcaccatatggacaggaaaataagccatcatgtgtgaaatcagtagaaaacacaaataatagatgtatatacccagtcacttcagatacaggagttttcaattataaaatactaataagcattcaaagatatgaatgttacaattaaaaaatcatcaagcaacatgagactatatgaacaggcacttcgcaaaagaagatatttatgcggccaataaacatatgagaaaagctcatcaccactgatcattagagaaatgcaagtcaaaaacacaatgagataccatctcatgccagttagaatggagattattaaaaagtcaggaaacagatgctggtgaggatgtggagaaataggaacacttttacactgttggtgggagtgtaaattagttcaaccattgtggaagactatgtgatgattcctcaaggatctagaaccagaaattaccatttgacccagcaatcccattactgggtatatacgcaaaggattataaatcattctactataaagacacatgcacatgtatgtttattgtaccattgttcacaatagcaaagacttggaaccaacccaaatgtccaccaatgatagattggataaagaaaatgtggcacatatacaccacggaatactatgcagccataaaaaagcgagttggtgtcctttgcagggacatggatggagccggaaaccatcattctcagcaaactaacacaggaacagaaaaccaaacaccgcatgttctcacttataagtgggagttgaacaatgagaacatatggacacggtgtggagggggacatcacacactgggcttgttggagagtcgggggcaaggggagggagagcattaggacaaatacctaatgcatgtggggcttaaaacctagatgacaggttgataggtgcagcaaaccacgatggcacatgtatacctgtgtaacaaacctgcacggtctgcacatgtaccccaaaacttaaagtaaaattaaaaaaaaatcaagatcaccaaaaaattaacaaataacattgttttaattgagaaatataactctcgaaacttaaaacatatggattgattaaactacatattagacaaagagagcaaatgaattaatcaaaatgaggcattagacagaatatttaagagagagcaaggaggggcaaaatatcaaagacatttagtaagatatggaatataatgagctattgtaacatacatctaatcagagtcccagaagaaagaaaatgtacagaatagagagtaggtaatcagtatttgaggagaaaatggaaaaagattttctagaaccaatgaaagacataaatactcagatacaaagaagcgtagcatacactaagcaggatgatgtataggaataaattcagttacacacacattgtagcaaaaatgagaatgccaaggcagagacatccttaaaaacagctgtagactaacaagaaatcgactactcagaaaagacatttaggttggcagactttttattagcaacaatggaaactggaggaaggaggaatattattcagagtttggaaaaaacatcaaatagtcaaccttgtattttctgcccatcaaagctatctcctaagaataagagcaaagcaaagacattttctgataagtgaagaccagggaaacatctgagcaaatccaaacaaacattgcctgtcttgtttatgtagttcaaaaaggaacagactaggcagggcacagtggctcacacctgaaatcccagcatgtgggaggccaaggcttgaacccagaagtttgagatcagcctgggcagcataccaagatctcgtctctaaaaaaaacaaaaaataaaaacatgatctgagtatagtggtgattacctgtggtcccaggtactcaggcgctgagatgggaggatcacttaagcccaggaggtcgaggctgcagtaagccatgatcatgccactggcctgggcgacaaagactaaggtattgcttagtgctactatgtaagtttgaagggaaaatgactagaattaaggtattctaagacacctgaattgttgggagttagcgagctaggactttgttatacatacttggaaaaatttaaggataactaatgaaagaataggaaatgaatgcataacttccaaaactatagaggagaaaaaatggaatgatgaaataaagaacacccataaaattcaatcaactttttaaaaaatggtgagaaaatatgtgggaagtgttagacatgtagacattttaaagtaaaatctataaaaattgtagatatcaaaagtcttaacctgtgtttgttaaacttttccactgaaaagatatcagatgatgtaactgtatcctgcatactgtatatacacctgaaacataagtctctggatgttcaaaagaaaagaatagacttagttataccagcaaatataaactaaaggaaaattgaggtatctttattaatctcatacaattttaagaatttattacaaatagcctatggaggaaagaagggatcattgcataataagaggtttaacttcttcagaaagtacaatggttctaaatacataacacataaatacaaataagtaaagcaaaaagtgatagaggaactacagggaaaacatgacacaccacactcacaatgataaagttttaggaaaattccttattaaaagttaagcacaaaaaatttttcaaaattgaaaagatttgagcaacaaattatcacacctgatttgataaaaatatacaaattctgtaccaaacaattagagaatgtacatgcttttgaagcacatatagagcagttctaaaaattgagacatattaagccaaaaagaaattaaatgtcaaaaaaacagtatctcatagaacatctcctttgactcagtgcaatgaaatgagacctcaatgacaaaaagctaaggattgataaagttatacagggccaatcataaccaaacaaaaagaaagagatccctttatatccctttattaatctcagaaaacatagattttacgataaaacaccttatgagggatagaaatggtcggaacatactactttggaaggcaaatttggcaaaatttggcaatatcagatgttcatattcccagtgactacataattttacttttcagaagaaaaccttttcataggtttgctaggaaacgtgcaaaaatgttcataattgcattttttagaaagaacaaaacaaccaaaacaaagtcagtccaaaataaaaacaggaaaaaactctgattgtctttccaaaaaagattaatttatttgtagaattttcaagcagtggaatgttttacagtagtgaatttaataaatgacaagtgactacaacataaatgaatcttataagaataattttgacggaataaaaacagatgataaagacaagtcacagtgggatagtgttttatataaattcaaaagataaaactatacaaattttcatgttatatgtttatgatatacatatgaatatcatatgcatgcatacatatacatacatatgtgtacatgcatggataaatacatctgaaatatacacatacatagatgtatgtatacatacatatgatatatgcacatagatatatgtatatatgtatgcatacatataagtatatatgtatatgatactcatgtatatcatatacatatactctactgtaccataaatagtactttctttatcatatgtaatcatatctatatctatccatatagaatctcttcctctctacacacgcatagatctcgattcagttatgtaaaatcacattctatgattctgtaatcgcttcagtttttaatttgtttgcgaacttagatgtaaatgaatatgtgtgtgtttatttatttgtatgtcactaacatacagtgtacagctttaaaattaaaaaatgcatcaattctcatcattgcccatgtcaagtaaatatatgaatgaatgatcaatctcactattaaataacttactgtgaaagaactactacaaactcagtaatataattatggtctagtacaaatattaaaatgttcattgttggctaaaatgtggaaaactacacacatattttggtagtgtatgcgatgacaagactgtgtattaggagatttacgaatgcattttaaaatttttaaacagtgcttgcaacttccagacgtaaaatgggtaaaatcagactgaaagagttgacattggttgcagtaggtagtcaaattaatttagctcctgctcaatctctatcttacatttaaatttgtgtatgttatgtgtcatatttttcaaaataatacctaataaatcagttgcttataataccttgaaataaacatgatagttcaattagaaaatacccactatgagacaaaaagttacccaggatgttatagttcaccaaacaaacaaacaaacaaacaaataaaacctcacaaagcaatattacctttatttgtatacatgatttattagaaatttcggaactaatgcttctgaatactatgcaagaacagttatcaagtcttggaataagatacattttagccacagtttcaattccattgacatttgtataaataatttcctattccttatttactttctattttattgaaagactttctacatgaacattttgtagggaatgtttaccttttgaaaggggattctaagtttgatttttaagatatggtgttagtagtgttttttctaccacttgaagatgtgagcacctcatcccatgtccccaaaagccagttactattactgagcaaatcctaatcagattatttcaacttaaaaatgcaagatgagtaaacaacataattattttcatccagaatttcaatttttcttggattatgttctgtagactatttctcctcttttaactagtttacagttctcaaggactgacctaataatccatctgtaattctgtttttgtctttgttcctgctactctcttctcgtttttcattttatcattttacagtggcagtaatgccacatgccactcattgtagacatttatagcaacaatgcatatattacaaaaatgactaactttattagatttcagacctacttgaactacatttaaatttaagtatttgaatcacctcccttttccccacttctgtgataatttatctgtagttgtttgattctgtaataaccaaaaaaaacctctgaaagtctaatcaattagtatttatgatttattcatttactttgatgcttcatttagtcattgaagaataaaaactgtggttaaaattattcattgattgtctttaagatttaaaaaaattactgaaagtaacatgctattatctagtaaaaaagagctcttcaagtgatgacataaatctcaagttaacatttaaaagaaaaaaaacaaggcatccctcagctgcagggttggtttattataaaaataaaaatattatcagagcatagtaaaggagtagcatcttttagctgatttttttctagaagcattcctcaatgctttatgaattatgaaaataattcataatattctctactaatgaatgaaatactactattgtgaataaagactattgtgcattgaaacatggaaggatcaaaaaacaaatgcttttttatggcacatgaaaattctataaagtagaataagaaataacattttttcacagaggttctaagtcacttgaattaaatacaaatttgatctttttaggcaatttgatgtcgtttgcctagagagaaagcatgatttagttttttaatcaaaatttctttgacttgcctccacattgtcgaatattgtatgggacacagtgagattttataaaagtatgtcccaaatattttatgcagcattcactaaaatattcatttattatctgaaatttaaatttaactgagcattctgtgttttatgtgatgaccttgtgcttatgctaatgagatctataaaatgacatctttttttctcagataatatgaagacagtgtttgctgtcagtgtggcaggaggatatagcatttagattaatacaaagcatatatttgtaaaaaatttgaaattagtttggcttaatgtacccagaggttttaggagtttttaactaatgaagggtttattcataggatcactcaaaatatgccatctgcaaaatatctgtgtacatcttaatatttctctgctgctttgtgaccctacatattaaatccagcatcctgaacatccagagctgtgactgtccatttctttgttattaagcagatacttactgtcaatctggatgttttgtgatgaggggaatcaatagatgtgtgagctttggtcttgaccttagggtaattacatatacttgtaaagtgaggcatatgtgattttaatcacataccatctgtgattaaaaaaattgaagaggaatacaaggatttagaataacgaagaagacactagatttattcttggattgaatcatttgggaagtctttatggatgcgggggtggttaagttgggtcttgagaaatagaggaaaaatttcctgaatgtctttgaagttttcatgttaatgctgatgaaaagaaagtgcatttagtaggttggaggagagtccaaattaatgtactttcacaatgactaaacttttattcttgagaaaagttttcttttactggggtttattataatctagtcttattatttggaagtgtgacattacattgaagatcttgtcagttattattgagagactgatacatgtcagaaaatatgctcaaatcttttaggtactaattcctgaacaaccattgctttaactatcaaataacgtacgtgaaacagtaaccatagacaagagcaaaagtattctattttgccttcaatatttttatgttaattaactcttctgtgcttccacttctttatctgcaaaatggggtggaaatatatactttgtgttattgctgcgggcaatatatgtaaatgacctggcactaaagaatatttaaagacaatctccaaacaatgataaagaaaaaatgaattgggattattcctgacaattttgtgcttgtagtttattttataaagctgtgaatgttgactcagaaggtgtatgtgacttaaaaactataacaatgttgccattcataaaaaattcatcttggacctgagtatggtggtgcatgcctctaatcccagctactcaggaggctgacgtgggaggatcccttgagcccaggagttcaaggccagcctgggcgacatagtgagacctcgtttcttaaaaaaaaaaaaatttatttgggaatgttctaaaagtgctgaatatatacaggtatattaagagtacactccaagccaacacacttgtcatgagctatttatgaccatagctgcatgattcttgctactcaaggtgtggtctggggaccttgtaagaaatacagagtattatcaggatctgggaaaatttgaaataaaagaagaaacacagaatattagattctaccctagtcttccagcatcagaatatgaatttgaatgaaatccccaggtgatttttacacattagtttgagaagcactggtctaaattttagtataggttattgaaaagttcatattgctccaggcttttgacagtaatgttgtctttttaatatgttttctgtcattcagttagaactgataatataaggagaaaggagttgttcaagtctcaagagcactttatagcaaattgccttttctgcttcacctagtggtgttcaatagcctgaaagattgagcagtttaacagtttactgcttaaatgtcaagctttactcttttttcattaatagtagtaagacccagagtcttaagattctgaataacaataatagtaagatcattacctgtattttattaaagccttgggagttaggagatgtcttgtgagtttattcattaagttgcttagagccatgatgtagctagtaatacagtttatgggtactggtccctgcgttggtgtcatttgaggactttgttaaagttaaacatttagattctcagattatgcccaggatattctggttcagtgggataagaaagacttggaatctctatcgctgagaaagaaactctttgggttgcaatgctgcccagcctgttttgcaaaccattgctgtagtcagtttcttttttctctgttagaagaccttttccatcccctgtgttttcatttggcatatcgtcagtagttaacatttatataaaattagaaaggtaggaagtggaaagtagaaaaatataacattgttctgggagtttgaagccctgtgttcttgacttgatatagataaaatgggcaaggcactctttctccattttactatctgtgaaatgggccgtatacttcagtggaacatgagaacctgtagacatgagtgctttgaactttcaaaagaagtgtgaattgagcttgtttttacaaccttgttgtaatatccttccgttaaaatgtgttttccttttcgacataaaacctgggtctcacggaaaacttacccctgcactttctgtttcctttgtactttattcctatccccactcttctctgtgttcctacagctctccagcacctgtaccatgggcggttttgcctaggtcggttggttcacgaggtcctctccaggatgatgacagcagctcctgctgagacatgccaggagtcagggagttttcctttgggacaggaacttcaaactagaaaacctagaagactcagacaccttgtctcagggtgtcataccctgtgatgaactcatgttttgggcagggacctaggaccttgtatatttaggaagaagtactagttaaataataggtgaagattatgtaacttcaatatctactgattctgcaatctagaaatattcttaagcgacccctattccttcatctttattcagaatcagtagacattgaagtaacataatcttaattacttagctatattcctagatatgccatgttctaaacaactttaatgaatacattcataaaacatccttacctcccaaggttttaataaaacacaggtaatgcccttactgtctttgttatttagaatttgaagatactggctctgactgctattaatgaaaaaagagtaaagcttgacaattaagcagtaaaaggctaaactgctcattctttcatgtcattaaacgccgctagatgaagcagaaaagcatagaatatattctactgggccatgtcctaaagcaaaggatcttctaggacataagcttggttttaaaaatgttttttttttttggtcatggttaaggtacatgggggaatggcaatgaatgataccaaaacaccagtttgtaagtttaaactcttgcagaaacagtacagaatgtggattcacagagaacagaggggctttatttaattttaggatttatactgattaactctcatttatttacttattatgcacaagaaccatatcaggagacaactttattttcattttgcagatgaggaaactgagacaggttcagtaaattattcgaagttacttacattgtagaatacagagccaaagtttgaagcttaagcattctccttaagagtctacatgcttacatgtggttggtcgtttcaccagtaagaactgagagtctaccgtttgaaaataattttgctttgtggtccacaggaattttgtatttcttttcatatatgttgatcccttctccttcttgtcaccctggtatttacagtcttgatatcttgaaacagaatcactatgattctttggcattttatcactggagttaccagttttggtagaagtgtcagtggtaatttgtagttttaatttataggcatggatttctttagagaattcaagcagagatctcaccatgtcaaggaaccacaaatatgctaaagtggacagtgagtccattataaccatcttggggtgaaaatcaatcatggtttgttaagtgctttcagaagttgttgttgctgttttaatttccatgactcgatatattgtgtagaatatattcagtagggtaattttggatttatgtgtttatctcccgttagattaaactagaatgtgtgtgggttttttttgttgttgttgttttgttttgtttgagatggcgtctcgctctgtcgcccaggttggagcacagtgtcgtgatctcggctcactgcaacctccgcctcccaggttcaagtaattctcctgcctcagcctcccgagtaactgggattacaggctcccgccaccacacccagctaatttttgtatttttattagagatggggtttcaccatgttggtcaggctggtctcgaacttctgacctcaggtgatctgcccgcctctgcttcccaaagtgctgagattacaggcgtgagccaccaggccctgcctagaatgtgtttttgataagaagcttttgtagatgagctccacagaggttctaggtcctagattttaggtattgtctattgtcttttgtattcttagtcctgtttttgaattttctggccttgacattggtggcaagattattcctcttgttgataatcgtcttcacgttaaaggttaggctgtttccacttgagggaattaattttactattgtgcttttatggtcaattcatcctcccattatttgtcatttgttgtatatttctttactacttaaacaatgaaaaaaatagggaaaagattggaaacaatcttctgtaaaaagtaaatatggatatttactcaacaaaatgtaagctcttgtatgctacattaagcactctcaacaaatacttgagattttgtttcatgttttatacctttgaattttccttccataaaataggaacattcttttggaatttcagccatcagacatgtcttataaaggaatgaagttattgataaacattacagccccagagtaattaaaacatgcatttgagcacctactccccagctgattgccttcctttacctttgacgagatcccctgtccctaccatgacctacaaagctctagataacccttcaagcttgtcagttgacattcttcctctcacttattcctctaaaaccacaatgtcctcttttcagtgtctcagactagctagaatgtggcttcctttccccttcctcatcctccaaggatagcttcttttcaccctttgatttcatatatctccctcagaaagtccttcctgattacctacgcagccctttataccaattactatccatttcattcttagcacctgtcactctttgtacttaatagacttatagtcatgtgaaacttcctgtctagtcattcctgacgagactctaagcagcaggtgggcaaagactatatatcttttattcaccaatgtgtacccagtgcctggcaaggaaatattttgatgattatctaaaattacatgtatgagtacataacttgcagtatcttacagctttaagtaatagctcacaaaatttattttgttactttaatttggtaattcatagcaagttatatcagggaagtagaaagtgtttccctgatatttatttagacagccatacacagtttttatagttaaacaaaatatgactttttccacatcacttgtgtatctttcgggtatgctttttacagtgcaatacttctgttcttcttttttaatcaaatatttgtcctaatgtagcagtcactgttctctctttaacagcagaagatggtagggaatttgataataaaattgtcttgttttatgccatttaaaaagaaaacacacacacacccttttaatgaatatatttgtaaagcctctattatggtgtttgacactcaacagacactcaatttcttgaatgtgtttacgttctcatagatggatagaatttgtttagagaaaaatcatgggttataaatacatcttattttctagactttacagatcagtgagcaatatttaattcactaaatggatttaaatttgatgatagaaaagaacactttatttcttttttaaaatcatttaataatttgataatgatttattattttatatttaaatttagttccttttaatatatggaaaagctgtacaaagcatttcagcattagaaattgaagtgtatctacagggggaaaaatcctcaatttagtttaaataacagaaagtgaaaagggcattttaaatcaggtgtgaaaacttaagaatagtgacttaaatgatataattcatgattatccatcagggtaaactgcatctatcaaggcaaaatgaacagagtggggcatttaacagtaattcaaactaaccagttttaatgctaatcacctggaatgtatgcgcacaagcacgagcagcgtgcgtgcgtgcgtgcacgatgcgtgtgtgtgtgtgtgtgtgtgtctgtgttatacctattactgctaatataacaagggcactttgaactctttatatagaactgaaaatgcctgttaattacattccagttttggggtgttaagaatattgcatttctttctacctactatattgcatgagtaggtagaaaattcaggtgcttaaaggctattaaaaataaaacaacccttcagaacgctgtctttgcagtaactgttttcttcttctccaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgggtaggatggtttcatttttaaataattcctttgttttgaagggcaaaaggaggaacacacattctttctctacaggattgtgttgtgtgtgaagtgaaacttaatgatctgtctcaatctggggatttatactcctaaggccaaagtggcagcaagtaactcatgtgtgtttgtgtgtgctgtgcacttacttgatacagtgttaggcagtcacttgtttgtctttgctcttagctcagattgaatgttggttaatcattcctggtgactatacaaaacaacaaggccatatttggagaagggaggtttagaatcccagaaggatgtacatctgctacactgaaataactaaatgacttttaaattttaggctgctatgacaatatatggttaataaggaagtcagaagagatttaaatcactaagaatgtaatgtccttgatgagatgttcataccaaaatacggagttttttaaaacccacgatataattatgtataaatgacaatgcttgttgttgtcgagttgccaacaagagggggaaaaatgagaaaaggctaagtgtgaatagtgtgaaaagcggccaaagaagagtgccatgcatttgatatgaacaggatcttttagggggaaagacctagttccatgtggaaaaagaaaacaaaacctctgagtaaggtaagatcctcgattgctctcttcatactatgtagactcagcattgttaaaaagtattttagattttgaaaattcatgagctcccaataagtgatagttgctcgatgcctaagacaccacctcttggacattttaccttaagtctgtgaaagttttgagcttctctggatgattttgaagctttgtttgtgcatagaaggtaggatcagaaaccagctaacctttacaaaagatccagttgggaaatagagttccattagccaggtgctttgacctgcgggtcatagaccagtgagttctctctggatgtattctggggagaaaaattgctcttcccaatgtctgcttggctgctctgctctcatttcctgcagattctctgaagcctatctgtgcttctcagtattctctagcggagttgaaaaacgccccttagaggtgcacagttaattatagaagctgttagctttcccatctgtagtcatgccctggagctaagagaaggacttgaatacagaagaggagatgccccctgtacagagagaaacaaagaatccttcctgcagggaagaagcaagtttattaggagtaacttcgggaaaaaaagagaaacagtttctgtgcccttcaagagggggttcaatttagggaactcccctccagtgaatatacatggagctgcatttttatcattgtcaatatttgttgttttctcagcatgtcattactcttctggcctcaagtgactcatggcttctggttataaggcgggaatgaaatgtcctatgttttattaaattcatactgcattttgagagtatggtatatttggggaccttatatctatatcactggaacccctttccttcctttttctacttaaaattggtttcatccatgacatcttcatttgacgccatattgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaaccgccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattttatatttgaatagtgcttttggaaatcaccaattttattggatatttggaataggaagggtagccaatttaatttattgggcaacatttaggttattagctgtatatgaaatttttaatgtgtacatatcttagatgatgagctttttaagacacctaacagaattaagaaacagcccattctcattgtgaatttgacaccaattctactttggtggtattagttggtattctgaaattatcataccgaattacctacctctaattcattaccctaccagtggtagaaaaaaaaaaaaaagcagaattttgaggtcatgtttactaaaggccaaaaaaaaagtactataagtttatagtttcagaggcatagttattagtgaagatgtcctgtaataatttaaaatacaccatagaaatatacagatataatttacatgttttgaacccaaattacagtagtgtataaatatatgcctacagaatgcatgtttatatttgaaacaataaaatagaacttgaaagtaactacaattattcagaaattgtaagcaatttaagaaatgtaaactatcagattttaaaagtacctttttaattaaatagttttttcaatatagcattaatagagcaagtatattaatacatttatatatacagtttctaatactaaagtaaaacttaatcatttaaaaatactatacagagtgatatcaagaattaagtatggaaaacttgcccaacagaaaatgttgatttaatatagttcaatactatgctggtaaataatggaaacattttgaaataaaaggctgaatgtagttaggattgtgttacaaagcacataattaaaatgttgctttcagcatattagtctttctgataacttttttttttaaactggttttagcaatgaaagtttgctgtacttctcaaagtgaggaaggaaatataagaatcacaagaaaagctaaaatttcgaaatgttctcttcattaacattagtggttttctcctttttttggcttatgtcagggtcagtgtttggcttttagttttgtgttcaatatgatatcatttatgtatatttttatttagtaaatgtctatatttttcccttgttattagtatggaattgatcttgatataaaaattttcagttgcatatgcctctgtgttgacttctgtgctttgagtatgacaaaagccacattgccataaacttgatcttataaattgctctaggaaaactaggcttttttttgcatattaatcacacaatatttctacaaaatttttgagtattttcttgtgttagtaggaagaagtattaagggctttagaatctttgctagaaatagtctaagcttatatgacaactttattatcttaacatttctagaatagatcttatagaacatgaatcacctcctgaaaatggttaccaacatttactaataatattttgaaaacccagtgtttttatttaaagtttaggtctgtgaagaggttaacatgtttaaaattacctgtaccaacagtataagtaaattattttatatattccaatagatgtttcttaatcattttaaactaagtagtatagtatagtcagcattcatgtaaagttgtatacttttctgacaagtttttttttatgatgtacatctacacaaaggtatttattttttagataaatttatgcagatgcaactgtattaattttattgtttcctgaataagaaattctggattttatttttgtaatggaatttttagattggatattccattgcagaaaacttggctttttatctgataactacatgaataaggatccaaaaatcgatcattaaatttcacaaaaaaattaaccaacattgtgtagtttttcatttgttaataaaatacggaagtacagttaagcttattgggtgagtctttagggggagctcatggaaaatcaacattcaggtaaactcctccatgttatttgtcaaaacggaatgttatagataacttgtagctcaggttcttccataggttcaaatgctgtagttattagagcacttttttcttgcagctagaggaaagataaatctccttgagattgatcttggtttccagtttaaatttctttagaaaagtctgtcagttgtaacatctacattttgtgctacttggcttcagcggagatgctcaaccatgggcctggggagttgagttccaagttctggaagttgagttccaagttgagccactgactttcaaaggaagggcctcccaggatctccgttcatctgtcgcttggagaggatcatgctgcctgccaccctcacaggagtgttgtgcagcttagttaattaacgtttgtcaggccatttgagatcctcagatgcagagtgctagataagtggaaatagtctgattatttgttcattttgtaagtgtgataccaggacagtacaatgagaatgttatttccccttttcttcagcagcgttaaatttatagtttaaagattgttgataccggacagactattgagatgcaaaaatgttcttttggggacagtccattggcagccaaacagacgtttaaacaagtgacaatgttgaatgcctttacaaccactgacagaagactgcaggagcttttttttaactaaagatggtctgaagtgaaaagtgatattcattgttttgcttcatatttaattaaaatgaaagcaaaattccagttatcaaagaggtagcactgacttaatgtttatgtacataactgttttctcacccgatttggactttttacatgtgcataagtaaaataccaaagagatcagactatatcaggaaaaatgggaagtatatacctctctaaacactggttatgaagccatgactttaggccctgttggtagtttctctttaggtagcagttgatattttctttgcctgagagtaaaataaatgattaaaaactattgactatatgcagagatgaaaaatccttgtacatgtctctgcttctgtgccatatagatgtatttctgttgacatctatttgaaaaatatatgatttaaactcaaatatgttttagtttagattttaaaaatacaatccatgtatcaaattcattatgtgtaatagtgaacatgacagttctgttttaccgtgtaaaagtgaagtagctttttcttatttattgattattcatcttttacatttatataccatttttgacagtagaaagttgtcaaattcgttccatattccataggtatagaagtttggttttattagtttgattaatgagatttttaagcaatctaatttcttttctataagtctgcttcattaacccacacattttttaaagcactttttttttaatgcacacacaataattgtacatattgtggggaacatagtgctgttgtgatacatataatgtgtggtggaaggattagggtaatttgtatatccatcacctcaacatttgtaatttctttgtattagggacattcactattccagctatttgaaactacatactgctgttaagtacaggcatcctacagtgctacagaacactgaaacttactcctcccgtctagctataacttcatatccttcaacaaatctctgcctattctccctttccccctacccttcctatcctctaatatcttctcttccgtttttggtttctacaagataaattttttttttttttagcttccacatataagtgagaacatgcagtgtttaactttctattccaggcttatttcacttaaaataacgttcgcctgttctattcacgttgctgcaaatgacagaattttattctttttttatgactgaatatattccattgtgtgtatttacctcattttgtttattcatttatctgtcgttggacacctaggctgattccgtatcttgattattgtcaatagtgctgcagtgaacatgggggtacaggtgtctctttaatatactaatttcctttcctttggaaaaatactcaggagagggattgctggatcatgtatgtagctctgtttgcggtttttttgaggagcctccatactgttctccatagtggctgccctagtttacactcccacccacattaatagcacttgaaaaacgacaacaacaatgtttttgtaacctaggctgtttgtgaggtctggcatagttctgctggcccaggtttctaaagcaggtgaagcagatgtatcttagtgaattggactgtaggtttgcagctactgtgaaatgttatcctttagtgcagtatctgttcattatttcctatataactatcttttgcttggcttctcttttccatggactgcatgagtcaggacataacagggcccccaaaagaacccattgttgagcattcttagatgttggaagtgaagagtatacagaaggtggcccaagtttcaggagcacagggccagaatgattcaaaaatgaggtatgtagtgttgatgtgaatctggtaattttccggcagagcccagtctgatgggtccattttacaggcacattaatacctaaaatgccacaacgaggttttattttggatttttggggattttgttattttcaccaaaaaggtaaatattatctccattgtctctcatatatatatatatatatattttttttttttcttctctcccttccattagatactgttcaaaactttccttaagtgtttgtaagcaaaggcattgattagtagactgctctgcttgttaactcaaggaagcttggcaagctaggtactgctgtatctagttgtgttatcagtttaaggaaaggcaaattgtttcattgatgtttgaagaccctttttccttttggagaagcaatactacttatagacttttattatgaactataatttacaaatacaaggaagtctggaacacagctttatatcagtggttaggagtgaagcaaaggaatcttagttttgtttttttctgatgacagcacacttgtgataaattgagcgtttggcatcattgttcatctcagaatgattaaatgcctccctctcacttgtaattttatatgttaacttgcctcttttaaacaaggcagtttcttaattttgaagaattactttggacatattaattaggaaaaggataaaccattttctaccatggaaatttatatatgtgtaacatcatgaataaccagaaaatgctaagtatatgcactatagatatctatttttaaaggcaaaatacactttataattttgctaccattaaaaaaggtactgattatgaatcaaacttttatgagaatttaggtacaaaatggaaaagatttttaaaatagatttctggttaaaatgatattttgtgtgaaggaagtgataagatccctgacaacatgatttattgaattgcatttgcctgtagtgttacatttagtttaaatttttatacaagactgatgcttgatcataaaaaaagtcttggtagacaaagcacatagaatctcagggaattaactttctgattgtagctatatacattgggtaacacaagaatacctgtttgtaggtgttaaatttgaattcttaatgaagaaaagaaaatctggtgaaactactttagaacaattgtataggaaagcattacaaaaaatatttggttaaaatagacggatatttataactggttgtcaatttagcattcagtttctaggattaagcttactacctttccattaatttattactggatggattcctttcatcctcaccagaactctttgaggttgaaactattattatccccatcatttaaatgagtaaactgaggcctggatattaagtattttgcctagatcacactgcttataatggcagacattaaattctagctctggcaattctagagtccctgctcataaccattgcatagcctcttttggttcaatatggtttgctaataaatacttgggtgactttctacagtttcagaattaatttgtttcatctaagcatacacgtttttatgtgtgtatgtacaaaacaaaatacctttttgaaattacataagtgatacatgcttattgtgaaagagttggataatacaatatactgtaaagaagatgaaaaccactcataaattccaacctgtaaatactttcgtgttcatattttggcatctaatgtatcctttatgtatatttaaatatatattttattcaagtataggatcatgtacctccctgttttataattttcttttttaatttttcagtgtattgtggacatcttttctcatcaacaaatacatcccacaatgttcatttttgtgcctcattataccatggaatagtgacatcctagtatgtttaagacattccttattaatgaacaattaggctacttccaatttttaattataaaggacattttgaaggacttccttgtacatattattctattgctttatcatctttttgggataatttcatgtagtatatttccagttatttaaatgagaaagtacatggtttataacaaatggtatttaacgtccaagtcactgctatctaaaggggtaatttttaaggtataaaataatttggcttataaaaaatgcgtgggaaaaatatcctagaaatatttaaggattaacttctaaattgtaaattgacatatttaatgatagattcaaaaaattaggagaaaagcaagtggcaattttatcacatatatggaatacagtacatgtccgatacaaggtaaatagtataataagcttactttatattgcatatgcagtatagtttattctttagagaaattgatttgtaagaagaactcattttcttaagcagagttgagtcaagggttttaattaaaagcagtctactcaggctttgcctttctcgggcgaataatttctctcttttctctgcttttgctttgcctccatggatgatgctcctgctacccttcacgctttgtcaaaccagttttgaagttttcgccttcccccgatgtatgtcgcatgtgtgggtaatggcatgggctttgagggagtacaagagaaaagaattgatttctcttttctttaaaagatggcatttaattatctttgtttttatttttttgctgaaatatattaaatgcacattgattccgttaagtatttttctttgataaagttgtcagaatgtcagaatatgctttttttctgttattgatgcataatatttcatacattggtgaggtatacgtgggaattttctgcaaacatagaataaataatggtcaagtcagggtttttggggtatccattaccttgagtatttatcagaatttcaatgtgctggtaacattttaagtcctctgttctagccattttgaaatatgcaatatattattgctaactatagaatatttttattattttttatgaaaatttgaagaagcaggggcaagaatactttctgaattaacattgcatttgtgctacctatatgctaaaaatacagattctcaggccactcttaaccatacatttataaaaagatgtatgatgttatttatgaatgtttaagacaaacaagttaagccactcttctatatggaatctaaaaatgtacaaacactgcatttgaaagagacattcactttacttaaaaataattatttgctatttttttaaaaaaagactcagagtggaacttttgaaacatcctcttttgtacattgaacagtgaaaaaaaactttacttgttaacattttagaagtatatttgtttgcaaaatcatggtataattgaaggcaatactggctatattttaggagatgcacatatttggcttatctaaatcttagtgtcagaaattgcctacctgaaagttccctggtaatatagaaaaatctgtcctctttgcctgacttacaaactaattctaagaaggttggatgtttttaaagtgtaaattgtctggatggacagtttgtggtctacaaatttattatccagctaatactgtcataactttatgctgtgtgactactgagtgtttttgagtttttaaaatcagagctttcctcaaattcacatgtgattaaaatatttttgaagagtctaaaatatatactaacctttgaggttccagctgggtttggaggtaggtatgctccacatttaactctggctgtggttcaggcctgcctgtattttattttctggtaaaattagatgttattttttctttttgctcttcccttgtgatgtagtggaaagtgctctggattggaggaaaggagactttgtgttctagattcactttgtgactaactagccgtgtgaccctgggtgagtcactcaagcctcatatactgtttcctgctttggaagattatagtttgaagtatgcagtttctcaaatctctttacaattgcagagtcaagcaaatctagagtcaagtaaatttcctttaaaaccttaaacattcagatctatgaattgatacccgaggcaactttaagacaaaatcttatattttggacgtagtgatgctgatgtccaaagatctagatctatatctatatctatatctatatctatatatatatatgaactacaaattcttaaatatgatttccaaccagtggctgagaatccataagttataagcaactgtcacacatacagtctgaaagcttcaaaaattgtattatttgaacttatcttgtacaagaaagcccattctttggaaacaactttgctgcaaaagaatcatgtcaaggggctgctgatgaatgaagttaaaggaaagtaagcacaatgagaaaataattctatgagaaagtgacatgcttaaagtctccttcctcagtttcttggcattgagcgatgatgcctgttttgttcacagtcagatgttcaaatcagaattttggatgcagaaactaattttagtaggtggggtgcaaatttcttatgagtccatgaatagactctaatcccagctgtttcattacaattataaaaataaaattggctgtgaatcattcaaactctgtttaatggatgtgaataattcagtttcatcccactgaaatcttaaaactataaacctatctttgttctttatgttccttcagagatcatatgtcattactcatatatgaattatttgaagtatgggtgatcatgatgaaagtgaccaaatttctacttagctcctgtgggtttcaggagaggaggtggcctctagggtgaggctagggattaagtggagaaacaaattgggaaaagtccaggaaaagagaaaagggtgttaaattaggatttcttggcattatctttcctatcaagatatatgttcattatagacattttagaaaatataaacaagcaaaaagaagaaaataagttttcaacgtttttaatgtatttacttctggacacagacacacaggcacatgcacactcagacatgctcactcacacacatagacatgcacctgcaaacatagatttgtatgtttattattaaataacttttaatttcactttctaataaattacacgctgttttatagcagcgtatattctgctacatcatatttattgacttcatagtatttcactatatgttgtactagttgtcctagaaaaactgtctatcgatttcttattgttggacatttatttctattttttgctattatcaatagtgccacttttagtatgtttatagctgaataattgcaacttgcttgcgattttaaattttgagaattggcgtcccaacagtcaggctcctctatgggaccacacagtagtagagtttattggcaagcataggtcactttaccagatcatgtatatagactcctgagaaacaggaaaacagtattatttcttggcttccattattttgaattgccttgcagtgatagctaagaaatagaaaccctgaagttttttaaacattattatagtggaaaaagtgaatatgattatttgaataaggtgcatttcttgagcagcagcaaagaatcagccaggtattgattttactttcataattgaaagatttctcagtcacttggacattcagagaatatttcataggacaatgcacttataaagttatatatatatatatgggatttaactgccttcaaaacatttcttaatatgtcaaatttcttaatgtgttttggtgagcacatgaagttgatgccagtaactactcagtgaagtgtttggtgcacaaactgaattttgaaatatttaaattttctttcatttgcttacagctatttgtacagtttattgtaagataagaatgaaaatcaggtgttaaagcaaagagtacaaaactattctatgtcctgtctcttttcagttgcttctccaagcattagacttctctaggcaaagtcctttcataacactagagattcattatatttggtagttcatgaaattttaacaagacacacttctgtttgtgggattggaatgcgtgttggtgagtgtccgaatttaaatatattggtattcatatggattcaggatttattttcaaagaacagatattcactagaccaaactaacctgtactcaaacttgaaagaaatagaaatagaaaaagcagaggataactttgtagagttaattcctgatatactggtctctaaagtttcttgttgtccgataaatattaatttagcacctgctgggtttcaggcaggaactgtggaagaacttataaagggtatgaaaatgagtatatcaagatttctgtactcaagttatatacagttagctgtaggtgataagacaggtatggtgacagctaaaatacaatcagacttccataaaagaggtgaagggagacgagaatgattatgattgtttaaagaggaacagatcacattgtgttgagaaaaccgacttagttgtcccaaaaggttttctgagcttgtttcggaaaggaagactggacttttagcaggtgaatatgacagcatgaagggtaagccaatatagaagaaacaatgtaagattacaaggggcattttcaggatataggaaagagaaaagcttgatgaaaagttaggtatagtatagtatggggagctaagacttgacataaaggttaggataattttctaaaatgtttatttgaaaaactttatctcagaaggaaatagggaaccattccaggatttgggcaaaggataatttgatgaaacctttaatagggttaatatgaccatcttacataggttgacatggaaaggaggtggacggggttgaggtgacgaagactcattagtaggctgatctcttactctatgagtaataacagggagcctacactaggataatgatgttgggaagtgatttctgtagctatgctgagcagacagtcttcaagagttagcaaagtttatatgtgcgggtgacaaaaaagaggctttgagttttgatgactgaaaggagacaaataatagctaatctttgataaagactaactatgggcaaggctttactctttgtttgtagtaacttacttaatcctcattataacccctttatatagatgctgtattttctccattttacagagaggaagtagagcctcagagatgttatgtcacttgtcaaaagtcacccagctagtgaatggctggatcaaactggatcatgtccaagtagcctggcttcaaagttcacacgctttactatatttattcttttttttttttcttttgagatggagtttcgctcttgttgcccaggctggagcacaatggcatgatctcagcttaccacaacctccacctcctgggttcaagcgactctcctgcctcagcctcccgagtagctgggatgcgccaccacgcctggctaattttgtatttttagtagagacggggtttctccattgttggttaggctggtctcaaactcctgacctcaggtgatccacccacctcggcctcccaaagtgctgggattacaggcgtgagccacggagtctggcgtatatttattttcagtgtatcattagcagaattctagagtcagctgttctgtgagggtaaaataatgaagctggttttgtacttaccaagtttgtaaggcattcagatgaaaatatctaatggatagctggaaacgtaggctgtcatagggaatagaggagttggaatgacttccaaattaactaacattcatttaataattgaatataaactgaaagcctagtttgttcagaatattataggagcagcattaccatgactaagctatagacactgattctttaagacttttgcaaaccagtagcaaaaataatgttcaataaaccgattacagcacaagaaaaaaagagtgtcaggtaccacagagtgagaaaaaacaacaacaataacaaaaaaaaaatagcaaaatgttgtagaaatttaaaaaaggaaatgaccccttctcaattaatctatcaagacagtgttccagaagaggttgcttatcagttggttcttgaaaagtggtatttggaaagcttaagaaacatagtacactagcctacagagaatctaagcagaagttgaacttttcactccaactaaaaatctatgttaaaaaaaatgagtgaggccccctctgcagtgaaagttactattttgacatttgtgagatcaaattttaagatcctctgggtatgtcaaagtcttttcgtaattgataggattcagaaacaccacaaagacatgcatgctttaagtatcttattgtaaccagctaaactaaaagaagagtacgttttagaacagaaggtgggtatttaaatcaaagtctaaaataaaaatttaattgtttaattatgtaaataacttcaaaacgtttatcttcttttaaatatataaatatatatgtagggtgtgtatatatgtaaatagcgtttattcagatataaataaaaaatagccctactacttagggtcgtatatacatattatcaaagaaaaaaatatacatgaaaagattcttgaatacccatttaaaaatgaatgccgtatttactatgcctgttggatagattcattatatataagaactatcaaattttagttttatgtattggtgttctgatttattcgctaatcatttctcttagatttaacccagtggcttattttcaagtcttgtttaatgtcttattttataattgaggaaaaaagagaaatgcttgcctgtgatatatcacctgttgtttaatcgctaacactgttacatatcttaatactgtatcacattaagtcattttaaaagcattctgctttcccttttgtttaaaattcctacgatccctgggatattggtagggggttaatggaagtcttgattaaaatcttccaagctttaaggctttcagttcttgtaaacaatttggatctgagagataggcctatttatgactttttactagcctatttacccatttaatgttaagaaaaaaatatgcttattaaaagttttgttataataagtacaaattaaaatgtcttttaaaaaatcagccacacttcgttgtgtgatgatcacagaatttatggtagttcttttgaaaattgtctgaagatgtattataatcattttaaaagtaaaggaactaccctgagtataccaattttccattattttaaacaaaccttttaagttttatatctagattgcttttaagtagttatttccaaacttgaaggactatgaactctaatcataatcaatctgcacttgtgtcataatagctaacctaactatatagtgggtgaaagtcttggaaataggtaacaatacagttggagtttacacttgggcttacaggcccagtccagacgattgatccagtggaccagcccaagctagtctgacctttcttatggctggcaacactgactgcacagtattctggttcggtcagaagtcttggttattctatttttaatgaacagacatgctgagtttcaaacatggtggttttggtttacatgggattgagttggcatgcatgtagtttccagttcttatgattttaaggtatcaatttcatggcaatgttggggtttctgtgatactccctgggcttgaaattgaagttcattgaagtgtgagtgtgtgtgtgagtgtgtgtgtgtgtgtgtgtgtgagtgtgtgtgtgttttttttgaggtttttccactaaaagcaaggagcttttagacaagtatgggacacagtagaacaaagatatgagagatactgcaaatactagttcttttaatttatccatttgcaaattttcctcctttagcagactgagagctcctgagggctgtgcatttttatatttttgtttcttgttggccctgttatactgctaatcttttaggaggtctaaaatcaatatatctttaatggaatagaattatatgaggaaatatgcattttttaaaatttggaaaaccatattttatttgctgtatgagactgccgtaccgcctgtgtaaattttctaccattaagattataattataaattgattattatttgtatactcttttaggactgatgaattagtaaattattactttgtgcattatttccaataacctttagggtataagattatctagtgagttacttactctggaaaaaatcaattacagcaatttagggttcgtataacaataaaaaggatttgagctttaatggaacattttaacacttggcatgtatctatatctacatatatatctatatatatcccttttttctgagttatctggtgaaacagagatttctttatagaattttgtgacacaggaatctagagacacaatctgccagtgcatttctaggttttaaaagtttcagttcaaacctaaaaagtctatttgttaaatcatgactccaaaatttattttttatataccttctttttttaataaaattgactctaggttcaattttggttgaacttaatcagtcttctttctacacagctatattattagtttatatagaacacagtgctggcaagtgttgaaacaaaaatgtgaagaatgatttaccataccaatatactgcttccttctaaagaagggagatattttagaatattagatactgggctcaagataaccagaaatgtgtaatgggaccatttatctatatcattttatggccaagtcagagaagcaaaggcatatagcccagaaagtgtgataagaagaagagaaagatactagtagattattattccttaagtctgcagcatgacttaactagagacaaacctggatacgagaacttgaaagcttttgtgaactcaggaatgcatatgatgtttgtactacaaactcaacctcatcatcttaatctctttgcctagaagagatgaataaaagtacaggttatatttatgaaactgaaatctataaaggcatggagctcttttcctcaagtgggaattcttgtgtgtttatttgaccctttagcaaattagtggaagtaaaggagggagagagggtatagctgtatggaaataaagctggtgaagtattctgctcttctgttcttcttagtcttgatggtgaaccatgcctacactatactatcactctggtaccagatttattgcctgccaggattggaattcatgcagagaggaaggattcatgaaaaaaataatcaaagtcaggaaagtctttttctgtaatcttgtctcatacagtgagttatttttgtctgggtagtttacggggatgtaactccttcagtcatctaaccgtgatgtagtaaaagtcatttgcaggaaatgaaactccactttgttacttttttcacttaaaggctaatctgattagctttaaaacatttgttcatcttttaattcagtatttgtatgatgcctatggaagacatatggatttaaatagaacttggctaaccatctgccaataagagaaagtgagatgctaaatcagagaggcaggaaagtctatttcagtaaaagctattttgatctgaaatactgtaggcagtcttacagagtattttaattgggaggatattgatgcatgctagtaaaagaagtgtatttgctgatatggttgaagttatgtaatcattaaatttctatataagtttagagatgtggaactatgtgaaattttgatcctgttaattataattttttttcctaaaaaagccatttgtggaaaaaaattttctgatatattttttagagcagtggcacgttttatatctcatgccagaaactagagcataaaatatcaacttttcaaataaattaactagaaataaagaacaatttattcagtgctaatttgttgataattttttatagtaaactatgttttaaaaatttaactttggggaaattagaaagaagaaaaagaatatcttttctcatgatggtaaaatgctgatgtataaagctgaaaaatttacaattatgtcatatttatgttttaatttaaaattgtgagagtttagagtcatgtaagcattaagaaagataaaatatctgaattatatatatttgcatatatgtgcatgtatatactattcaacttaacctttataaataagccttatttttattattcagattaattgttcattcttatataaaatgtgtctggcatttggtttttgctgggggagtacaataatacatggtatctgccttctgggaagaagtacagtaatgggtcaggaattaggacagtcactgtcagtcacagtcatcatctcagttaatcctccaaataacattatgatgctgggcattgtcaactcaattttattgatggcactaaggtatagaaaagttaagtaagttgccccaaaataacacaactggtttaaaactctcagtatgagaggtgttgaaaccatagcctcttacaactagaagatcactgtattcaatactctaatccctgatatatcatgaatgctgaaagaggatttagactctactacacagccgccctgaaagagctgcaggaggcacagggaattatattaacatagtggattgcacgttagggacagaaatggaccaaggagcacatgagaagtccacattgatagaggtgcctggcatgggctccccttctctgcccagatggtgttggtgtgacctgatgggtggcaccttcttgacaaggatccttgctttagatatttggaatattttatgttatcaagctatttagaaattttaagtcactgcaaaagtgctcattccaaattctgtttcttgcctttgtcttgaatccatatctgaatatttaggaagatttggtattggtatagagaggtatcaatttggcaaagatccttctttgccaaattcctggaagtggaattgctgtgtcaaggacagtgcacctgaaaatgtggacaggtaatgccagatttccccacccccctttctaataacagtgaatgacctgagaagtaattgtgtccatttagaatttcattagattacgatggaaatgaaggtagaaatgaagaatcaacatgtggaaaaaatatgtctgtaactaggaattgatgtactgagtttttctgtccatgttgatttattattcccttgatggcatttttgagaccaattatttcaacatgtggtgaatctttttattcatctgtctctctgtatctggaacaagtatatcttggatatacctgaggcctaaaacttggtgttaaccagactttcctctctatggtgtaaactgccatagttggcaagaaatattccagggaaagcaatgtaaattttctcaaatgagaaagatgcgtgggtttatttaggataaaaagcagagacataaatgctacaaacatatatggtattagaatgattattacatttatcctatcaggttttgaagcagtattattgccttagtttcttgcatcaatttttctcttcatttttccatcttatctctttcctttcacagaatggtttgatgaaattataggcactaaaccatttttaattacagatctcttgaaaacatatcatctcactaaacttcgaggcaaaatgaaaatgtgtgattatcccaatttattagaacttttgtagctgtcttaaatttttacagatagaggttgaagttgccattacttagtgaagagtcattgtccgtggtttgaagaatgagtgacaaaattaatcaaattctgtttttttttctgttttctgatttctggaatattgccattttccatatgtttttctgaccttaggaataccagctggctacaaaaaaaaagaagaaagaaaaaaatgcaaaaacaacagcaaaactcagaaatcattgcttccctaagccatgccattggcactgcccctcccttagtgccacataacctggagctcactagcaaggttctagatctgcatcacttccattttctattttgccaactggccttgagcaacaggtgtgtattcttcttgttgctgcaggcttgaaggaactgtagggtagcttctgtccacaattctgaccacttgccttttggcaatctgtttagtgactttaggctcttctatcaaggccatcttgtagactggggggttgtccagaattttatgatacatgcaacattctgaccacctgctaagacttaaatgaacagactacatgtagatattctttctttctctcatacttaacttttgcccatgcacattagtatcaaagatgttatggtaattcaatatgtacagttttctttaaaataggatatggccacgaatttgctaaaatctatgccatggtatgaggataacttacatgaaaatatggtacaagattaggtaaacagtgttgttcatatgagaacttaaaaattcccttaccttgaagtttcaagtaaatgtctttcgtccttttaatttggtgtgataagaaatattgcctttggtgtaatcagaattatgtagcatgatgcttcttcttggtgctgttatttttactgcagtaaatatttattttagttggcattgttgagttacctcatttgtgagcacagctagtaaagctatggttaaattttattgcttttactcttagaatcactttctcagctagtttaccttggagagacaactttacgttttccaccaaattaaagaagctgagaaaattgggtggaatttttttctttttttttctgtttaaaatgtggttactttgtagtactttggcgaactcactaatgtatgtatgaaagcacacgcttatcaaatggaaaataaaatcaaaacaatgaactccagtatgtttagtaataaagaaaaaaaaaacctgtcattttttccaatgcaattaaatacaaagagaccactaatattacatttatctaattcatgtcttctcggcaatatgaaccattcagatgttcctccacctcttttgagagggatgtatgctgtcagactttaccaatgggatacacagttggggttttggaaataattttgaatctccttgcagggtagcctgctaaaagacagggttgtagaaccacttccgagggccttctaaacttaaaaaagaaaaacacctgtagctgtcagcactactttcagcaaacagtccacatcgttatgtgtcatttaactgctttctgcttgtcagcaggagtctttgtttcacacctaagagttgtcacatcagaaatcagaataaaggcctaaggtctctattcccacggggcagtaacatgttatgtattattttcctctaagtattctccatctactcaactctctcctggaaacctacatgtttattcgaagcccctatatatatagtgtagggtatgaagaaaaacgtgtttggctttttaatgacagtcttttcaagtgtatgtaccattatttataaacctatgaatgtaacattcagtggagttaatgtgttcacaagtataccatgagtgtggatggtggccagaaaagtattattcctgaaaagaacacaactatgtaagcaactcctgtattttgactacttgctgtagataaacatgctcccctcatccaagtctgctacaggagtggacagaaatcttggggtaccaatattgtgagggggttggttgaattcagcattttggcaacagaaactggaaagaaataattggcggcccatacggtatgtgtaatgggcactatgagctgtttaaacgtacaccaattattttgaagctttccaaacccatctgtcaccatattgtctagtcacatgacatagaattgtcatttctccctgcataaactgatacagttacaattgatttttgcttcaatcgtttgtataaatagacctgtgtcatcaggatctattgtttttgttttgttttgcttttgcttttgtttcccctaccagtgatctatggtacaatttacttgaaaaacaaaaacaggtatagctagagggccacagcataaaaaataaaattaagtattaaaggcacttaatatagggttaaaaaataccctgtgaaagctacggcacatcttttccaatgtgtacaattgagtcaagaaagcatagttgtatctttattgcaaatctaataatgtaccccatagtattgtatttaatcgctgctatttttctctcctattcatcattgtgtaacgtgtaatttgacataaattcctggccactgactctttctgcggtgttggcaggctcagttcataactggaggtaattggagtgagatttgagcactgttcactgcaagaactgaacaatgtttaggatacctctgattctcgtgagaattctgtggggcataaaggggaacatgaaagaataggaaagtgcacttttctttttttccaacggtggcagaatcaggagatttcttggtaactgattcactggttcctgagtctgttttacctctggcaatgttaaataaacccaagactgcattgatttcccttagaaggtgtatactctagcagtacccattatcattgcatgagttatcataacacctaatacctcagctggagtttaagcattatgacagcttgggaacttaaagtgagtacagtaaagactttaggagggcctgtgaatacaagttaaagatcacgtggttggctcccatggaagatttacattgttaaagtaaacttgtgtggtcactttgaagtcatagattttccatataaattaatgaagaaaaataaatttctctaagatagtgtttctctttttacatttgcatgagaggaaatgaaacagtataaagttttaatttccccaccttctggctaaccatcggtttagtgattagcagaggagacttttatattaggtttggagctcagtttcctggctgcaattcattgaaccttgacgtaaatctgaaataagtattttgtaaggggttagccttttgtgcagggtgtgtgagaaatcctgctggaccaggttggttacagaaactagtgtcaagttgcctgtgccctaagtggtgaataagaaaatgcagacaacagaaaagtagaagaaaaaaatcttcctaagaacaccttcacccgccacttccgaaagccttactgtctaccttaaaaggacttgcagttctttttagtgatgcatgtttgttgggtgggacgttttttcttttttagaaattatacagtcattgctagtgggtagagtgtgtcagtacagaagacaagtgtttcattcacataatccacatgttgtgtggtgcttgttgaggctggttgctttgcatttaatctactcgatcatgctatttgccttaggtgatcagcaacctttaatgtaaatcctagccaatctaataaactaatggagagagaggaacaccacacacacacacacacacacacacacacacacacacacacacacacacacacacagacactgtgggtagggggagtaggcatgcgttctttcatggtttatatccacattatcttagaaggtagaaaagttatgtgccatctctcctttgatctctcctttgatatatatgctcctttttttctccttttgtttaagtaagtacactatattgtttggtaatagaaaaagaacatcttatcagcgcagtgtcttgaacttggaaacttgaaaaaaaattcaaaattttgttcagcctgactagtctatattcagttagtcttaaaattgttttaaaacaaatcatgttactaaaattcaacaacattttttccccttatataaactgcagttcagtattgtttaagctttttttttttttttcctggcaatcacactgaccaactgttttgagttttggattattttggaaaagagaagagggaacaattcttgataattccaattacagatttgaattaagtactaaaacttaaaaatgtggtttttttaaataaacaacttctttaaaatattgaaaaaagttaggaaaattgatgaaagtgaataaccattttctttatccattggaacaatcagagtaaagagactattgaaagcttcaaaataaagggaatggtcttcctctttgatataagtacgtttaaatggctctacagaattaggatttttatttttaatatcattggtctattttttaaaattacaatgtttgttaagagggtgaaattatacttgcctacaaaaatttaccttctcatacctcctttcatggagctttttattgttatatttgttttgttcttactgctatcgtcttgatgtattataactgcttattactcaaggggcatttatacacgtactgggaaaacgtaattcttcgttcatcattaagttttgaaaaatatttttggatttgtcgatcatgatctgcacatgattaaggtgcttggcttcccttccctctgcaagctcagttcatattggtaattcctaggtttttgtttttactagcaattgtgttcttttttttttagatggggttgtaagtttttggagtattccagtacatgcttgatggtagtattaatggtggtcagaacaggttgggtactttttcttgcatttttcttgcatgcattcgtagctgtgcatgactggagccagtagcttgacgatgcacactgagtatagatggatctttagactttactcaggttatcgttcctcctgtagcaggtttcgttcaatttatcctactgtaaaggttaccgagggtaaaattctatttccattacttaatagtgttaggtattgtgttgttgttgtttctacatgcccccaaattgcaccccttgttgctactggagttccaaactaattaagagaaaaaaaaaaacacaagattaaggaagttgagagaacaaaatatcacctttcatctgattcagctagtgttgaagaatgtggcttgtcctgtgttcagatcagcttcctaaaattgaatttcacagccttgtagaagtagctcatggctgccttgtgtgtgccagagaccccagactgcacatacaaatgccaagatgcacgccttgccttcacggtgttttcagcctgtcagggaagataagccatgcacacagatgcccagaatataggtgaagatttgtaaatgtcaaatgcaaggaataagcatttcaaaaattggtgtaatattcacacttctcttactttgtaccacagaggttttgtttataaaatattttgaaacattcacatagaaagcgttctgttaggacaaagtaatcgttgcaccagtccatgattaatgttaatgttccttttgtctttataaaaataaagctgtggttttcgtactttgagttccagtaaatgtgttagaggtaatgaggtaggagaatgttaacgttaaaatcataataagcagagttagacttttattgtttacctcctaaaacaagctttctgcctttaagctgaagttttacttggtgttaccaactcagtagggatttttatgctaaactgatggtgtttaatacttcagcagtcaaaagaggagtgaaaaatcgttacttgttttcctaccatggtgtctgccaggtagcattgtaaaaatctaaatgtgccttgggtatcactccaggccattcatccagtccagtttctgaaaggaccctgcattttacccagagttgataaaagtaaactttgtaagttcaggagcaggggcagtttacaccaatgtacaaattttactcacaatttcttaagttaaaagtttcttttaacttttctcacagtgtggctaattttgcatttgggactccctaaaatggattcagcagcatttccctggaatgttcaaaatagttcaaggcacaaagtaacctagatatttaaatggcccctttacaccttagcaacgtggttgttatgattttatgaaaacagtctttgtttcttttctctgctaacttctggctttagtcagcaaagatttctctgcctcattaatgttgtaaggactctaaataaaatttttcttcgtggattcctttttgggcaggcctgatattgatcactgatttaatgcttctagtttcctgacctgttttataaattgtgggaatagcctttttagattttgaatgcccacagtagtcctctttctagctttgggaaatgatttgagaaatgaaggaatgttgattttatttttactctactttgaaaacaaacaaacaaacagattaatcagattaataaacagcaacatgaaggtggatggagctgagaagagagtcatctttaaattctcttaaagtataagcaactcattcttgtgctttgggaacctagtgcctcccaagaaagtcaagatgaagatttgaaatgtatacatttatgactcagtatttctataagtatataatgttagtaaaggaattgtataaaaagacttaaaaggccagttcatccatccattgtctgttattgaagtcaacaacttgatgatttggtttcatataaaagatgtacacctgggggaaagtgcatttcaagggcactttcaagggtaagattttacaggaatttgacattttttaaaaaataaaatctttggaaatttgatttcaaattttaattcatttataaactctgtattgccctaaaatgattttctcatatggcatcgaatgtgatgaagctagattcattcacacattcaataaacatatatcagtgtctgctgagagcagggctttatgctgggtactgggtattcagtagtgaaccatacagaaatatctctcatggcagttacttcttctgtgtatatctgaacattcaagggtaataaacataaaccatttgtggtgcgtgagacctaggaataaatcagaatgagctcacacctacttacttcttattataaccctaagattgacactttatgaatttagtgttatccaaataatgatgcagtatcaaagatgaatacctagatttaaaatgctaaaagcttgttttagaaagccagtgaataatgtactctcacttttgtatcaatatttcaagtgctgctgggtaacatattgaaatgctcacaccagccatggatgataataaatatggcatttttattaatgttaataaactgggtagcataaatggagaagacatcttcataggatttcataatgtattttgttattcagaaatattaatgtactttgtaatgctgatgcagtaacattaaagaataaaagacagaggttttatcttgaaattgtatggtgtttagtagattttgaaatgtggatacatttaaaataaagttcaagagcccctaaggcagctgataaccacgggtattctgatagcaatgttaccccttaacatatgaatttttttaggtatagcatctttgtaaaagtggttttaaatttcatctccttatcctttaaaaaaataccacattagcattccaaagattctttatcatttctagttatagcagttgttttatcattaacacggtgctttcttatatctagcaggtttgattctagataatttgataactccaaaagcatatgcaatttgtcataaaactatgttacagaaatataattgtaattatggatttgaaaaatcttaattgtacagaaccccactgagtagatgatgaaaaaaagcagtgattaagtacaggccaataatgggaagatataaatccacaaagtgaattttatgcttccaggagtaagtgtttttcatacttaattgctaaaatgctttgcagcactgagaagaaatattgagaagcaagattagttgtgccaaactataaccttgaattctatggaaaaccagtgcctggatgccttagtggctcagcctctttatctaggggaggtagaacagctaggcttaagcctcgactggccattccttccccactggcttgttttctgattttcatttataatcatctggaaattgaagagctttgattgaacgccagtgggagattttagctttatttcatcaacctttcccaatattaacagtaaattacaactatctttattactgctagattaagttaaattatagtaagatggtttatcatcatgtgtcctttatccctggtcttagactagagtttacagaatatctcacaaatttgaagaataatatacaatgttttatctgtgttagcaagaaatgcaaagccttttttttttttttcctgtctgttttgtgaattgagcttagaactgtcctcgtaattagaaatctggttacttggattctaagcttagagtttcttagttttaagaacacatcacctcataattgtaccataattatgaacgttacaagtagtagtgtttttgtgtctcttactgtcagtgacaagcaaaaaattcgctagaatatattactcttccctaactctgagatggaagacagataatagccatggtgcttgaaacatgtggtgctattgggatgggaaattgtaacagcatttgacatgcaagggtcatgtttgcacctcttcttggatccagtgaaaatgtattagttcattctcactttgcaatgaagaaatatccaagactgggtaatttgcaaaggaaagaggtgtcattgactcacagttctttatggctgggaaggccttaggcaacttataatcatggcggaaagggaagcagacatgtccttcacaaggcagcaggagagagaagaatgaaagctgaatgaagggggaagccccttataaaaccatcagctctctcaagaactcagtcactatcacaaggacaacaaggggtaactgctcccatgattcaattacttcccactgggtcacttccatgacatgtggggattatgggacctgcaattcaagatgagattagagtgggacatagccaaaccgtattaagaggcttttagattttggggggaaaaggagaaagtttcattgtagtcatgacttaccatcttttgagtttgagacatatgaggatgagaaacagggtcttaaataaccagtgatatagtttggctgtgtccccacccaaatctagtcttgaattcccatgtattgtgggagggacctggtgggagttaattgaatcatgggggcaggtctttcccatggtgttctcatgatagtgagtaagtctcacgagatcaggtggttttaaaaagaggggtttccctgcacaagctctctctctttgcctaatgccatccatgtaagatgtgacttgcttctccttgccttccaccttgattgtgaggcctcttcagccatgtggaattgtaagtccattaaacctctttcttttgtaaattgctcagtcttggatatgtctttatcagcagcatgaaagcatactaatacaaccagtaaactccagcactgaatctgttctttgcatgggctgacgtttaaattgctagggctaaaaatgctagggatgaggtaataggaagcttggaaatgtggcatacatgcatacttagcatcataaaaaataggaaatgccactagacatgatgaatttctggagatcttagacagaagtgttcccaacttcattaagttgccagatttgctgaatagatatttgtgtgtaaaggactcaaaaatactaggaatatatagcagtaggatacactacttggcctaagaaacatgcagtctgttttgtaaagcagaacacaggcacatgaattggcacaggaatggcatttgccatccttttagacagatatggtagcagtataccatatgaatatcaaaagagcacagaataaataaaggaccatggttttgaataaaaggacgttgattttcaagacctgtacagttgactccgagagatttaaagctagggtcagtctttggatggaggatatgcaggcattgcaggtgtgttaataggcaatttaaatatgctgcttatcagtcagtaaaaaaaagttcagaatttagaatatcacagtatttcaaagcagccattcaggcatattatctttgccatcagtttctctgttaaaaaaaatagttttgtcattctgtagtttttaaaagacaatttcaaaactttcagggggaagcaataattgccaacaggaaccttgacacctagaggttgccaatgtgatcagccttttgaatggtaatcttttaccatccctgtttgagatccacatgtagagtagttgggatatattgaaatcacacttagtgtcttagtcttgaaagttctttttactttattttattttattttttttcagacaaagtctctgtcgtccaggctggaatacagtggtgcaatcatggttcactgcagcctccctcctcccaggctcaggtgatcctcccacctcagcctcctgagtagctgggactacatagcaagccaccatgcctggcttttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcagaaagtgctatttgagtgctggcgactggcttgcatagtggaaatatactggcctgagctctgcccacctgaccacatactgatgtcattatcctcccttcatcaaccccctctgcttcacatagtcttgtctgaagggaatgggtcagctggaagaaaaaaaaaaagaagtacttgccaaagaaatctgttttctaaaatccatagaaaaggtcattaatgtttcataacatattggaagtgttcggaaaaactgttaggttttctttcttgtttttaataattacaaaggaattcttgatgttggaagtgagaaacagatgttgaaataatcagtttcatttaccttacatactcctacatttaggacatgtaatcttaagagtccgattgaaattctacctgatatgaaagaaattctacctgatatcttactgaatgttctaagagcgaagttagcagtacagaaaaaaaaccaagtatattttttaattggattatcatttaggaactatccattcagaagactgtgaaaactgtgattgttaagtgtctgttaaactgtgtttgcctttgacagttagtagcttctagggtttgggtgtttggggaatgtagctcccacagatactttgggaagagataggaaggtatcagtaactaggaagtagaaagagagtccctcagtgtttgaggtagaaccacttattttcgccctcttgccctgttccattcatgctcattgtcaaactggtctcagtcaccctgttcttccctttgtccttctcctcacctacccccgggcctctcatctccctcttcacactggcacgcctttcaaagggccttctcctctgaacctgtgccatctagagcagctgcccttatctcaggactccattgacttgcccccttttctaatctgtttggaagccttatctcttcgttttggcctctacactgtaatttatttctgcttctattattacattgataaatctcacatttaaccagactttgagggatatgctgttgaactgatgtaaatcttgaatcgaaaactgcggtgcaatcctcattggtcataatgtgtgggctgttttgcgcataataactgatggaggcatctcagttttaaagtttgagaatgaagcattgttcagttttgtcaccctgaatcaatcattttattttgtgcattgttttatcgtgatgtttttggaataaagattggttctaggaaaggggtgggtcatttcatttggtgataacggaaatgcccttctactttttaagtgtctttggtatgaggtggggccctaggtagggcctggatgtctgactgtcctgtcattttgaaaagctcccttttaagacaagtgggactctactcttaggttatctctgaggacttgaaagaaagggagaaaaaaatcctcccctattattcattaatgactagaaatgctgagccagtttcacagattttcttctcttgtttgcttttctattaatattaagaatgcttttgaggaactagtttagtgaatgggaaagcaataaacacttttgtagaaatgtttattaatatttcatacttttaaacattccacactcttagtttctttaaaattaaaaatgtttttataacttgtagtatacaaatacattttaagaatttttggaaaaaagtaagtgtttaataaagactataaatttggaattcaagtttagcaaatactcagctatcagagcctgataataaattcattgaagtgttaattgtatgaggaatatcatgaactccacatattctctatttataatcagatcacaaatttagatgattttccaaattttagctatcactttctaaaggattcaacagtctaatataaatttatttacctctatgctactgtgaaaaagaagaagagcaatgaaagtttctaatatctatcatcagagtatcttagcctagaaaactaaatgttattgaaaattaagctgcttatatatgttgtggtgacatttacattctcctaaataattcattgtctatttacttatgactacttacttatcaaagctaccttcatatcaaagaggaaaatagaatattgtacaataacatatattatcataaacgataagcagcaataatggtttttaactagctagaaaggtttttaacagcgtggtcagcctaaacttcatgttagtatattagtgtgttagttaagaaactactttttgaaggatttacatatacctatacatagagtgagttaaacattcagaatgtggataattcatttgttgattcagtcattatttatttttacagacactctaaatgatcaagattctgatctgggcattgcaattacaaagttgaaatatgcaagattcctgcccaagtaaaggttacatctcaataatcttggtaaaaagcaacaaaaaatactacttactcaacataataaaaaattttaatatattatgatttatataatgttatgtataaaaatatgtaattttggtactgtttaaaaatcaaggttttatgtaaacttaaaattggcccactatcattaggacacacgctttgagtttctttagtagcagatgtaatacttttgtgaatattcgtcttattctcttggacaccttatctccctattaggtagtgatgcatttttacatttcagcattctagaagtgtgtagtctgtgaccattgtactaggtcaaatttaattagttatttcttggatgaacctttcactgtggatattgccaggattaaagtttgaaggtaagagggctttagggggtggggggaattgctgacaaataaagtaccttcaatgagttgtataaattggagattcagtttttataagagctaatgggaacacttattataacaaccaaatggttacaaaaattataagaagagtgttattgatatagctcaaatatggtacagtttgcagtttgctggttgtgtttagttaagttaccaaggaagttactatgctacagtttttaattaaaaatactaatttatttatttctgtactgtaacaaagggatatattgcataaatgatggtcatttgctgtataatatatttctgttgaaaagttatgcataaaattcttagtttaatatgcatttgattttccactcatgattactaatctttgcattaaagtaacaggattattgctttttcatgatgtgaagggataaagtggtaggagtaaacaacagatcagaatatcttttcattttttttaaagaggtgaaatgactcccttaacaaattccagcatttttagattgtaaagtacattatgtaacttcattcatcatgtagacctcagacagatactttaatttttttttgaaaaggtcttgtagcacacttaatctgcagatcttttctggcaggaggaaaaaaaagcatatactgttagatttggtgacataaaggtcaaaagataaactgtaagtgatacctatgtttatttttttgacagtgttaaattagcaacccctcagacctctcttggagcagtacaacctgagtaattgaacatgtcgctggggagtatgcttggttaagctgattcctattatgttgacttgtcagggaccaataattaaagctgaagagcgatgctcattagtgtctgcaagatgattcgaagaatgagaagaagtccttgaggcacacctgcaaaaggcaggcattgcatggaggtgagagcagacggactggcctgcttttctgctatgttagcaagccagcgataaaggggatacactaaattaagtgttgcaaatgtattctccccaatttagattataaaatgcattttacttccgcctttgaacataattttattccaattttattccatgtaatcatattttgctcaattatgcttttaatgctatataagatgttttagaaactagatataagtctattcaaaagcactttgaaaaactttatactaggaatcatttcattcattttcctggaagcatcataataatcaaaatctgctttgcttctttgaactctcaatactctgcacgtaaaacatgtgagttatccagctttgatgataaagactttagtggcatacatttgtcacatttacttcacaaaaatggaatttttaaatgtgtatttaacatgtactaaaccacatacagtacacaagcattggctcccgagaaggccagaggaaaacactacatcataagtatagaatttatatttatcacaacttgagcaaagctgttgacttttggaaacagttcaaactttttagcactggaatgatacagaaactcaatcctaaagctctgagaagcatttttcttcttttgaaatttgccttaggtaggctcactttttacaaatctatcataaaatcatgggatatacaaatatcctaatattttggaatattaagaaaaataatttattggatcttttttctgtaatctggttttgaaaaaagtgctttatagtggtgaagtggcctttttacttccagtgttgtgcctgttaaatttatcctgtgcactttggctggagggatgcatgtgccttttattcagagtgaaggctggagtctttacacagaagtcctccgtgtttgtatcttcaggagtcactgtgagattatctctttgaagaggcccttcctgaaactaaactttgtagaacttgtattactgatattccatgttagcatgaaattgtccgtgtttcggtttcctccaactgaaggaagtccctcaatggaagggactgattctcgctaatgtttacatgaacagtggttggagctcaataaaagttggttaaacttaacatagtcaaggtgcagaagagacttgcagggtagttatagatttccaagaataccaagggctttagaagtcaaatagaacaacctccaactcaatgtcaagaatttcttacaggatgttctttaacagataggtcctctcctggcttggtagaagatttccagtaccagagaggtcactactttgcaaagtagctgtttctagattgatcaactccaatttatagtaatgacaaatggtagttaaaagagttgtactttatatgaatttgcattaattgtcatttagtcttcacagtatccttaagatttagccactaaatatgattatcttcattgtacagataaggctcctgaacttcagagaggttgagtgacttacccaaagccccacagctaagtagtggctgagccagcatgagagtccaccagtatctgacttaagagctggaatgctttggcatcatagcccacagctgcccctcttttgttattgttacagaactatttttaattactttcctttaaaagccccacaaatcattggttgccattagaaatcattcttttttgagacagagtcttgctcagttgcccaggctggagtacaatagtgagatcttggctcactgcaacctccacccccggttaagcaattctactgtcgcagcctcccaagtagctgggattacaggtgcccaccaccacgcctggctaattttttgtatttttagtagagatggggtttcgccatgttggtcaggctggtctcaaactcctgacctcaggtgatccacccacgtgggtctcccaaagtgctgggattacaggcatgagccaccaggcccagcctagaaatcatttttgttttgtttgttttctttaatagagcaaggagagactcttgcaacatttgttacctatccagggttactaggacagcattgcccatcctacaattgctgcatagtagtggtatgaaaagcactccccaaaacaaatagattcttgagtttatccagtaaaactctaatttactctaatttaacacttcctgtgtcttaaatcttaactccaaagggctgttttgtttagcgtttttttttttttttttaatagagtattatagtagagaagctacttgaccaaggttcctaagtctgtctgagtagctgcaaacatttgggctaactacacaactcaaggaatatagatagccttttcagctgtcaaaaggggacaggggaatcccttttctactaatcgtccatctttgatattggagtacaatggactatatatgagaacattcttaccaattgatgtattaaaacttataacttttgcttagaagaatttatggtattgatgttatcatcttatacaatatgatgttttcctaggacctgtcatattggaaacataattgatattgactcttgttacaattatataatgctgaatacatattcatttgcatgaaagagattgacagtgattgaatttagcaggatctgtcataagccttgagcattcttttcttaaaggttcctgatagcagggggttagggagagatgtttagacatttcaattttttaatgaatttattgatatacagtaggaacagttcggctttcacattaattcatacatttcaaagatttttctttgtgatagaatgatgtaaagctattatatattctgcccagaatgtctctcatctgtttctttaaaaaacgttaaagcaccattgaaccaatttttacggtactattaatcagtgtaatcagtattaatacactactttaccagctcagtgccacttgtcagtaatatgacagggtgaattttacatcttcttcacaaaggctttcatctattagggagagaaaaaggagatcaggattttaattgttagcaatcagaagcctatgtgattaagacaggcattctgaataagacacagcacagattatactgagaatatttttcatcctttactaattcttttatgaatttgaatgtagtcttatttacctgaaactttaattatagactcaaaggagagtaatatgcctattagaaatataagaatttaatgttaaaggttttaatgtggttctggctggcttctttctctctttatatcttggcttgcagtgttcccaaatcctcaggtttcctccaaatgaatgttgttggccaggcacagtggctcatgcctgtaattccagcactttgggaggctgaggtgggcagaatcaggagttcgcgatcagcagggcgtggtggcgggcggggcacctgtaatcccagctactcaggaggctgaggcaggagaatcgcttgaacctgggaggcagaggttgcggtgagctgggattgcaccactacactccagcctgggcgacagagtgagactctgtctcaaaaacaaacaaacaaaacccaaaaaacaaaaacaaaaaaatgaatgttgttgatttggtttctaaaatgcccacaattaaaacttgatttctttaggtttaggattatttatatatatgtattttttgaatcttgctgtgtcacccaggctggaatacactggtgcaatcatggctcactgcagcctcaacctcctgagtttcagtgatcctcctgccttagcctcctgagtagctgggcttagaggcatgcgccaaccacaccagacttatttttttttttttttatgtagagatggtgtttcactacgttgctcaggctggtcttgaactcctgaccccaagcagttctcctgcttcagctctcaaagtgctgggattactgatgtgagccactatgcctggccaggtttaggattattatgcgtagaagttttctcttaaaatagaagtgatccttagagtagccacaagttaatttatttctagtgtttacaacccagcacagtttagttctcaggtaattaattcactgttcaaagtagacaacaggacacaaaaggaaaaccgaaataagtgcagcgtagaaggaatggtggagagatggctaagataaaggcagctactcttcgggagtgaaaggaatgaagcctttcccgggatgagggtagctcaagggactagggaccgtggcaagatggtgaagagtctctctagagggaggcaggttgggagaaaacagagaagcctaagaaagaagttctgattgccctgaagctaattacggtgactgccttctatttgaaacactaacctgtgtgtgatgcgtttaatgaccagagaatcaaataacttgcttaaaatcctagctctaggggcaggtattcacactcaggtcactaccatacagccacaagcttaaaccccatgcttcactggcccagctaaagctaaagactcatcagattatttcagcttagcacagagttaaaaagacggagaggcagagggagagagggctatagaagggaagagagagagggagaaagggaaggggagggcgagaggtagagacagagagagagaattgagtcattctttgttccctttcctgatttaaaaaagcaagtgatgcttagaaagtcagcttaacaaagtatgggtaataaaagcatcttttaatcatttgctatttgatatggcatttttatgattttatcaggcatgaattataccatttgatatatttcttaatataattaaaaagtaaaattaagtaaacatcccgtaatttggatgctagattaaaaacttaatttctaggaaattacaaagtctgtgatgaacttcaaatgtagttgacaactacactggcagttttattatttaaacatttgaactggactttgtgggaacagttaacgtaggattgggacgtttttctttgaattatttaataattgcctcttgtccgtacttgtgacatctgtgcttctgttttaccaacctggatctcgaaggaacctctgctctgtgttaaaaagtaagcaaattttaactaaagttgcttattcagctcacagtaatgaagagttatgtaaactgttttgcccaagtttacagatgtctgcttatattaggtacttataatagtagatattttgaaaagatttttaaaaagtaatttatggaaataatttatggaaatgttacattagttaaacactaaaacctccgtggctctgtgtgtgtgtgtgtgtgtgtgtgtgtgtgtcacatttttacatgccagagagttacatttatattttttcctactttatccattggatgtatattatttcttgaaacactaaggataagaacatgccaaattcagagttacttacaaaagcaaatattattatgctatcactgttatatctttgaaattaaaaacaaatagtatcccaggtatcacttaagtgtattagaatatagatttgattgttagagaaagtcacctattagtacgatgtttttatattttttgtttatttagcattttttagctagcattgggaatcttgttaaaactattgcaaatgctttttaaatatatatgtatatagtgtatacatatgtgtgtatttaattaaatgcaagaatttaatttttacatattatataaatatatatattcatttcaatttgttgcatgttatttattttgaaagttgcttgctgcccaccattgacattttctaaatatgttcttacatataaataatgctagcttaagttcacaatgtggacaatttgaaaagatattctttttctttaggtgagggatgataataattaaagacactgtaattccattgttatatacttttttgagatcataaactgttttaggttatctgcaagttttattgtactctgtgatatcttagataaaagaattaaaattggtgaaataagttgcaaagtgtgcatttcactcagataactttctattccttttcacttctttgaatctgttcttgaaataaaacaatgaagccatttgtcctaaaaataatgttgaaaaattgattcatcaagtataactaaaagatagtatgaatttgactgatgagatcattagttgtattggaatttttcataaatctgaattggatctttatctaaaatatgaatgaagaaatggtctgcctaattttaatatttttttaaagtaagtacagtaaatagtataggtctatttatttgtttttagtttggccttaatttcagatggtttcaagggtagaataattgacaccattgaatgccttgtgctattttaatgactttctgctctttaagttaagttgtagcaaccaataatgtccaaggctcttaggcatagtgaagaagggatatgaattatctagataggaattagagagaatatttaagaaaacacagagttaactattaaacttgacgtcttccaccatccagtgaaaaatgctactgaatagaggaaggaaaagtataattcgtgcagtttaattagataggttaccacactgacaccagtggaagaaactccagtgtgaattcagacagcagcaccttatgtttctttatttcagcatactcggtcatcagtgtattctttcttcctgtgcttgactgcatttgatagtagtttctgagtgtgaaagctttgtcaagaaggatcctttccaaccataagcgtgcatccactttggaaactacctagaaaagctgcaaatgataattttgataaagagaattttgtttggaagatactaaaaatacagttaacaatgagcaaatagcattctctgacttactcgaaggaccagtttatatgtaattttagatacctgcatttttaaatgattgtatttattagtatgaattttagaaaaaatattaaaagaggggaaccaaaaaaagttatatcttgctttttttcttgtcctttccctccaccttcttctcctccttctcctgtagttaagttcaattacttgtaaaatctgaggttcatcaactacagaatttcacaaaagcaaaaactgggaattctacagaagttacactggagaatgatttaataaattaatgaaagggtgttaacgaatgcaaatgttacagcattggtggacgtaagtgcctccatatcaggcaaaaatggttgtgtttgaatccttgttgatagaaataacattaagttattataaatattgtacatgaaatgggttttcttaggctgctggatgtctaataattttagtgagtgaatcaataaaatacagctttttaattagtatttttaggtgtagttggaagaattgcttagcacactgtggtgttaggtatagctctagcaacatcctcagcagatgccagggaggtacaggacttagatttcagtggcttcctggcccttccacctgcctccaatccagcattttataggtcacattcatgacattcctcagggtcaggaagtaaaatatttttatacattaacttactaaatcctcatagtaatgctatgagatagatactataactcccatttccctgataaggcaaatgaggcctgaagaaggcaagtggctggctgggagttaaattaggctacttagtgatgggctgcaatttgagatttcatactagatccttcctcttagccgcttgtttcttctgcttcctttccattgttgtgttcacaaaaatgccacttcacaggtttgaaattattctctttttagcctgaaatgttctttacatttcttgataggaggattttattttatgtctaaatacattttcttgttcacttttgtcttgatgaattacaagtaacagtttttaaattccatgtcttaatgtttaggatatttgcatttttatgttttattattaagggaactgtcaatattatgttaaacagacatgagcatcgaacgtgttgtagagcaaatttcagagaaatcacttcttaaattatttttgtcaggacaaatcaaagaattgtataagataggtaattgatctataaactggtgaaggggtcattttaaaatccaggctaatttaagttagattcttacttgacttacagtattgtgttggctttggttcatttttttcaccttctcatggtacataaaaagaagaaagattcttggcttaaacaaatcgctaaagttaatcttgtatgaagaagaaaaaatgaggacatcatttttcaatttgctaaagagttagcctcaatttttaaaactttttatcttggtatatagatatatattttttaaatgctcacttgcatatcttagaaccaaaggcctaataacaaaaaataaacacttggttctttcagaagaaaaatcacagatggcaaaaaaaatttaaaaaaaattattggatcttttgaaagctaattggcaatttttatgtcattgctaatcttgaaagagacaatagataaaactccatattagaggtggatgtgtaatacataacccaatagcaatagcaacagagctgacatagccacaatttagtttaatccttgtcacctctatgtggtacactgaggtcctggaagctgtgtcttttccataagaccatgcctgcttccctataacagtgatagtgaggataacaacagcgagcccacttacttattttccctttgtgtttcaagtggtggtgaaaatattctcagtcttttttttttacccgtctgtcctttgggcctccacatcccttaggacaccaacctgcttcaaaactgccataatgacttgctgaaatcgtttatgtcaaggttaaggagagtatagattctctgctttttgcaagtataaaagagaaaatgtgagtcttctccctgtatttgttcaataaattgaaaggagaaagcttaagcttgtgcttttccctcatggaactatgattatttcagagtaggtcatattgtgggacttaaaactgtaattatagcattgggcagttctctcataataataatagttagcatttatataacccgtttcatcttcaaagcatttcacaggcactaattaatcctcacaacatgtctgtgaggtgagtatcatcatccccattttacagatgtggaaattgattcaagtaagttaagagtcttgccatgggccataggaggaagtcagagtctaaaagcagggtgcaaacttgggagtggccggcgcctaaatccttttccacagccctaaattagaccttctccctttttctccccatctccccgtctttatttctttttttttctaagttctggaaaggactctggcgtttttcctttcagtcttccttttagagagtagtttttttaacactgcccccagaaataaataaatcatcttagtataatagctttaaagatctaatgtgtctaatcaggatataaatatttcggaaagtcaggaaatgaattaggtttgggtgcaagaaaggattccaaattacattttgcctaataaatatcgcatccgtaaacagtaaaagtaatgatagtgattagttaacagtaccaaataaaacgtgcatttaaaatgaacctgaccgggcatttttgtgtcatgctgactgatgtgtacacagtccattctttgaaaaatcaaggcgctcatttgaattgtaaattgccaacactgcaaatagtaaattgcagtagtcttattgtgctgtgatgtgacaaattacaaatggaatattggctaggcttccatatcttgcatttctcttccacttgctgctactatcaccattaatctcttttgcagaagttctatggcaaattgttctggacatggaaaggacattaagttgcattgttgactattgcagggctctgtgtggcttctctgacctctgacttctcttattggtgtaatccagtatagtgatactcattttgggtcctgctgtgtgtggatataagggttctggcacagtttatgtctgacatttcacttaaatattgtattacggtcaagaattttggctgaaatgtgtcaagtatatcttaaagtggaatgtggtcctttaaaatacatccatatcagaaacataaactatattaaggatgagtagcttcttagtttggcctttcgttttacaaatgaggaacctgagattgaatgctgttaataaagattagtttttggatataaggcaggctatgtaactgtcagagctgaaaaacaattgatttcaagtggaatgcttgacctctgaacctaatttttaattattgagttttcattttaaaacacaagtaaattatggatataagtttggaagtatgtctacaaagagaggttactttttaaaggtgaaagtgttctattgccttggcataaccagtgaaaattggttacactagaataaagaatagctatagtttcctgttctttatcgttcgtggtgaaagcattaatgtgtattgagtggagggtagagttgaaaattttgcactgtggtgaaaaagaaagatggatatcaaaaaagtatagtaagaaaccctcctaagccatccctatgtaaccagttctctctggaccttcttggtaaaatgcaccatctgatgtccacagcatgctgagtgccttcagatagtaggctttgttctctaatgtaacatacattcgcttctgctactattagttgacctgtacgttcaccaagagttgttggggattgttccaaacctgttatggtatgtgaacttattaatatacttatgtaaataaattaaatattatataagtgtataaaatctgagaatgaaaaggaagttcttcagtgacacaaaaatgaatgcttcagaaagaaagatttaataaaaatgtatcacttgaggtgtcagattaagtgtgggtgagataattgtagcagattggggaaaagatcataagcatttgaaaattttattttctttttaattttcatgggtatatattagatatatatttatggggtgcgtaagttgttttgatacaggcatgcaatgaagaaattttagaggatctattatgtgcacaagtttatgtaaaaaagacaactggtatgtaattcaaagtttagccaaagtatgtattttttgtgttttgacatataattcctgattaaataaaataattaatttaaataatataattagtaatttaaatggtgattacatttttttttatgattccccactttaactgactttttcagttaactgactactactgatcagtcaactgataagatgaattctgcagtaatggaagatcaagaaatgctattctcaagatctttttattcacctcttcaagaatcctttttatttttctgagaatggaaagttctaactaaattctttgttgctggactcatttcgttttattgtggtttatttataggaggcacacagaaccaaccaccagtcatccatcgcttgttttgagtttttctgttacaatattgctgatctttaatatattccttaatatttaccaatgtcttactacattttcttattaattatactttcccactagctttctgatttcactataacatttgtgaattctcaaatatcgctgttaaatgtgtccattgtgctgtttttctattttgtactaaagcatgttaagctttcttccatgatggaatttataactcaagagaaataaaatcagattatgaattctaaattctaaggaatgagaaaagaatgtgggatagaagagacattgcggtcaagaggtggtgtgtgaagtttgaaagttctgttgccaaacatatgcaactctcattcaagagaaaaacaatctgcaaagactttgaagaatgagagaaacatgattcttaggagcaggctttcagattctcgatgatggatcatgtagacggcagatattatccagcaaaatcaggataattcctgagtcggaggctgcattccagcctctatgtcccaggctggagcagtggcaggatctcagctcattgcaacctctgcctcccgggctcaagcaatcctactatctcggcctcccgagtagctgagactacaggtgtgtgccaccatgcctggctaattttgggggattatttatttttattttaatttttgtagagatgggattttgccatgttgtccaggctggtctcaaagccatgggctcaagcagtcttcccttctcagcctcccagtgttggaattacaggcatgagccaccatgcctggccaaatttctttatctcaattgacccatcttcaggtttgctgattcttgcatctaccaactcaaattcgattgctttacttttcaactacataattttcatttcgttctttttgaataataaataataaaatcaggaactgggtagaggatgggactagacataaaatatttagaaatggtgcaaaaattagatagctgaagctaaatagattgagttagagcccagaaattttttaaaataacattggaaattaaaatgaaatttatctggaaccgctaacctttctttgaaacccttgttgctacctataccagtgaacctatcatgctgtgttacagtcatgtctttactgataggtctcctgcactagcctagggaagggttctttgcttcttattccttatatttctaggatctgagccattataggccctcaatacattagctgaatgcagtaacaaatcaggaagtagagttgtttttacagccttactgttaggttgactcaggtttaacatgatgtgacatttttaagcatcttggacttactgcgtgcacatctgtagtttcttttccttatggttttctttgatgtagatatgcaaggtaagagaatactttacttttttgatattatgttggagaggttgttttaaaaagtacgactttagatttagaagaactgagttcaaactatagatctataacctcttactggctcagtagtcattaacaagttatttacattttctgaatctcagattaattgtcagtgaaataggagttgtcttcttgtctctcagtattttttaatattacaatagaaaatactaaattagaatattagaaaacatatggtatctagcacagagtatgttctcagtaattttttattctaaatattggtcacagaaaaatgaatgcatctcagaagatacatttggaagctcatttttttttttttattttctgaaattgagaatttgaccctcactctccactctcagaaattactcatagtcatttgggtagttggattgtctttccattggctttcatatataaggcaaaaaatgtccaaaaatactgagaagcaccaaatggtgctagtaatgcaattcatgaacattttccaaatttgctagcaagatagtcggtaaaatgtgccattttcacatcttgttcatagagcaaacaaaataatacttaactatgcaataatatacagtattaaatccccctgggaaaagagttggttttaaatactttgaaaagaaactttcaagttagtgatttacacagttaattataaacaacaagacttgtaattaagtgttgccattttgggttgaattggtttcacccatcactaatccgtctatccttgtctttggctgttgagagattacgggaaaatgcacacgatgaaaagtttaacttgtcaagtataaatttagatgcaaagtccggaatatcaaacaccacaagtgataattatcagcacctggaaataatttgtaccactaagttaagtaaagaattctctttctgctgatggggagattttaacctcatgatcactgaagcactccctgcagtttacagtgatgtatcttgtggttcattcccagtagtcaacatagcaccaagcaattagtagaacactggaggataagtgttagctctgtacaatgtgactaagattaaaccgggagcaaattagagcaaggataattgtccagtttttaagttgctcgaagtccaactcacttacgtattacattgaggttcctgcaaagcctggattttttgtttttgaaaaataataaatacaatttttaaaccgttgaatttcctggattatattttagtatcttaacatatgtattttctcctaagttaaaaatttattttggagtctcaggacatgtcttttttttataggagactaatttgggtcccccaaaacattatcagaagacaagttattataatacgtaaacatggtatttaaataaattttgcagaggcatcgacttatgggttttgtggcagaagttgtctggattctctgatggcttgttatatgtgattttcttagctttattaagtttctgtggttgttaatgagatttctttatagtcctctgtaggtaagggttgattttgaaattttggctgcttgtgtttaagatttgattctcattctcaaacatttacatgtataattttgagaacacattttatttaacacaatatagtaaacagaatgaatcataactatgaacgttttccagaagcatttcttagataaattattttataaaaagaaaaacaacacaacatctaagatttagagtggaagaatatacttgtagttaacttccttgttgatttaaaaaatatatttggatttattttggcagggtgggggaatcatctaataaaaaatttaaagcaaacttcattttttctaaccagagtgaagagacagggagagaatcaaatatgtgtgagctccctctgttgctctgtaacagcattttattcatgatttgtgatgtgataaggaaatttttgctaatgtgtcaaaacaaattcaattttcccttaaggcaatttataactttatttaaatggaatataaaggaagaaccccctatatgtaaaattctgaccttcaaatttatgttaatatttttaaattattaaaacattaaaaatgcatctatttctcaccactaagagggaaaaaaaaaacaaaaaaaaaacttcagctatatttagtaagtactcactgaagtcctaaacattaggataaaatgcagggcctaattgagtaaagtatcaactgggatgatgatagtgaacaggttggcaaatttgccaactggatttatggtaccttttatattaattacataagagtaaaatgtgaactcacaaaatagtaatggcaaaaatgaggagttgttttaaaagtatgtaaatggcattttacaatgctgtgaaatacatttttttttttttttttttgagacggagtctccctctgtcgcccaggctgcagtgcagtggcgcaatctccgctcactgcaagctccgcctcccgggttcacgccattctcctgcctcaggctcctgagtagctgggactacaggcgcccgccaccacgcctggctaatttttttttgtatttttagtagcgatggggtttcaccatgttagccaggatgatctcaatctcctgacctcctgatccgcccgcctcggcctcccaaagtgctgggattacaggggtgagccaccgcacccagcctgtgaaatactatttttatggtaagctagaattttaaaactatttcttgcaagtttaggattaaatgaattacattatgtaaaattacatctttgtctgtattacgtatttgtatacagttgaatagttttggtaacacgtaccttagtgctttacattgattggctcattaattttatattttgagtaataatcatctaattttattattgtacaattcagtcttaaattatgttatgatgtgaaaatggtagctttcttgagtgtatttatttttgtagtagtgggcaatgtaattatcacacataaaatgaactgtgagacttttgagcctgaaatattattcatattataatgctctgcagttttattaataacaatgagagatgaagcactaactttaactggtatccaaagtaggtgaatcaaaaggcttgactctcatatatatatatatgacagtctcatatatatatacacatatacatgtatatatatatgaaaaaacttagcatatatatgtaattttttttgtatttttagtagagatggggtttcaccgtgttagccaggatggtcttgatctcctgacctcgtgatctgcccacctcggcctcccaaagtgctgggattacaggggtgagccaccgcacccagcctgtgaaatactaattatatatatatatatatgcgctatatatatgcgctatatatgcgctatatatatgcgctatatatatgctatatatatgctatatatgtgtgatatgtatatgctatatatgcactatatacgctatatatatgcactatatatatgcactatatatgctatatatatgcgctatatatgtgctatatatatgctatatatatgtgctatgtatatgctatatatatgcgctatatatgctctatatatgctatatatgctctatatatgctatatatatgctatatatgctatatatatgctatatatatgctatatatgctatatatgctatatatatatgctatatatgctatacatatgctatatatatgctatacatatgctatatatgcaatacatatgctatacatatgctatatatatgctatatatatgctatacatatgcgatatatatgctatacatatgcgatatatatgctatatatatgcttatatatatgctatacatatgctatatatatgctatatatatatgcttatatatatgctatatatatgctatatatatttatatgccaagtgttttactttagatatcttttcaaaaggactttttcttcaccttctccaacctaaagcattcattttatagaaggcagtagagtaagttcctagtgtatttctaactttaaaactagtatttatattttacccaaataattagtaaactggtagttgaaaaggaaaggattaagtaatgtagtttctttctccacattctgctgctgcttgaatctcattccaaaacagtttagcatcatatattattaccactctctgaatatcactgttgttgatatgcttaacataccttgatcttcaaaaaggaaaaaaagcgagaaagagaatgagttttggggagttgtctcttttgtctttacatgacacaaagcatgaaacatgttttctttttcagcagtcctttgccatgtgttatgactgaatgttgctccccaaataccatcacaccgggggttagagcttcaacctccagtatgatggtattgaggttagagcttcaacctccagtgtgatggtatcggggttagagcttcaatctccagtgtgatggtactgcggttagagcttcaatctccagtgtgatggtatcggggttagagcttcaatctccagtgtgatggtatcggggttagagcttcaatctccagtgtgatggtactgcggttagagcttcagtctccagtgtgatggtatcggggttagagcttcaatctccagtgtgatggtatcggggttagagcttcaatctccagtgtgatggtactgcagttagagcttcaatctccagtgtgatggtattagggttagatcttcaatctccagtgtgatggtatcagggttagagcttcagcctccagtgtgatggtatcagggttagagcttcagcctccagtgtgatggtatcggggttagatcttcaatccccagtggtggtggttagagcttcaatctccagtgtgatggtattggggttagagcttcaatctccagtctgatggtgtttcgggatggggcttttaagatgtaattagggtttaagatcataagggacctggtctgatggggattagtaggcttatatgaagagacacaagagggcttgctctatctctgactctcccacacacaaagtagaggccatgttagcctatggagagaagatggccatctgcaagccaggaagaaagccctcactagaaaccaaaccctgcaaaaccttaatcctggactcccagccttcagaactgtgagaaaatttatttctgttgtttaagccacccagtctatggtattttgttctggcagcccaagcagactaagacaccatgttcagacagaatttgaaaattacttttaagtttgcaccagaatgtaactacatttgatatttaaggggcaaaagcaggtgtagagtttgtaggaaacctttatgttatttaatccctgtaatcatggtaccctcttgagagtttgcatgtttgaaatatttaaatttaactcactcatgatttttttcagaaaaaaaaaaaaaaaaaaaaaaacagattacatgtgggaagcgggccccttaatgtttggtcttgttcagaatcagaaagttcatataggtactccctgtgtggcattgtagacaggatttaccgtaattgacaacattagaaatattggaactagttttcctactgaccttgattcaccagagggtggtgggagagtatttgggaggttttctcaaagagtgtggtgaacaacctagcggataacctcacagttaagactgaatcttctgtttttgagccattaaaagtttgctcaagctagaatttactctctcatattccagcattcagtgttgctccagtatgaaattttagatcctatagaagttaaagtgcagaacacctgggactcatatcctgtcaatcactaatttatcttctgtttcactcctttggtttagaccgtgttctcttttctaaactctcacaatagctgctgaacttctcttctttcctgtgggttgttgtctctaatctatcctctactctgccaacagagtaacctttatgaaatctgataatgttcctctttggctcttgaataaaacccttctctgccttcttatcatcctcgtggcacccaaagcccttcatttattcactactcttctgatgcagcctcatctcctgatattcctctctcatggtttgcagaccagtcagatttattcacttactactcagagattttgaggactttttgtgtccaggactaccaagataattaacgtacagtgcctgtctcaatataaatatattggtctcaatataaattctattcatgcttcagaactcagctcaacccttcaagtccaaagggaagtcttctctcattgggcctactattagggagtagctctgtcctgtatattttactgatctttctaaaatggcaccatattataattagttgtttacagatttatttctcttctagacactgagcttccaagatggggactatgtcctatccacatattccagacaccaagcttagtgcctgattgaaataatccctcagccagtatttgtagattttaatttactgcaatatgcctgaaaagtctttgggttatagattcttcatctattctctgacttacagttttcatcagtcaaatatttgctgtactatttaccatgccatttaccatgtatggtaaaaaaaaaaaaatgcgctctgatttcattccatttcttgcttagattaggtagacttatttcagaagtattggaccaattatagatattttgaaatcctggtgcaaatatgtattttccaaggtctgattatctaatctgtatatcgttttgtatgtttggtgactctcccaatatctctctttatgaatatctcaacatcgtgagtgtcagtagcccttcgactcctttttcttcagatattcacaagcatgcagtccctcagatttcgtcattcctcatggcaacagccccatacaaccagcaactcagaaaccccgatctgtgaccacatcctcccattctttcttgtaccttctccatttcttcagcctttatgaaataagcacccgcctccatcagacgtcttcatgctctggattccctgttatgcctccacttgtgctcagcgatccttttactggtctttatttgactgcccatgttattcctcccaaacaaggctcttcactttgttttttttaacccttctcagctatgtattctaaactcttactctttgtaagtaatattttattttaccacaaaggcatccccagcttcctcccattcctaacagggaaagggtactccaccttctttcctaacctgtcttctttaatccctttcatccgtccttctgacttccacactagcctttgatttcagtcttcctttctaccaatctatttatttctgcacaaaagtatgttaaattatcccctattttctttacattttcctctgaagctttttcccttccttcagctcatggcctagagctgaaagattcctgccaggttagggccgtagttaatggattcaacagtaatcaacaagtatcttgaatttgctagtctgtctagtgacccgatttgcaaacatttttgattacaagaatactttgactatttaatttaatagaaagttcagaactagccggtttaatattgtcaggaagcctttctctattacttcagtctgcctgatgtttccttctcaaaatttctcaggcacctatatcattcgtttttgcagttatcttgttaattcataaaattaacaaatcaaaagttctttagagacctctttgttctgacatgaaaatcacttaacatactctttttttaaattttattattatactttaagttctagggtacatgtatacaatgtgcaggtttgttacatatgtatacatgtgccatgttggtgtgctgcacccattaactcgtcatttacattaggtatatctcctaatgctatccctccccccttcccccaccccatgacaggccctggtgtgtgatgttccccttcctgtgtccaggtgttctcattgttcaattcctacctatgagtgagaacatgcagtgtttggttttctgtccttgagatagtttgctgagaatgatggtttccagcttcatccatgtccctacaaaggacatgaactcatcattttttatggctgcataatattccatggtgtatatgtgccacattttcttaatccagtctgtcattgatgggcatttgggttggttccaagtctttgctgttgtgaatagtgccacaataaacatacggaaaaatcacttaacatattttttactgcaattgacaaccctgacaaatgggttatgtttctcctgtaattactgcatttaccttagtgttactccatgttttcacactggtttgcacacgtatctaagttcaatcagggtggattatttttgtcttgccttacccaggactatacacctaacttgtttcctcatactgattaagtgctctttctataccagatccctaggttactggcctattttctcccaagacgacttcacattttaccatttctggactttgtcttgtctttcaccaatactcttattgtctctaaatttctcagaacagtgctgaatgtgggggtcaatatttactaatttatgtcatgatatttatagaatatctgaaaacagagtcaggtaaaataaaggtttgtacattatgctggaatattatggaatattatcatgacattaaaagtcaggccttcaaagaataatgacacaacacggtcagtttatgagatttattagaatgcctacagtactaataacatgaacttttttaaaaaaattattaagttcttcagattgggaggaaaatataggaacccgatattcaggctcagcttttggttaccctgtctttacccctttctttctgatggattttctcatttaatgcatctctgccattttaattttgtaaagatctcctatacacaaagcacctttatatttccctgccagttactgttagatattttgtgtgattagcatcctctgaatgttgaggaactatgctttctacatgctggtttaccaggtgctgaaaactagagttatcaagtaactacctggtgttgccctctcattttctatagttctgctcaatatagtgggcattgttggcacaaaataaataagtacactggacactttctgtaatataatacagattttatgctgtggaaacatgctgcagatgactccagtctcatgcatatgaatggggtgcaaaatgggtgtggaattttctgtagggtaaacctttctcttcttcaggagaggtagtcatagatgtttactgcactaagatgttgaaagaacctgtccagtgaaggcacatttttttgttaatgtaaaatcaattcttaagagtaatctttttcagtgatttccggatcatgccttttaattagcataaaaacatggaagcaatattaataatgaaaatatatatcgtgtaattttcaatctacatcttacatatacaattgttattttaaaatttgactcagatcggcttcttcaaagacacagcaaaaccttgcataagtttttgaaggtctacacttagattttacatatttgctcacctgacctccacagttctgctcactggcatgtacaccatttctgtacctctcctgcaaaaaaaatctccagctgtattttattccttctcattcttacctgatagccaatcagccaaaatgccaattttttgccagtttttcatgtacatttcctttttatattccctgtgtcactgcctcagcttagtttttaatcgtctccttcctagctcatagcattggttccttaattgtttaactggatgatgccagtgatactgttcttaatttcattctcttggtgaggttcttaacggtaaccattgtgtaccttgtttgtcctcataatgtttagctactctgatttgtgattctattctagttgacctcacattctattttgaaatagtttttaaaagaatcataaaaaattagggaacttagtatttgtcctttataactgcatgttataccatctctacagttgaatgactatatatacatatatatatctttatatgcctctagatgagattttatacgtcatctagagactatttataataaagtgattagtagttaaagactactgattaatctgaacactgtctactgggttagttttgaattttgtttttcaattatcatttattaccctaggatttctagtaccattctgaggatagtagctggattaataatggtcagtgaagtttaaggtgtcatatgaatgtaacacaagaaaattagagatcaggtgtgtttgaaatcttttaaaatcgtatttaaataaaaatgtggcttccttattggtgtggactcatactttattggttgtaatcctgaccctctcattttctgtctatgcgagtgctatttaacctctctcagagtgctgctgtgaggattaagagaggtagcgtataactcaaattaatgccatgctttgtgactcttaagtgctcagtatatattagttgttattataactcatttcctatgataaataggtacacaataatcttatagttatgtacaaaggggagtgtaacaacttttttcacgtaaattgctcagcttgcaaattattatagagtttagtaaataatcagccttcagttttactttcccagaaaggttgtatcagtcttttatggtgactatttaagttacttacttttttctgcagtgattgcttcttaatgctgaaatcagaaagaatgtcagcaagaaggagagcaggccaatttataattctccatttgggatatatgaacaagcaattgattatgctttgatctttccggttttacctgtccattgaaatctaagatggctggaaacaaaatcgtcctcatttcctggtaatgtgttagaaaggttctaatttggggtaccttactcagattctgacactttgagaatagataaccatgaccgttcgatttttatttagaaggaacagtttatctcaaccctattagctgaagtgtaataccagaatggcttctttttattaatgctcaattatcctgagcatttggggaggtaaatgtctcttcatctattaactgtacttttttaaagttgacttttcttctcaggaccattttcaagtgagggtataattggctagtgaaagagacctttacctcacagtttcagttttattataaattgcccattagtgcattagaaacaaagtgaaaaagtgagaattgtaactattcttttattctatttgttctaatcctgccactgaatttttttcaacttttttttaatatatgaactcagtatgaaagatgttggggaaattgaatacattattggttaagttgtcaggaatagtatgatcttcaaatattcatttttctgacttcaaaactgaacaaagcctcacacgcatttggagttaagctatttcaccttgtatattaaatataattttgcacatctgaaaaatagcaggtaatgtactcacctaaacgatatcattcttttgtgaggcacatattttcttgggagattagagcttagagaataaagattaagtgactactaaaaattaataagaaggcggagtcagaatgaaaaaaaaaggctgagggctgaagtctttgtttatatcagcttatataatcaacaccttctctttatcaaattcttgaagccatgagtaataacaattttattttatgaggaaacgtgatatcccctggaaaacttgtatataaattgcacagtcttatgttcccaaaggatgctgggcccttgaaagaaacacagggttatacatatattagagggtaggtaagtagctggaaaaatctatgaaaggaagcctcacatcagtgtatctctcctagaaattaaaccatttggattctccttcctaaaaattccttggtaggagaccaagtttgagttattgttcaaaattgggttactggcagtgtttcaagggtcaattctgtaattaatccttgtgtgactatctaatttattgctagtagaaacaaatagtctggttctttgacacataatttaaggcaggacagtctggggatcccttttctaatgtactagaactaatgttttgtctttagcacatagcttattgccatttctatataaggcatgaatttgtgatttttaactgtgattttgttattttaaaatttacagtacttaggcattctctcttctctcttgctttcagaattgagtccctttctaacatttttgtttttgtccaaattgtagatgtattatattgttggaaaatagaagaaagaaacaacagatttagaatgttgaaagataataataatactgttttttaaaatatattacctactaattcaaacatcttcaggttttagaaaactagacccatgttgagtccattctagtattaccagcattaccagtttgagtagatgacccagaacattctttatctcctttcttttttttgagacagtcttgctctgtcacccacgctggagtgtaagtggcgtgatgtcagctcactgcaacctccagctcccgggttcaagagattctcctgcctcagtctctcgagtagctgggattacaggcacgcactaccacacctgactaatttttgtatttttagtagaaatggggtttcaccgtgttggccaggctgctctcgagacccagaacgttcttaatcattttacatgttttcatgttagcctaatttatcttgatattgtgttctgcccttcttcccacagtgtaaaatctttgcaaataatttattgcccaacagtatttttcagcatgtactctgccagtggtatcactaccattttagctgaaagatttgcttaacacaccatcattgttgtcttttaaattatttccattggttataccaaacaagtgaaatcctgtatagatttccactactttgaactcctccacatttcagtgctcttagaaatttttgtgatgttggaaattttctatagtatgtgctgtccaatatggtagcacaatttatagaatatgtgctttgcatctgagttttagaaatagctgtgaagacaatataaaaagaataagtgttgctgttacattatctttttgtattcagaagctttgtttctaaccactctctcactctactaagatgttaatgaaaatcaacactatagttttcaggaatctgctaaataatcagattgagaatggttattaccattctacatattaacccataaaatattaaatatattcctgttgcttttttctgctgcctgtcccaccaccaccattgtttaggatgaaatatcttatacactggcatacatggtacttatgaacgttccacaacaccatgtggaacgctgagtgagcctgatagagatagaatacagcttcttctttcctggcttctctgtactatagacaaattcttactttatctgaatttagaagtccttaaaatttcattcaaattcaatttgtagggcattgaattagtggcatttttctctgataggttttctgtatcttatgagaaattttactatacaatcctcgtatgttcatagggagaactgatctgctttcactaaatccagagtatgccagaagatctgaccataagatacttaatttctggtaaaattgaaagttttttttgttcaaataaaatgcatcaggtgctttcggaagacttggtgaagataacaataaatacattttttatctttaaaagatgtacttctatgtactgacaagaaacaaatctttaaaggacacagttgtttgaactaatgactccttcattagcagccatactaaaatctttgtaaaagttcaagaaattatacattttggaataaccactattatagtgttacatatatctataagcaactttgatcactggtattggctatgtaaaattatgttgatcgatactaagatgtttattgaagacagttaatttaattgcattcatacatcattagattttttttcaaagaagctccattttaatgccattttatattattttagaactttctattgtttgtttaccacagatttatatttgagagtaagagttgatattaatacaaatggcatgtgccttttctgatattactcttagaaataagaagaaaatgctgggtgtggtggctcacacctgtaatcccagcactttgggaggctgaggtgggcagatcatgaggtcaggagttcgagaccagcctgaccaacatggtgaaaccctgtctctactaaaaatacaaaaattagctgggcgtggtggcgcatgcctgtaatcccagctactcaggaggctgaggcaagagaattgcttgaacctgggatgtggaggttgcggtgagctgagatcacaccattgcactccagcctgagcaacagagcaagatgccaaaaaaaaaaaaaaaaaaaaaggaagaagaagaaaatgcaaagaaaacaaaaatcagaattgtgagtgttttatgttatgaaacaatacagtggtctatcagcacatgccaattattgctgaagagcagacaataaagcgaccagttaaagccaaatctgtcccttaatgtacatatttagcatctagatggggaagtaaaacacattctcacccacttatcttattattttaataacactatcatagaaatgattgaataaattcagttatggataatttttaagaagcttgaccaaaaaacaattttctggactctggagtttttgtttgtaaaattgttgtgaaatagtgtcctgatagattgtattcttttatttttcgtgaaggctaaactagtcttaaaactattttggaaagagaatggaagattcttttctatatcttgattttggcagtaaccttgtcagccttccagttggccaggaattttttacaattcacttcatttgagtaacaatcctgacactcaattgatgggctggaaagaaagcttccttttgacagccaagccttagccggagactcatccatgtatcaacggatattgttatcatcatgctcttttagatagcctttttgttttgtttcaggttggctttgcgatatattaaagcctcggactacagagaaacctttaaatattcagaatagaatttagggattaatcagcagtcttttaaatgcaagtttgcctagagtttgagacagctttccaaatggtttatatggatagttattattatttttgagacagagcctcgctctattgcccaggctggagtgcagtagagtgatctcggctcactgcagctcttatatagatagttttaatggaattgctttccagatactaaactttcacatgtacccacatgttcataaccaccttagaaaagaaaagcatagccattacataccccaagtcttaccatggtgcatattcctgacggaagggagatcaaacactattttttctggatccctccttctggtttatgaaactacctgaaaccttttaagcccttctgatttatcaaaattactgaaaccttttaagcctcttgcctttcccggtcctttacaattcttatatatttctgttaagggtaaaacttgcacttaacagtatattttgggatatgttgggattctctgagaacaatttttttttctcccctaaactcaggatctaatcttggaaaagcaaaatcaaaaggtttatcacaggggatttgtgtgattcaaataggataaaagtgcctagaaacaatagcttggctaattgttaatcagaaggacaatgcaaatttttaaatcaacatggaagtaacatgattgctatgaactgtagatctttcagaatcaagaacttaacaaagacaacaacaacaacaaaaaactcaaagtatagaaacttatggtggtaaaccacatccctgttatctgaatttattacagaaggtaaaaaataaccttttactaatctttgctgagaacagagtaaatgctgtaagaccaatgtattattttaacagttattaaaaatatgtcgaatttacattaacataatatgtagtggcaaataatttacatgctttcttttctttgatattattttatgaataagtctatcaacttaccaaaatttcacacatttcattatttcctttcaggctcattattttctggtgttatcaaactgagtcagctctcacctcttacacaacttgtactcacttaagttttgtctttcaccataccttttcatattataaagcgaccagacactttactttgaaaacttcttttttaaaaaatttccacttgacaaatgaagaacataatccataacttagttacacagttgaacttttctcccccattgcttgtataaagtgtggagcacccatatgaattataacacagagagctaagaggtagatatttgagatatatctatcatttatagtcattttcacagatatgcaaagctcataaatgccatcacacaatctcctactgtcatactcattgatattacactttattattgtgggaaaaagtacttacattataattactcaaagatatagccatgctataattctaacaggttggtgattagtttgtcaataccctatcttacgtagaaattcaccagttatctaaaaacgatccattaaatcgacttaattatgtttaacctgacaaactacagcacatacttattgttgacataaaaagattttggttgaattcatagttttatgtctttctcagtgctcgacattgttgttagcagtaaacgtttataatacgtttaagtttagattaattcgtctcttcatgaggacattaaaccaaattttatttaaaaaataattgtaatcttggaatatacttaatattggtaaaatcagggaaagatatatagtgttttcaaaccaaaattataaaaaatgtcatagtagtttgaatatttaccttaattgcataaacttggtttatatccttattcaagaatgctctgaggttgtatcttctacaaatattgctattttttaaataaagtattagcacatttaaattttttaaatacaggtgttttttatttttttggaattctgggaacgttagatgaatgtgattattaacttctcaaagcaatcataacagaactcattattagagatattattgtataatttattaacacatcgtggatataggaaaacatctgaaagttacagtgagagatgaagtcctttctaaattaaataaacacagaaacacagagagctttcagcttccattcttcaacctcagccttgggtcaagagtaaacaaacacaaaaactcactgcttcaaatgtgaaatttttcttctctttttttttcctgtgtatgaaatatgttcttgcacaaacgaatcaatacaagaaactacaaaatacaatctctgttgcctctcatccagtggataatagagaatcgtagttagagattaccaaatggtcagcagtaggattcactatcattgccgtcaccaactaggaataacttatttgctgtgtgcacaccagaagaagaaccaaacaagtaggctaggaaccagaaatagtaacacaaacatagagttaggataagaaagagaaatagagaactcttacagaaggtaaagttctaatattgataacttctattgtttgaaattgactcctgggaccagagaaaagtgtgcctttgcttaaatatttctagtaggtaaatcacctctgggaggcataagcgtggaacctccaaaactgtcgaagaatagttatgaaaaggtttgaaacatcacacctgtacaaatatagagtaaacatatgttaaaaatttaactcattaataaggaaaatagtgagatggaaaaactgctttaaaggaaaatcagaggaacgtgaccttctgaagctaatactgtccaataaggtaatggcacattaacctttgaggttatcatttcttttggggagaaaattaacatgtaacttcacagagtctaagactttaattaatagtaaatagcaaagtcaaacacaaatacattcccttaggtaattaaataatccttttgtgagcctgtcaaacagtccctagtgtatattaaaagaacatgccacctacttttttattttttgcctaatttccaagttttgcataatttttcatagcagtgctaacagataaaaataatagatgtcatctttaaaatattcatgttaaaattagttttccaaagcctacataaacaataagtttgactactgagtagattatacttgtcatctagttcatctcccaacaggttaaatggctttaccaagaatctacagcaagttatagggagaagagctgaaagataaatgaggtgagatgagcctggaaaatacccagttttatgttatttcttttttctgtactttaattgctctttagcctgtttctcctgatctcctagggcacaaaatgtatgggtatgtatgcatacagagcattcctggaacttaaacctaaggataactgtgttgaaactgctgacaggataaaaacctcatgtaattaaaactgccaatcacaatcaggacatatattaatgctgttttttttaaagtggttccatgtcatctgttgatgaatttgcaaaacaattatgattacattgacagtgaagaggtatgtatatgaatcagtgtctagaatctagatgcttatttccgtctttgctgaattgaatattttagatggaattaaaagggagctataaattttgcaaagttactgccaaaatatagttacaaattttacaaaaagcatttcttgaaaagcatattctagattattttgtttagcaatttacattttagagttttggaaaaacattatattcaatataattaattcttcttttcttttgaactgtcatagaacttcactctgtaatcttatgtttttagtaaatacagacttaagactttttaatttatttttcttagtttttatttctttccatattgttattaatgttgtctacacaatatgggacaaaaccttttgaatttaaagttataatacagaaaatatttttatgtatcctgaattttctgaccaaataatttagtagtttttttgttggcaccacatctattgtgtactaaatacactggaaaaaaacaaaatatatataatttaaaattccgctcttaatttttttaatccaatgatcatctatcgaaatggactttgagtcactaaataaattattttgaaagagaatctttttatgagattttagtttattccaaccccttaactgggacatgatttctaaaggaaacatatttcaaatttacgtagtggatttcaaaattaattaaaaatttaagtttaaaagatgactacaatgagaagttatgctggtaaatcctttctgataatattgttaagaagttatattcatctgaaggatgtgtttctacttagtttttcacaatgcgtgcctttataactaaaatgtcatttttttaaatgacatgtttgcttttttgctttttttcttgtccaatttactgtccacgaaaatactacttataagttaataagaaaaacgaaaaagtagcaggcaaaaaaaaagttctaaaatattaccataaggataatacatcaaagaaattttaatggaattttcatcacttcatgttgctggacatgtgtaactactgcacatatattaaagtggtccctaccctttaggaaaatgcataggaaagtgttgcatagtagcacatgagatggataaccttgacaattgtaaaaggcaagtgatgttcatgaccaacatactttacacatgactgtatatgagcatttgatttgtatctgttgatattgtgtgagaagaagtttaaatttctgatggtttagtttgacgctggcaaaaggcaatgcagagaaaatatcacctttactcttctaacctctattttaaagtgatcggagctatgccatacagagtttctttaactttaataagtatatccactgtccctaataattttctccatttacactaacatctacaggggttgatgcaattttgtgcaactgaaagcttgtcaaatttggaagccccactttaggaaaaataattcataattttggatatacctttaggacaaaaattaatatttgtgtagaatgagaaaataagtcacagcaaattacggaatttaaattttaacaaataacatagttatcatgaaaacccaggaaaatagcataatatttgtgttcattatctttctgataatctctataatctttttctctcacatttttgtatttttgctttttgatcacctaatcatatgatgagacttttctaatattttctagagtgagaatagtttttgctttagcctggaataataaaagtgtattttttatttttgatgttataggatagtttcctttagctttacaactcattattggtgtgtgatttaaatttatagtattgtcattccatttggaaacacttcccatcaaatttcttacatacatactgtaaggtttggatttgttttcattagctaactaatggctctgtgcatttgaagccttgttgctcttttactaccaagaattgtgtagtgctgggcatgttggaaagtttcttcttgggatatgacctctggcccttcattttcctgtccttacacctggtggatgtttggaagcctttcctacaccagagcggcttgctgaacaatctactggatccagttttagtatgggttcttaaaagttttactacatagttaggtaatagtcaaaattaacacaaatgcaattatcaaacaaacccagtcaaccaggattgaaagtgtcaaacagtgcaacaatcaaggccattctttgtcatgatcaagagcacagagcctggagtcagactgacaaaggtttgagattgatgaaagattgtcaggtgactttttggtctctcctacatagtctggaaatcagaatttggagctttaaactttaacatgggtaggatgccaactatgctttaaagttattttctttgatgcagaaagacataatttttagtatatcataacattaattcacaccattaatctttttttctctgcatattgaatcataggaacttcttttcacaacaatttttgttgttataatgttattttaatgttactaattagccctgcagaacccctatgacatcctttggcatcgtctcccatcgtctctctctctctttctctctctctctcattttaataataactgttgtataaaaattgcatgaggaataagttcccaactcccgtgatctgcttataatagctgtactttcttcatatagtcttaagaggcatgtctagtttaagtaccttccagagaaggtgtgtatttatgcaaaacttttcaggggcttgttaaaagtgaagcttttgcatgatttgtataagaaagtaattaggatatctatctaaatgataataagaattcaatgagtacagattggcaattccactttgaagattatggaaagatagagattttatattttaaaacaatttgttaggaatatcaaagcagaaaatattctagatttggatgaacaaccatatattttgtttaaaaagcaagaaattgccccagattacttcttgcattagcaatgtatatatcaaagactccggaaaaggaatttttttttttttaaccactaaccactccttgcaaaaataaggagcattaggactttcctccctaccctttacttttttaattctactaattgttcacacaattataaaatatgtagaagattgttttattatgtttttatctgtttgttcagtgatagtgttatatagtaaaagaacactggtttgggattaagcttaacggtgttttagtctgagcctcaagagactttattcatactctttaacctctataaacctctgcttcctgcactccaaaatgggactaactatactaccttgcctacttctaagtttgctgtgagtatcaaatgacaaaatgtgtatgaaaatgacaagccaatgtgtcatccttgcaattaccatagttggttagaaagatattaagcaacggttaaacttttaaatcctgttttacttgtttttattatgatagagttctttcttctattatttatagagttatatatatgtatcatccgtatccaaactaatattaatgttatggcaacttgtgctttttgagtctttccaaagatttcaacatgattttcataaagcatatcaatttttttcactcacattgtgtgacatcaggttaaaaagttactaacttaaatttcttagaaatattgactagaagaatatataacaatataaaatgtagagacgagtatgaaatatatttaaaactcattaacgaatactttaggttcatttgcttatttgtacaaaggaagctcaagtaatttcagtacctatggcaagatttatacattctgtaattagatatcttttaaaaacctacggtgataattttcttaaaaattggtcttaaagtaacattgttaacacattggtaataagaggtattcattgcctttgttttcttttcccctcattttatatacaattttgttaatgactgtagatttagtggtatatgtggtagctcatgtaatgctctagtatgctcagtttaattatagatttttttaaaaggataattgccaagcttatttgtcctgcacaacatcattgggaatactttaaaaagttttcagggaatcagagaaaaccaaactaaagataatggcctcagaacccaaattatttttactctgtcatgaattttgctaacaaaatcaaaataatgagtactaactgacaaggaccatttaataatctacccagctaaggttagcagtcaatattttacatgatatttcactgataacttatttatcatattttacatgataacttaagattctgtgggtcttaagttatgcatattctcttttattactttaataaatattaaaccacaacatgatgtaattttagcttattactaagtattataagagcacttagaatataactttttacaattacaaaaattttttaatgtcttatcaacatgaaatacttagtcatttatttagaaagtataagtttattagtggatttactgtgtcctgatttaggtcagttaccttaaaaatacgttcatttgtctgtttttattaatgctacatgccaaactaatgacatttaaaatcataggaaaaagagatttggcatttgatttatatttcatggcaaaatgcacaggtttgggtaatctcaggttcttaaattctttccacattaaatagtgagctaattctaacttttttactgtacttcttcgtgttactgcattaggtttttgaatctgcttggatgactcccgaagagcagtttagtctttgagaaaaccagatctccattgcttccatgaagatcttattaatatttagataatggagagtaacgaaaagaatttggacattgaatatgtctttgtcttctagctatcattctccccaacttaatctgtgaccctgagaaagttacttcatttctcttgagtcctcaacaaatttttcttacacagtatatgccatcttaattatcttaagtatgtacttgatcatctctagaggttcctttctagtcttaggttgtaatagtctttgtcatactggaaaaacatttttaaaaaccatcaaaatgtattctttttttctacactggaattgacatatggcactataaagatcttgtgatggtagaagtcatacatttgaacatgagaatattaatgacagcttgtaaccacagtatttcttatcctattctaagaaataattttagttattaagctggttttttttggtatgtcttgagtttatttgaacgattgaagtatttggaattgcgtcatgtaatagttcactgcaaaattaaagtaatttgtatgaatgagaaatggaatcagtatggtaaactcatttcattgtgcaaaatatcttttgcatggaaggcttagttctattaataattcaaggaaatttttaaaataattcattatacattaaaaaaactactaagtgtgctaacatcttgggatagactacggggtaagaaagaaaagagaatatggactctccatttaattatatgttattatctaataaaacgaatatatgcctttatctaataaaagaggtatagtgatattactcccattttccaggtatcaaaatggagacatagagtgattatgaaacattacacagctgacgagtggcagagccaggattcaactcagcgtagctccgaaatcccctcattattgtgttacactgactcccacctaaaactagatttggggcataagcttataggctgttaaaaatagtgagtttttgaacataggaccatgtcttctttaattctttctttccaaagtgaatgttcttataaatcaaacaagagagtatcttagagaagggagtcaattctctcagttattgggagaagaatagactcacatatgtcctgcaataggcatttctggataaaatgtctcaggatgtgtattatatttaatctactatgatgcaatgacattgtttaacttagataccatgtggatactccttatgttcactaagggtacgtatagtcttttgttacctaggtcataacagagaagcctttgtgtaccataatctgactctctagctataattatgtatcacttttatttctttcacacaactctttatatatacaacttaaacatatatgtctatcacaggacactattcaacagaagacacctataatataggagtgtgctgttgagaggatcaggagactctgatttctgatttgaaagaggaactatgagaaaactagaaatagttttcttgcccagggtgttcacaaaccttttctatagtaaatgttttagtctttgagccacatggtatctctgaactcaactgtgacattgtagtatgaaagtagccatacacaataagtaaatgaatgggtattactggttttcaataaacctatacttatagcatagacattggctgtctatggaaccataatttattaacccttgctctgttaagtaaaagcctttacaatggatagaaataagacagacataactcacacaaaaaggcacttcttgtctacttcttttctttacaagaagcctaaggtatgagcacctaattgcaaaccataccacgttcacaaatgagatcatgatgtaaataatggaagaaccaaatatggtgcttaaaataaaaatggtacccaaaaatataagtccttgggaatatagtgcaagaagaaacaccaatcattctcccttctgctgcagtttgggattttgttgacattggtatttcatgtttattacatggattgaaggcaactgaattcatgttagttacattatatttacaaaagttcaatttaatttctattcaaatacttaatattatgagtgcctgactacatttcagatatttccaaaaggatggaagtaagagaataggcaaactgaaacaatcttttttgaaaatatttttgtaacaggtttctataagaaggtgtgggtacaagtgtttacattttgtgtggttagatccaccacaagattatgagtatcttaagaacaggtcccatgccttattcatttttgtgtcattcccattccccataacaatacttgggaaaaaggagttaaatgtttttgaagatgaaatagtaattaaagttcacatgtatattgatatgtcttttctgcaatagtaaactaatcccattaagatatatatttaagacagatttttgtaggcaagtatgcagtagtcttacatgaccatatatttatggaattcaatatatgcacacacaaactttaatggagtaagttttgaccaaaatctaagagtatgatagataatgccaaatacagaaaatattcatatatatatatagtagttggtggtggagacagataaaatacatagtattttccggccaaaaatattatggtgattcattgaactttttcactcatgagcatgaattttttagctcaaaaaaaaaccatgaagcataattttctatttttcacattcattttagagggaagaatgatacagttatttctagaaatagttgtctaagaacaatgaatttcttctctttatgatagggtccattttaaattatgttcatttatgtccaattcttgaagaaataaggccaagctttgaatttatagtccgcaaattttcttttttaaaaacaaactagttcctaaggaatgcagatttttttaaaaggcaaccaaaacctaaaaaacttctctccttttttgtcctcttattgcttaaaaaagtacatgaacatactgtttttaaatttaggcttttaaaaaattgtcctcatgctgagttcttgtttgccaagtttcagcttggagagaatttttatagcttttataaaaccctgaaaatagaaaattttaaatggaaatgcttacacacccttagtgacagccacaaatcttgccactttttgagaatgaaggtaattttttagtatttagggatggtagcaacacgttgatgcgatagtttctaaaggacagagcttttgtttagtcgtatgttagatatgttacattggtttatcatattaagattcatattaagatttagctgtatgttcatacatttcgtatgtgatataaaagttttaaattttagagtgcatttgtcctctaccacatatagtttatatgtagaaatatgtcttatccatctttttgatatgtcacctattatttaacttgactagcaatttaacttgcaagcgattcaccctagaagttagatttattgtagttgaataaactgttgtcctctcacttttatcatataaaccaaagggtcagttgccctttggggaaacccagaatatgtcagatctttgtcaggtcgctgtgggtctttgtcaggtcccaactctgtcacagggattttaggcaactagaaccacaggtgtcacttccaaaattgatagcttgttatactgcaaccagagtcaattttagattggagaagagaaagaaaaagataggaaatgattgaagctgtgggcaccaagaaagggcagtgctggaaagagaatgaatgacatagacacccaataacagggagcgttggtcatttttgcatggaccaaaacaaaattgaagaagtactgctgatcaaaggccaatacaatgcacacatatcattctggttaggttgtctcctgagaaaaatatttctcagcagcagtatgatttattttgaacaatatctgattgaacagcattctagtaatgtagaaaatttatagacatctactaaattttattctagcagataatccacattaaaagagacaaaagtccatgttttacctagaacctctctgtggctccttttctccaccagaaagacaataatttcatatctggcagaagttaatgctttttaagttcttgacgtgtatactctgtggaagaagtgacctaaaaggaaaaccaaatagtttgataaaggataactgtaaagaacaaaaaaagtaaaacaaactactataagactaatagtccttgagacaagcgcatgaattagtgatgaagtattgctttactacatcctgaaaattctttacatttatttcttcagttgaatgaagctttctaatatctgtgtctggaactaattctgataaccttggcattcaaaatggagataaaggatagatagccttccacaaaacgcttcagtatggcaagaagaatcatctaatattgacaaataaagcaacgtgacatctgtgttgaattccaaattgacttgttgagctgtgcaaaaaagtaaaagaaggtgcttattttcaggatgtgaaatacattgggaaaagccaaggtcaaagatgaaacatgactcaatgccaaagattttcaatcttaatgaaaatctctttcaataagaaattgacgattgagaaacagtgtcattgttagaagttcgatgttcttttgggggtctaacagacgaagccccagagaactgacttttattaatagatagcttaagatttatagcttaggaagaacagattaatagtttttggagtaaagcctgaattatagaaggatgacctgagccctggcatgagtgatcaatcagttcagtgtctgcaactgcacaattttaagaactcttaaaaggctctttggccactgaaaatgcattataaaggataagtccataaccagccaagtctggaatatatgtttatatggctatacagatccagtgtttctttaaaaataaagcaaagggtatgacacaggttggtttgctgttacttaggatatgtacgattgaattgagcctaagataagtgggatgtactgggtaaaatgtggatgctggaggaggatgcacagaggctaatttgaatccaggagatttttccatttaggaaatagaattggagtcagggaagtaaaaatcttgaatacaaagctaagaaattgaattttccttgttaatcagggttcaaccattgatgtttacaaatgagaaaaatgtttcatgcaggttaatcctactgcaatattggcaggaaaggtggaggtcagcgggaagagacctctggaaacctgttgaagaatgagtacttccagggtaaagctacagcaggcaggacagcagagtggtggcctaggcattggagataaaggcaaagataaaacacagatggaaggaaaattcctaaggcaccatgagacactggatattgagtgagagagaatccaaagaacgaagaatcactcacgtcgagctcagcctactaggacgtcaatgggttccttatttgttttctgtaactctcttctcaaaatggatcaacttctttcaaacttccctagtgcaaattctggtttggttacttttcttttctgtaaaatgataagaacattaattagtcttgaaggaaccatttactgcattgcagatgattagaaaattgacaataccaacaaaaattgaattggattctttaggtttaatatttggcctaaactaacatatttcacctgccatgtgccacactcactgattattcctgagatattcaccaaacccttccccacacttggcagtgagttcattaatgacaggtatttattttttatctgtctccatagcctcaacacttaattccattcctagcacttaacagatgttccataaatgatgattaaatgaataaatagaagcctagtgtgattcccagctttgcctggaataggtcctgctccaataggaactcttatacctctttaaagagataaggagttcggcttcagggaaaacaccttgtagactccatttatcattacttttctaggttgttgtcatacaggaaaaaagaaatgatctgacacatttctttccagccttacacactaatacagtataaggagccacagagaggaattttaagattttttttaagggagagtatttgattggccaagatgtttgtttaattcaagagaaggaaagccccaaatgctgcctaaacataaactcacaattcaaaacattttagaaattatctggcaactttacatagagtccaaatgtttccagggtatgcagaaagatgccccaaagtcttaagtacccccagggaaagtagatcaaagtttagagaccatttagactcacttccaaaaggatctggcctcagagttttgcagtagtgagcaaaaattctagaaaggtctaggttcagaaaccatagcaaagttacaagagaaaggttttctagcttctgtttcttatgccattcaacaagatttagaaggaaatgcagccaaatttaatggtcgttacctgatgaaaaacagacatcctttggattatcctcaagcagaactgaacagaactaaatgcaattagaagactccacggaggccaagatgatcagatgatcgaggaaagcaaactgatataaaatataagctcaccatgttaggtaactcatgtgtttccaacatggtgctattagaggagcattagagaaatttactgtatcatgaagtgcacattcgtttcctcggctgaggacagtactacgacaatatttgacaggaaatgtagagaatttttatttcagtcaactctaaaaagaatggcgaaattcttgaagctgtgtatgatgattctctattaatattctttgttcaatctttaaaatggcgtttatttctcaaaggaaagttcgtgccatcaatattgattccattatatttgtgatatacatcaagttttatcttcagagtgaaaagttctttgtatatctttgtagtaaacacagattttgttctcattttgaacatgcactaatttctacatgaactaaatttctacatgaactgggcacattggcttaatttaaataaacatgttaaggtggtcattactattcaagagtcaccaatgttctgattttttattttatgttctgcttttttattttagacaggcaagttgttagcatttttttcaaggaacaaagaacaaaaattatcttgataagaacttgtttctgaaaagctagattagctcttctctgcacaccaatcatgcaatgacagtacaatttagtgacttaagcagtacattaggattctcagcctaggcagaagcttcaccctcgggccagacctatataatagttgtaagaaaatgatttatgtgttgtaataaatgttacttctcaatctgtttgcttgttcaatggttgaggtcccaaaagaaaaggtctatctcaaattaggactggcatgtattatctgtcaactttatatagtactgtaaaagtcattcagctgacagtaatattagcggaatgttttatagatttttgtactgtgtgaagctttgtatgggtgacgagagactttgggtctgtggtgctctgtggtccgggataaagttgcgtgtagatgagtcgtttctgtgcttctctgtaaatgaacatctggctcacatattgattccatgtgtgaaaatgagatcagcccatataatgaccagaatcaatcaggcttcagccgaggagtaacatacactggtcttgatttgttagacaaccagaattggcagcaccttgcataatttggcaccaattgacaaagattaggctgtttggggaccctgaatggttattaatttgaaaaccccttatatattttgcagagtaaaatcagctgtaacttatttgttccagcccccttcttctcgtacgagccctaattgttttagacaaacgaacgagcttgcagcctgttcactttacacaggaagacatgaattctttgatccatacagtattctttagctcaaccttggagctatttactgaggagatttatttgcagacagacagtagaacagttctttgtgaatagaaatgagtacagcttctatgtgttttcagctcaagtttctgctacttactgtaagggagataaaactaagccatctttatttttaacccaaatcattcttttttaaaatatagttttaaaaactgaaaatgaattagactcttgacctttttactttttcctcacaagttatatttactagagcacagattgaactcagagaatgaccaaataccatttcttattttgtgaattgtgttaatcatgaagaaaaacttgtgagattttaaaatgggacaggcgttgattgtgaacattttacaaatgtgtctcactccttaattccaggcacaaataaaactacctgtgttgtatgaacactagttagttcaagaaaagcaataaaaatctacttttaaaaattattactgccaagtagttttaaagatacagactcatttactttgaatttaactagtaatatttaggtaagtatctaaaccaatatttaattttttcaccaattaaatgagagttattggaacagtctctctaaatgctttatatatatgagccaggcaatgtaatagtaacaataacaagatagtttcataactaagcctttctataatgccataagatatgaactccattaggactgtttgatttctacttgacacagaagagaaaaaaaaatgatgagtttgattaacaaaatcagttctagaagtgaatttcaattctcaattatatttgacaataaattactcaaccgtagtcatctcagagcttaatttgctgagcctcttgataaccagtatatgaaaagtcacccccatgtttttttttcctgcatgtttttttaccccattttttcccctacaaatttgtaggtcattaacattattcatgaaattatttcctttatatttcttttaacttaattttaccaataacttttagaaacctgtgagtagcgtcatataaatctttgtagttcattaacaagataaataactttcactgcaaataaatatattttgactccaaaagaaataatggtaattaaatgttttattttctaatatacatttttaagtcatagattaatattgacagattttcaaagccattatagttttgaagtttttccccttctacccatatacaactttccaaattaggagatacaacttttagaggaaagcatttcaaacacttaaacatacacatttaaaaaaatttgtaagcttttcagtgtaaacatgcattcaatctatatgtcctacgttttcacagtctttcaaattgcctccagaagtcttaagacctgacttggtaaacaaaaagctcatgagtttgtgccaaatgctttacacgatcattttgcaaaaattgtgagtagagtcattggaaccaaatgcattcttctagtgggtagataggttatttgttatttgtaaaaattaaaagggttagaagaaaatttcagataaagaatgctatatataagtagaaattggtaaaccagaaggctttataatttcagatcattcaatgacaaagtcacacgtaacacctgttacagaagatacactatcaaggtgtcatgtgacatcttaaaaaactggtgaagtgtgtggttgtctcaaacatgaaaaaattttagcgcataggttttcccatgtcattactagccacaggtaagaattcttgtatattaaaaatattaccactgtgatttcaaaagtgaggccaagtactcttattggaatgtgtgacaatttactgtcttgtctgcactgtaggtaaactgtgttaacagagacaatacttaaccatggattttgttatatttcaaacatggtgtagacagctttatatttcacaagctacttctttgtcttttctgtacatttgtttatttggtataattctttcattgaaataataaatcctaattgataatgacaacattcagagaattctacagaattctacagatgtcttggaaagggctgtcttttatttatttcactcttatttatatgagtgtttgtttgatgtgatatatttttaccaggatgacagatgatgtggttctctatatgaatatgaagatatatatgctgtgccttataaaaatgccagccaaagccctttccacagctgctgtgcattaaaataaaatgttatcctgtgatggtgttacagtcagatattttcttacacctaaacaagagttttcattttgttttctttatgacataatcttaatatattttaactagctagttacagaatgaatcgttgttgtaaaaggtcatatattttcaaaagcaacaatcttttgtggatttcagaataaatatgcctaacattataatttcatggaaagtgactcagtgctatcagtataactcataatcatatggcctgacttatgctaggaaaactatttcccttaacaagactattgaacctgcctattctaccacttacaaaaaaacaaccaaccaaacacacatacacaactgtgtttaaaggtagggcaagggccaattctcagttgggtgcattaggttgtgtgcatgagggcactgaattatattaatttaaaaaatagttcaagttttaattgcagaggagttgtgaatactctgaaataatctgaactttattttgtagggagtaagaatcacagctcctggtctttgttccacccatgtatcattctataattgatttgcaaatatagaatttgcaaccatttgtggacaatggttgtttttatagtagtcccccaaacactctagagtttctggactcattgtgcctagttctcattccccttggccttggacatctacaagacaggctaaaaacacactaaatatatttttaaatagtctaagtaagatgtaatacatttctgaagttggagtgttgtagtggaattgaagccaaagcacttggtaaccaattggatgccagtaggaaatgagaaggtttagggaataaaacaagaatacaaggaagttaacctgccttcccaagactgtaagcaagttgtatgggaagtatgtagaattcagttgagcaatctaatgaaacacacatttggggatttcacgtgtgcccttggaaaaatatgtaagttattgtctataataataagagtgcataattttcgttcacagtcacaatgataccaaataaggggataacatggttttcaatgaagtaacaatttgatggtttgaattataccattaccatattaagaaaggactgttcattcttttctatcagctcataaataactccaggatcaatcaagatgatgacaaaatgtgtattgcatactggtttgcatctttgttaatacatgaatacatgttgctgtctttcaaagttatttttaaactcttagttttgtaaacattcattataatttttccaaagtcaagggaacttcatgaaatctggcctagccttctaattttttagataaaacagaattttattgtatattcaatttggagattaggctctaacctaccctatatttggctctgtttcaggatatttaaatttctttcattgtaatttttgttcctgtatttttaataattctggtatttttcttaaaatgtagaaaacaaatcaagatagccttacccaatttatgcctagtcttaaactttttctttttactattggtaaaaagtgtttttgtttttattttttgacagctagccctggacagtggttcaattttatggtaattcgcgtacattggtgtggcatctttaagtagtatcattcttttttttttttttttgagacagagtcttgctctgtctcccgggctggggctggaatgcagtggtgcgatctcggctcactgcaagctctgcctcctgggttcatgccattctcctgcctcagcctcccaagtagctggaactacaagcgcccgccaccacgcccagctaattttttgtagaagtggggtttcatcgtgttagccaggatggtctcgatctcctgacctggagatctgcctgcctcagcctcccaaagtgctgggattacaggcgtgagccaccacacgcagcctaagtgtgattcttaaaagtattttacctacagagagagaaacaccatcaagtagggcttatcagtaggttgtgtaccaagaaagtttgactctttctgggtctttgtattgaaaatttattataaaaataatttgtcaaaaaattcccactgtgcctggtaatgaatattccctttattaaatattaaatacatgagatgccatttcaaaataatgtgtatgcatgtatgtgtgtatgtgtataaatagtctaagcatgatgaattggctggctatttttaacagtttcaccgccaccacttcctgattgtccctagctggctctttggcactcacacaattcacatactgcttgttaagtacctactgtgggccaaataccgtgtatcatttctagataatcttatttcagctttggattttggtgtttgcatggatactttgtaagctgtcatagccgatagcctttaggtgttttgaaacctacagtcttacaaatgtccacatttctgtactggtagcttctcttttcataaccctatgtttgcctggatcctgcatcaaagaaataaggggagggaattgataattggaggtaataagcctttcagtattctagtgtttgaagttaaggcttattagggctcaagtattcaaggttttctcatctgttttaagcaattggattctattatttgttggccttctctatctttgatgcctgtacttaagaaaaccaaaactgtaactcagagaagagtgtcatgacttaattgatcttgccctgatcttgtgactgtattttgttctgttaagaaaaaaaggcgattcaaatctgcagcatatcaaggttgtgcctgtaatcttcctgatgattcatttttagctcacttttaaaccatataggatgatgtgtttcccacatatttaagtatgtgttgactgtataatgctaaaaaggtagacttgataaactttgttgatggtgaatcatggaaaatgtcaagcaggagggcaaggtcagatgtgcattttaggagttgtatcctgctggcaatgaagatggactggaatgggcagcaaccagtgtccagatatgaggagatcagttataaatcaattgaagaccttaataaaagcaatagactggatttagagaagtaggataggggtgggtttcatagaaatttaggaggtcaagttacccagagttggtgaagataagataccagatgtgacaaacaaaaatgattttctattttggctctggctgacagtatgaaaagctgtactatttacaaagatagagaaataagaagtaactgggttttttgtttggttttggttagaggactctgtatagtgataatgattttatttttcgtgagcactttgaacttcacatatttgggatccaggctttaatactgtcagctggtgaaaatatgggtgtagaagatatttttgtatgaacataaaaatttggaaattgagagtttttaaatattagttgaaaagtggacatacttgaaattccttaggttttaaagttaacactcgtttgtagataactagattgttgccattatactataccatcatttttacttgcatgcttatctccctactagcaggtatacaccttgaggacagaattgtctacctttttttcaggttctctaccacctaacatagtagctggaacatgttcactgggcctgctcagctaggtgtttagtgaatgaataaataagtgaatacgtagtagaccaaacaagaatgtagaatgagaaggaagaaatcctggggaaaatatgatttgagattctagtattatttctgaagagtggtcagacaactttgatgagaaccagaaaagagtagtggggaccactgaaaacaagggaggatagagtcgcacaatcaggagttactgctcagttcatttagctccctcccccgaaaccaagatgaataaattacctatagaaagatctacatacacatgggaagaatgtctggttcatttaggatgaaatttgagattccttatcattgtcaagaatagatgccatcgctggactatattgtcattaaaaccaagttcaggtcgggcgcggtggctcctgcctataatcctagcactttgggaggccgaggcgggcagattacaaggtcaggagatcgagaccatctggctaacacggtgaaaccctgtctctactaaaaacacacacaaaaaaattagccaggcatggtggcaggcgcctgtagtcccagctactcgggaggctgaggcaagagaatggcgtgaacccgggaggcggagcttgcagtgagctgagatcacaccacagtactccagcctgggtgactgaaaacctattccatgttcttcacacatcaagtgataaactggcaacaatgtttaaaaatattgtttctatgtctttagaaattttctgaaggtacagttgttcagggtgaagatttttacagaattcagtaaggatggattataatatgctgaacatttggttgcttttgtaataatagaggtggacagctgagacaaatctagacaaaatcttacactgactgttttgtaacgacatacgaatgaccctgaactttttaagtaacttaagaaataggccgggcacggtgcctcacacctgtaatcccagcactttgggaggccaaggcgggtagatcacaaggtcaggagttcgagaccagcctggccaacgtggtgaaaccccatctctactaaaattacaaaaattggccgggcgtggtgctgcgtgcctataatcccagctacttgggaggctgaggcaggaggattgcttaaacctgggaggcaaaggttccagtgagttgagatcatgccactgcacaacagcctaggtgatagagcgagatcgcgtcttggaaaaaaggaaagaaaagaaaagttagctgaccactcttcagaaataatactagaaaagaaaagaaaagaaaagaaaagaaaagaaagaaagaaagaaagaaagaaagaaagaaagaaagaaagaaatttagcacttttccagatgtcatcatgccttaacctagtactacaaatcaattcacattgtatcctagctccccatattcctttagttgtactgtctaattagatatattgcttagacacagcaaacaaatccagtaattcctcttaatctctgtttattaattttttaaacctacaagaacactaaagcagcatttcttctgcaccaaggaaatagaatggaaacacattagacagaccaattccattactagagacatctgcgagtttcaggagtcaatccctagcttgtggttctgattagggctctaatgttcttgttgatttaaactgtttttcttgttgtttagaggtaaaatctgatctgtaaaagatcccaatttgaaaatctttattagctttttaaaaagaagattttgtcttcaccagctacagcaagggccctctcgatggtaggatgttcatgagaaagagaaaggaaggaaagaggagcccagtaaagacacacaagaaggatattggccactggcagtattatttttatgtagcattatgaaaacaacgaaaaattgttttattttctaaagaagcacaatattttgattcatccataatgtgcatatatcattaatgtaacacattacactttctgggaatttttgctcaagaatcataaaatactttataagcagacaagaataattttaacaagcagtttaggaaataaccaagacgtctatgccctctgaacctacataatcattgttggaaagtagctcttcatctgctctttagtatactcttttaataaataaaaatggagataatagttataagttctgcttgagacataaaaatattgttaaatgccaaaaatagtatctgatttctgagaaattttgtatttttttatttaaaagtacttcattttccaaaagatttaataagcagattaaaaggatcaatgaacctttccattttaggaagtctattctgaagtctaccatacctcccaggaggtagctgccctgtgatagaaacaggttacattattacaacttcagttaacaacccggattaactcacttctgtctggggttatatttgttttcttttaatgacaaaagtgtatttataacacatcatgtttccatcaaccagggcatttcttcaaagaaatatgcaggatgaagttcctttagtgttttcaggcaaagtttgtttttctttactttgtgtgacactaactttttctttcaaatacattaaattttgtagctacaggattcaaatatatatgcatggcttctactacattacatcgtttttctggcttattagtttccatataagtaaattttacaaattctgaagttactctccaagattaaaactgaaaatgacaacaacaaacttgtgtgtttttgttggaaatattcctatagttgaagccactgaatcaactatatatatatatatatatatatatatatatatatagagagagagagagagagagagagagagagagagagagagagacaggctctcactttgttgcccaggctggagtgcagtggcatgatctcagctcactgcagcatagactttagaggctcaggcgatgctcccacctcagcctcccagtagctggaactacaggtgcacaccactttgcccggctaattttttgtgttttttgtagagatgggggttttgtcatgtttgcccagctggtctcaaactcctgggctcaagtgatccaccagcttggcctcccaaagtgctgggatgacaggcgtgagccaccacacccagcctataatttcttttgtaactttattggtatggtaaggcagtagtgcccattgttctgcctatattacacctgtccattgtttttcgagttcttttgttggcctcttacagttttctaatcttcctcgtcatttgactaatatttctccattcctgatgttgttaaatgaccttacctactcctctcctttttggatgcctctaatctgctgaggacttcaaaaccagaaattttaatatcacaagaatgcacctgattggtatatgcccacaatcaaaacccaggcatatgaacaatgccctttacaaaggcttattgatgtaacataattttaatctctgctatttttgtgtcatatataatgtcaaaaattgggcaagtagagggtctgccctttgaaactgagcagcatgaatcagaaaagctactcagatcacaaggatgttccctaaacaaaactggtagaattatccctttccactttcaatcatgtctctatttttcttttgtgtaatttcctgtttttcagaagaattagaacttgagcacctggagcccatttctggacttgatataagccccaaatatgataagggagtggaggaaatagatgtttcccaaggctggggtcccaaacccccaagccatggacccgtaccagtctgtggcctgttaggaactgggccacacagcaggtgagaggctgttgagggagcatgatggcccgagctccgcctcctatcagatcagcaactgccttagattcgcataggagagtaaaccctattgtgaacttcgcatgaaaaggatctaggttgcacgctccttattagaatctaactaatgcctgatgatctgaggaggaacagtttcatccccaaaccatacccctcatctgtggaaaaattgtcttccacaaaacctgtccctggtgccaaacagagtggggaccgctgtcctaaggcacatatgagaactgtgtaaaggtactgtgttcactcagaggaatagtcccatgagcaaagtgaacatatttgattcccatattttttaaccttcattttctggtattagtttttcctcttactttggacatatgaaaacattacttgaaataaaaggtacatttgagttttaaatttggtaatttttagcatcataactttaagctgcaaaacttggggtaggatgtgtgtataagagtaaaaatagttttaaatatacacataaatgtatattaaaactttttctaaaatggagatacaaatgtagaaaactgctaactgttgtaataaatattaatcaggacttcacggtatagactactagttattttgaaaaagtcagaattcagtgagttttttgttgttgtggttgtgaaattggcattatcctttcttcataacatttagaaattcacactaccttacatttttcataagaattgaaataaccagtaaattagtttaatttactaatttttttctcccctggcactttataataaatgatagcctttatgtttcagaatgaaaaaacaaagtacttgcatcttttttaaatagacaaactcgttataggatattcatcacatatgccttctttctgcctagaatgatttatttttctgtctttttatattgatatagttaaacagttacctgtttgcaaaggaaaccttatccagatgtaggctcttcttttctgtatttaacaattgattgttacagttaaagagtacattgcttatttccataacacaatggtctttattttgaaagacaacccattggttgaaaagagcttagactttggagaccaaagagatgggttcaaattgtgtttctgccaattagtaccgggttctattgatagtttcttaggctttgtaaattataattttgttttcaacctgggataaataacacctattattgcataattattttaaggattggatgtaatggatttttagaaacagcacaggatttgacatgttgtagttagttgctcaactaagtgtagctacacgtttattttttgagccatgagaagcagagggggaattgagggggttctagtggtagaacgaggactcaaatcattcgctttaatataaagtgacaattggaaatgatcatccaggaagaagactaagggactccagatacaccctttttgaagatgtctaataattcaagcatcaccctgctcaattgaactaaaaatttggattgtgtagaatttcatttgaacagtagaattttgtttgaacagtatgataagctcattaaaatctatcacttgtgtgtaacctgatcctctggttaattccatgtgttttcctatggccttttagttctgcaaaagactgggcttgtaaagactttgatttcatttttttttttaacagatgatagcaaaagatatttagtacctagaaaggtaaactaatcctattttcatgtgcagtcaccctctagtgtaaataagtagttttcagtcttcaaatggaaaacattccaatgtcaaattctttaggaataggaataggaaaaaggattctgatgcagtgagtggctaatttatatatgatataaatttatatataatttaaatatatatatatatatttttttcctcctttctgccataatttggcttctccttttctgacataagatctatcagactatagtacaggtttcagcacagaagtaaataacagcatgtttccttgggagcaattgaacaacagaatgaaacagtgcttactgttttttgaaagttgtgtcagattgtcatggtaatacagagttgcatcatgttgtcatagtaaccagaattataaaacgaatttaaagaggatgaagagataccttgtgattcctttagctttaaagattttgttctaccgctacttctgtttattttgcttcctttttgcaaaatgtgtcacactgctatttttttaaaagtagccatggtacatcctctgcatggctagagggaatgatggaaatctttacttcttcccaaatgaagagttgaagcatcaaagtttaagtcatcccattctctttgagccaggtaaaattcagggtcaggagcacatcagatacactgctgtgtcaaaacatgccaactctgagcagggaggaagttccactccgagtgggatgaaaaggtatttcacctttcttaatgatgattcatagcttttctttcaagcgaaaaacatcctaatcttactttgaaggaaaagcagtattaagctttgggagccgattcatcgaactgtatcagaattggggtaatattgttttttctctttaattagaatgatttaggtcattataattcatcaagaggttaaaatgtgacccttgaggtgaaaaactaatttcaaggctaaaccatttctattattccatgagagagaaagagagaaaaaaataggcttacaagtaagttgagactttcgttgctggagcgcatccaataactaattctacaaataataatgactgaagaaaaataaatttgtcaactttgaagtcttgctaaaatcaattgttttaaatattctttctcttagctcctaccctcttggcgtaagcaatttgctttcgttctttttgttgctacattgcctcctctcgacttgctttttaacaaacgctttaagagccatgcaagttgcagcaagtttcaggcattaatagtggccaggtagtataatactatttttaatgaatgcctgttttctattctttactgtgctttctttggaaagaggcccacgaaacaaagtattaagaaaacacaccgctgccctggaatgtgtgtattagctgcagattatttcctattagcagattagctgcaaggctattggctcagaaaggtctttgagagtattttgttttgtaactgattcaagccatgggagaaaattgccaccatgattggaaagaagaattagctactgttgccatggacactggagttcacagtcccattgttaaatctagggcttcagaatgagatgtcccagcaggagttcaagttttgttaatgaaatgatcgaatatatttttttcagagttgtgacagaaccttgtgaaagatatgtggaatatattttttatggaatttagagtttcctttataaatcagtgttttctttccagtaaaataaaataattccatgctatagccctctatgaaaactaatgtacgcatctatttaaatatttaattacctccctattacatttacatttatagcatatcttttaaaattatatgtagattacataaaaactaacataaaattgcaaatctttaagtcaaattattataatatccatgccagtatggtttctaacaatataaattgatgatagtaatgcatgttggatgtaccttttaaaaaatgctttataggcggggcgtggtggctcacgtctgtaatcctagcactttgggaggctgaggcgggtggatcacttgaggtcaggagttcgggaccagcctgaccaacatggagaaacaccatctctactaaaaatacaaaattagctgggcgtcatggcgcacatgtgtaatcctagccacttgggaggctgaggcaggagaaacacttgaatccgggaggcagaagtcgcagtgagccaagatcattgcacctcagcctgggcaacaggagccaaactgtgtctcaaataaataaatgcttcatagaatagaaacaggatagaatagtatattaatgctagcaatatgttttaaaggctatatgccatgtgacatacagtagattctagtctttaaaactggaaataattcatggaagttaaaagctagtggcttattatggtgataggctaaaaacctgtaagttcaaagatggatcacaaaatgttttcactagcagactcttgctaatagtccagggggtggatattcaggtgcaggctagaagccaggcctaatgcgcttcaagaagaacttacagacttgaccagtcttttaaaaaagtatcttacccctcctattaatcaaaaatccctttgtctgggccaggcaaggtggctcacacctgtaatcccagcactttgggagaccaaggtgaacagatcacttgaggtcaagtgttcaaaaccagcctggccaagatggtgaaaccccatctctacaataaaatacaaaaattagctgggtgtggtggcacactactgtagtctcagctactcgggaggctgaggcatgaaaattgcttggacctgggaggtggtggttgcagtgagccgagatcttgccactgcactccagcctgggtgacagagtgagactctgtctcaaacagaaacaaaaaacactttgtctcattatcctactaacaatactgttttgttcacttacttttcagagaaacgtagagtccattcatacttttgccactaactgatcatgtgactttgggtcatttaattatctgtccctcagtttcctcatctataaactagaatgacaatagcacccaccccatagagttatttttgtcgattgaattaaacccatacacacacacacgaacacgcacgcacacacacacacacacacacacagtgcttggcacccaataaataacaattgacaattgttgtattcagtaacttttggtggctccctatttctgacaaaatgtttagatattctaacactggaaccctgtctgttcctgcaaaattatctgcctctctaattaactcctgaaaacatatctagttgttgcctggacacacgccaaacacatttcctgaacattcttacctctgagtccttgtttagcaaagcttccaaccaagagcactgtcacccctctgattctgcctaaggtcagtattttctaagacccatactctttgaagtatttcctgactaaccaaacgtcacccctctggattttttgtttctcatctcaatagaatttttttcttttcaaaattttaaacatgtattagaagccaagtgagagttagtttgaaattaaaagacccttaacctttcataatcatcaagtcctcctgggtatatttcatttatgaaaatgttattacaaaaagaaaagccatatccctaggatatttgctttccacaaatttcatttatcataaaaatttatattaactcgtttgtatttggattcattcaaatacagattgaatgaatctgaacctgtcattggtttggttaacttattatctagatacttatcattgtgtaatgattccagtggccttgttgctaacaggttctcagcaacaggcggttgagggtgggcagcagtatcaggcttgcttgcttgcttgctttctctctctctctttctttctttcattcttcctttctttctttcttctttctttcttcctttctttctttcctttctttcctttcttttctaccaggtctcgctcatggctcactgcatcctggaaatcctgggcttaagtaatctcaaacaatcctccctcttctcttcgacctcctgagtagtggggactacaggcatacgccagcacactccactaagtttaccatgattccttctggtagcactgatgggaagactctcaggtttaagccaaagctaaaaagacaaaaaagcaagccaattacacttcaggatggaatgggtaatgatctaatgcgctaacaccctgtacatattgccacttctctttccattggaatatcttggaatttaaatcccatgtaaataaatgcaaaaactcccttatttggagttttatctggcaacatcagctacctgtgatattctgaaagaggaaaagacaaagacaaaggtctcctcaaacgtaatagtgaataacaaagctacaaaagagggaaattggaatcgtctttaacaaagtctaattattacaaggtaaagggtttagatgtctcctttgtttgtctcccagttagcacctcagaaggggagtagagaattgttaccataaactgacatcctgagtacaaaattgaagaattttctgaaaaatcacaattcagaatatatgtccctcccagtattttgttgttgatgttgtttggtccttcatcccgtgtgtttcgataattgtagaaatagaatattataaatgcagagaatcttttgagttgtgtattcaaagagctgtcatctctcctggatttaatctgaataaaggagtgatcgctttcaaatttataaaataataaaccagcctccaaaattctgggaaaacatttttctagtccttgatattaacttaaaggtaagattcttaagaagataatcactgtttcaaatttcaagagatgaattctgtggtctaagacaatcgaattctttgggctgatacacctgtgaatgttagcaataacaataacagacaaaaggaatgacagcagaaaggtagacgattactgagacacaatataaaagatcgaaatgtattggttattgtactaagtttatagctgcttctagtgtaattatgaatttataatatagaattccaaattattagaacattattcattagccctattaagaaaaagttatttttgcaagcatgcaaaattacatgtattacatgcatatgtgtgtatatagtagattgtgtatggattgtaaggtgtggattataattttcaaagaactttaatacatataatggcataattaactatatatctttatccccttataataaaggtattttaaaatatcctcacattaaagaaaaattggaatgcaaagagttatttcacggttttactttcttgcttactaccatttctggattttatgagaattcagacatttaagaattccttgtaaaacttggtcttgccctagtaaaacttccttgtcttggtaagataaaaagtttgtttgacagaacccttgtgtgtgccttgcactgatatctattataaaaatacaattgtaaaacaaaatggaataaaatgtagagataaccatcagccagataccacaaacattatttcatttgtgttttcttctactcttacatttagctaaaaaagagacattgaggatcagtaacttttaatggaaacaaacaacacaatacatttttatgtatggcataaaaattggcatgttaaaagtattaagtttaagatggattgagaaacccatatttgaatattgcaattttaccgtttaaaaatggtaagatattatttacctgttctttaaatatctttataaaaatgatttgaatgtctttcagaaagccttaattttaaaggagctcttttaaaaagccaaattcatgctaatagggaccaataaagtatatttctaataatatttaccatgctctacaaaatgtcatgtgtgcatttttttcatcctgccaaaagccactctttgctttgaaattcaaacataatgtggcctcagagcattataattcatgatcttttgatacaaataaatgaaaacaaaatgtacactctttaattaatgtttaaaaatccaactctttattagtaaaccaagaaatatgtgattgctgaaccaaattctgccagacaatggtatgctataaaatttttaactgggaaagatttcatactgcacgaaaaattctgtggtttttttctgcaaagcagagtaaaaaaagaaaacagtaacaacactatttttccttaaaagcttgttgttttttaagattgggattcagtcccagtctttgttttggtttggtataatgggagtaactggacaatgtggctacacaaaaatgaaataagacaatatgttcccatatgcagtgataaagcaagctgacattttattggtgtctcatatagtgtatgtttctaagtgaaagtgtatataccatgtaattcacttgagatcaggtatgtattccattttgcataagaatgggggcaggatgtggaggatgagaaggccaaattaagtcatatagattatttttcagtagacaaaaaggtgttattataatggagtgggagtttaaaagtcataagagctatactacttattagacaaaatttttttaaaatagaagtaactgcagcctgctaaaatgttacatactttttatgagaacgttttgaaagtattgaactatattaatacataacctcatttataatgtcactgtttatatgagctgattattttaactctaaattatccaagtgtctattttatccttatatatctgttttctgccttttagtatgaattctccaatattatcttgagtgagaagggaaaatgtggtctctaaaagattctagagaagctctttgaaaaatgtctggtttgttttttttgttttttggtttttgtttttgacggaatctcactctgttgcgaggctggagtgcagtggtgcgatctcagctcactgcaacctccacctcctggattcaagtaattctcctgcctcagccttttgagtagctgggactacaggcgtacatcaccacgcccagctaattttttggggggtttcaccatgttggccaggatggtctcgatctcttgacctcatgatccacccgctttggcctcccaaagggctgggattacaggcgtgagccacctcacctggccggtagtcttatttatatcacacaggcataccttggagataactgtgggcttggttccacaccactgcaataaaatgagtatcaaaagaaaacaaatcccatgaatattttggcttctcagtgcatataaaagttatgtttacattatactgtagtgtactaagtatacaatagcattatgtcttaagaaagagtgtgcatatcttaatttaaaaataccttattgctaaaaatgtttaatgattatctaagcctctaaggagtcatagtcatttgtctggtggaggattttgccttgatgttgatggctgctgactgatcagggtggtgtctgctgaaggtgagggtggctgtggcagtttcttgaaataagacaacagtgaagtctgatgcatcaattgactcttcttttcgtgaaagatttcctgtagtatgcaatgctattcaataacattttacccacagtagaacttcattcaaaattggagtcaaccctctcaaaccctacctcttctttgtcaactacgttgatgtaatattcttaatcctttgttcatttcaacaacattcacagcatatttactaggactagatttcttcttagaaaccactttttttgctcatccataagaagcaactccttattggttcaaatgttatcatgagattacagcaatcagttacatcttcaggctcaacttgtaattctagttatcttgctatttccaccaaatctatagttacttactccacgtgaagtcttaaaatcctcaaagtcattcttgaggattggaatcaacttcttacaaactcctgttagtgttaatattttaacctcctcccacgaattacgaatgttcttaatgccatctagagtggtgaatccttttttgaaggttttcaattgactttgcccagatccatcagagcagtcactatctatggccgcttcagccttataaaatgtatttcttgaataataagacttgaaaagtcctaattactcctggggtccacaggctgcaggataaatactgtctttgcaggaatgaaaaaaaacactgatctctttgtacatatccatcagagctctggggtaaccaggtgcattgtcaatgagcagtgatcttttgaaaggaatcttttttttttttctgagaagtaggtctcaacaatgggcttcaaatattcagtaaaccatgctgtaacagatgtgctgtcatccaggctttgctgtcccattacagaaaacaggcagagtacatttagcataaatcttaagggctccaggtattttagaatgataaatgagcactggcttgaatttcaagtcagcagctgtattagcccttaaaaagagactcagcctgtcctttgaagctttgagtccaggcattgaattttcttctctagctatgatagccctagatggcaccttttaccagtagaaaactgtcttatctccattgaaaatctattgtttattgcagctatcttcatcaatcacctttcctacagcttcgggataacttggagtttctccttcagcacttgcttcttaaccttatacttttatatggagatggcttctttccttcaacctcatgaaccaacctctgctagattaagatttttcttctgcagcttcctcacctctctcagacttcatggaattgaagagaattagggccttgctttgggttagactttggcttaagggaatattgtggctggtttgaacttcaatcccgaccattaaaactttcttcatattagcaatgaggtaattttgctattttatcatttgtatattcacgtgactagcacttttaatttcttgcaagaactttgcctttgcattcacaattcactgttgagctcaagaggcctagctttcggcctgtctcagtttttggtgtgctttcctcactaagcttaatcatttctgttttttcctttaaagtgagacagctcttcctttcacttgaacacttaaaggctactgtagggatattagttggcctaagttcaatattgtcatatctcagggattagggagacccttggagagggagagagatgagggaatggctggtcagtggagcagtcagaacacacgcagcacttattaagtacgctaccttatgagtgtggttcgtagcacactgaaacaattacaatagtaacatcaaagatcacagatcacacatcaccataaaagatactatagtaataatgaaaaagttcggaatattgtgagaattaccaaaatgtgacactgtgacatgaagtgagcacgtgctgttgggaaaatggctcctttagacttgcaggatgcagggttgccacaaactgacattttgttaaaaatgcagtatttgtgaagcacaataaagcaaagcctaataagacaaagtatgcctgtcactatgtaatgaaggagcataattttatggagttttccttcaaatgtgacatgactaatttcttctttttatttccactgctcatcagaagcctcttttcttctctcctgatttattgcctactacctggtcttcctgttctctgaatttcctctctcctgaccatcctgcagttcctgctaagatcagcttcccaaattatatcatctctttgttcaaaatcatctgatgactcagattgtaacttgggttttcaaagaaccgtttcctatatctgtgccttttcgcctcagcttctcagtaaactggcatagatcgtggtgaagttttttttttaacattccctcacggagtgactatatatagtattgatgatatatataggcaacatatatagtaactacattgtttggatatggtatgactcagcaagcatggggtacactgtaaaactaaagaggcgtatgttctattgctgtgtgtaacaaattactacaaatgtagcagcttaaaatactgcaaattaattatctcacagttttttgtagggcaggagactgggcacagcatgactggatgttctgttcagggtctcactacgctgaaattgagatgtcagctgggccgtggttctcatctgggctcagagtacttttccaagctctctggttgttgggagaattcatttccttgcatccatagaactgaggtccccattttccttgtagctgttggccggagaccactgtcaagcccctatgggcagttcccatgtggccctcatagatgtgtgctttctttcaggccaggtgatgcacgtctctctgacttcctcttctgagaccagccaaacaaaactcagggcttgtgtgtgtatatcaagcccaattggataacctcctgttgtaaggtcaactatttgggacctaaatttcatctgtcaaagcccttcagaacaggtcctagatcagtgttattgaataactgagagaaagtgtatgtacaggaggacccaggaatcttggaggtcatcttacagttctgcctactacaaggagctgcagtatccataactgcaaaaagaaatgtagttttagagctaatgcctcaggacaactgattctccaagactggtggtggaagaacattgtgttcttcattcaagaactacttctggaaaatttcctgaagtgcatcaagcactattgtagcagtttttaaatgttcagtcaatgagataaaattggaaaattagtatggcatcttacccctactgtcagattttgaaaatagcattgtaggacatcacattaattggtgtgatttccaggaaaaaagtcatttttgaagctcttttagatgaagctgaccttctcagaaagaatacttttataataacattgctaaacagataacaaaccctaaatatcaaagcaagaaactaaagaagtgaaaggaagcaggacaaaggacaactgactttgtgtccttatttgcctcttgaaggatgtgttagagaagtcttcagcatctaagtactatagctattacttctatcatggggacatgatatttgacttgcctctctcagataaaatttggaaatatgaaatattaaagatttaaacttttttgaatctttaatattagattctgaaattgaatatatattagtcatattatgatattgtgtttacctgtattttgtctaacagatttttttttaagctttagctaatgaagacacatggcattgttaacagtggtaaagatgggaggaatgtttagattttctagtttggatgtagtatgccttgttttgagatacattgatgttggtttattttaatggcaaaagtgctttcattattctaaactatttgatttatcatgacctcatcccattctgtaacaagaagaagattgttatatttttctccagaattaacattacaatgattaataagagaaatcatatattttacaaagccactatgagtcaaatacacatttttctgtgaaagcatttttggagctgggaaatatcctctcctgttctctgtagtatcctgtctggagaaaatccagtttgtatcttttatatgcttttcaaaaattactcatctttagaggctactgggagctgattgtggtgtaatttctttgctgtgttcaattctgcggatcaaatttgcaatctgatatgcatacatacctctagctggcttagaatagatggagatagcaccttttcatacatgcctgcagtgtcagtgtctatccacaaatgtttgggaattagaccagaatgttaatattgaccttgccacttccttgctgtgagcttgggcaagttacttaaccacttggagcttaaatctcatctgtaaaatggagatgattatttatcataggatgatacttacaattaatttttttttttttttttttgagacaaggtctcactctgtcacccaggctggagtgcagtagcatgattacagctcactgaagccttgacctccaggctcaggtgatcctcccacatcagcctcccaagttagctgagaacacaggtgcatgccaccatgcctggttaatttttgtatttttttatagagatggggtctcaccatgttgcccaggccggtcttacactcctggactcaagcgatccacctgcccaacctcccaaagtgctgggattataagcatgagacaccgtgctcagcctagaattaaattaaaaaggcataagcaaagaatctaaggtgatgcctagaacattctaatcaccaataagtatagttttttacttcctctctcactttatccattcagcagaaagtgactgagtgtttattctgtgctagtatctgttcagttaggttctggaaacatgaggataaataaggtatgatgtctgctcctcaaaaggacaagacctacttatatggaatgacaatgtttatgcatttacagttcaaggcagttaaataaaactcatatgtaaaaggcaaattgctactgcttattactaaagatagtaagttatacaaccagttatattgatcacatggaaataattacattaattttctttgtgggttttcccatggctttctgtgcattttggtttcagttaaggtggggttcttttatctaaaatgcccacaggatatggatcctcattattgaggttgtattcttgtttcttttgttgctgtaaccatgttgatggtcaactgaagctattttcatacactctctagatttgatctttgatgaaaagaaccaaaaagaaatcaaagagttaccttgccttagggacttccttcttctattaaattgatgtatcccaactttgttggggtttaaggaacactaaaaggcctatgtttattcagttaaacttgaaagtattgggacagaatgtgctctcctagtattgtgatgtttgccagagaagatgtagtcattgttaatgattgtaatgaattgtttattttttactttaagtattttagatattcgtagtaattgaaataaggaaaactactttgtaatgtaaaaaaaaattaatttacttacttataactgtaagactttgtacagccaaaattgacctatatgtttagttaggattcagtgaaatccatttgcatatgtaggttaaatttcaccttatacatcaccaaactgcagcaagctaggactttaaacaactaaacatacacatattaattcttatttgaaatgatttgtttttgccctcattgaatgaatggttagttgctattaaaagatattattcaaagagcaaagctaatgacctgattttaaagaatggttcaccaaaatagatcaacttgcagtcctgactgagtccccagtttatactcaatctgggatcacttcccccaacatccacgttatctcaaggattcttttcctcctctgtacttccttagcattttgcaagggacaggtggaagccatgtcctattctgccctgtattctgttcatttgtaccattatactgtcttcctaaacttaccgaaattttccaagaactgttttccttcactacattcttcactgtgcctttgcattaccttatctcacagggtactcagtagaaatcttcataatcgaaggctgaagccaaaagtttggtatttgagttataccaagatattttagaaaaactcagaggggggaaaaacagatgactgtctcagcagatatacttatccaggtttccactgtgttcctgaaagcagttctaaacatagtcaatctctgtttctcaaatagttatcctctttatttgagatgagcagacaggagcttcttcaaacactgaaagtagttgctcagatttcagaatgaatagaattctcataatagtttttatgccctagttttttgatgatctggtacagttagatgaggctctctagtgtttgaatcatgaaacaatatcacttcacttccatcatattctaagcccttgtgatagttaaggacaagtaaaaaatataattactctgtatgggttttgttgcagaagagtgggggggggttgatttttatagtaaagtgagggatctataagccaagttataacctctgtttgttagcactacaaaagttttgagacagtttgaaatttaaactcaatgcatttgatgaatagtacttggctagtttgcgtttgcttcttaatttcattaatttttggtggcaaccagcctttacaacagctatttataaacctgaaatatctgatctgtaaacgggcaaacaagtcaaatctgtgtatatcttatttgccaaaccgttacatttttctgcatatttcatcacttttacttgaaaatgggcttgtagaaagataaacagcatatttacaggaaagaaaaggcaaataacaaattctaaaatataaatgcaacctaatactttctctctataatggtaaaaagaagggcatttaatattttctcctaaagtatatttaaatattttctagtcaacctactttctaaccaatgctaataattctgtcgacttattttaatggctgacatgcacgtaaatttagtgttcatattgaatcaaatcattagcatgaaaaattacacaacagcaagtcctgttaactaattatgctagattggcacttcagaagaggttcatcaattcaagtattatcatttgtagaaagaaaccttttaaaagaagctttctattttaaaacttgttaatgaaagggcttaaaaatagagatatatgtatgccgaaaaatggccctgaatataatatatgcattctttgcatgcatgcatttttcgagaggttacacattaagagatttgatatagccttccagatatatttctgacctatggtagcttaaaatgaggacaataaaaatcaatctttacccagataaaaattccacatacctaagaaggcatcaggtttctcatgccttattaacatttattcttctgtgcataaattagtccatttcatagcataaattacaactgacattatctcctgtaaactctataataaaagagtacagaaactctgccagccagccattttaatgttgatttctttacttatatttaaacttctaaataataataactaccattactgggtgcttcatttatgttggacactctgctaggtgttttgtatggtatttcatttcatctccctgttgaaagctatagattaggcagagaagctcagagaggtaaagtgaatttctgagaacacaaacttctaaatggaattgggatttgtgcttaattttaatctgtctgactttcacagtcatcttcagtatgaacagaagaaaatccctgaacacctttgaaatttaaagcaaattaaagcaaatactatgccattagagtatatacatatgaatatgattcactccctgtgaactctgctgtattctcccacctctaatgtgcctcgcctctgcttcattgggaagtaaaaaaccattttactacctgggaattgtgaagctatctggtcctttttaaaaatataacactcttctgaggactttctgatgctgtgatcaaatgatgtggagagaatcttctaagaaatatatttgaggtttacgtcatgttgtcattgatcattctggctttatttattaaaagcaaaaccttttacacattattgctttctgtttaagaactttcctttgctacttatttattctgttgatgtattattaatgtcctagctgtctgttaaatatagactgttatgttattaatgctgttaaatatagacatattcgtatgaaaaggggaatatttagatacaaaattttataaaatacccaaatgccttaagaaattatcagacaaatctttgttttgttttgttttgctttgttttgtttggtgggtgagggacttgttttttcccactgatcagccccattcttgggattaagttatagggaaaataagttttgtttcattttattttattttttcactgtgcaaaccactatatattgcttgtatctatcagcttctggtcagatacattttgtctatggaaactttccaactcaaagtaatctttaactcacttaataatttttcacttgaattgtagttaatgtctttcctgttgttgcctcctgtaccagactacaagttacgtaagagcatgataaatgtttaattcaatcatagttttgacgaagtgttcaattaatatttgtttaactgacaattgttattttaataacaaatttattgactgtgtaaagtgttgtacttattgtttaatgattttttaaggtaactggaaaacataaaggcatgccaggaaattatgcctgatttattatttttccccccaaaatactcgtggcttgtgcatagtatatgttcaaaactgtttattaagttagctgaataatatgtaaatacatatatacatatatatacatatatacacatatatacatgtatacatttatatacatatatacacatatatacatatatacatttatatacatatatacacatacatatatacacatctacacatatatacacatatatacatatatacatttatatacatatatacatatatatatactttttttttttgagatcaagtctcactctcgcccaagctggagtgcagtggcgtgatctcggctcactgcaggcttctcctcccaggttcaagcaattcttctgcttcagccacccaagtagctgggattacaggcacctgccaccacacctggctaatttttgtatttttaggacagatggggtttcaccatgttggccgggctggtctcaaactcctgacctcaagtgatccacctgcctcgacctcccaaagtgctgggattacaggcatgagccactgtgcccggccttgaataatatttttaaagtagaattttctaacgtatcctttgtgctcatgttgaaaatttaactgctccacccacaagcaagcatggggaaatcaaacaatgttaaaaggctagtaatacttataggttttatgattcaatttactatgtgtttaaaattgttttttgaaaaaattgagttatgtcactaaaactgagtcaatacagctcaaaaatgaagaaatacgtatctccgataagcatattatgtgaatttcaacatcactattgagaaaaggaatataaatttgaatgaaaatgaaactctatctttctatatcacattgcataggtgtaggctagtgagtactttgatgtaaattgctgtatcttttgaggcatctatttggcaatatagatcagaattttaaatcagcatactttgtttgccagaaatctatcaggaccacttgtagtaattttgttaaaaggaatatcaaacacttggatgttcatcacagtattgattgtattagaggaaggaaagggagaaagggaggagaatggaagagagaaagggagggaggaagattggaagcaattgagatatgtgatagcatgggatttgctgaacacactataatataccatggcatggaaaagcatgcacacttaaaaaaggacaatgtggatggatctagctattgacatgagatgaaattaaatgaaaaaaaaaaagaatgtagattgaagaaacagtctgtattttaagatcctgttgtctttttgagtgtttcctatgtgatgtagccaactaaggatacagagatgaacacaagagcctttgtactaatggaacttactactatggagctgatagaggttattttacacctcaaagacatgacctggttctaacattatgagtctaagctggagaaggtttagtgtattgaccatactgaactgtgttggaaattggaaattcacctctgtgctggagtttccaatttgctcttctgttggagtttctaatcagctgtgaagaaatcatgggataatagtttagaaattcctacaagatgctgtggtagaaggtaaagatacaggagcacttctagacacttgagagcctctaccagttgtgaaggaaccctgctagtccagagctaatggtgcatgtatccttaaatattacaataggacattggtactactggcacacctataattgttttatgctgaaaaaatacatttcttatgctcttgtcactttctgtctatgacatatttgtttattataaatgtattattcttccaagtgtcatgttctctcatattatattactttttttctaattccatatctagaagtgataacacacaggtatttctgtgtcacatttctcacttaattcattcaaatgtttcaaatttttttattcccacttttttaaatgataggatgtggatgaagaggatactgtgccaaccaacctcgtgttattaactgtgtttctgtaatgaaggctataaaattgaagtgtaatttatgatatgatttttagataatggctataattattgttgtttttgagaaatgcagacatacgaaggagatagagaataagtaattatatatgagtgttaagtgcattttcagaattggagggcgatattctttattccttgttaagcctttggaaatcaaaagcatggttgtatcagttgtggctctgaatatttttatggttctgtcttttgcttgatcatgttggtccttttgagattcaaacatttataaaaattcataattttgtgcaaatattgaggacctaaaattgcaaagtctatataaaccaagagctgcttgctggttaggcagaaaccaaatttcctcctagctctgccttgcattttcaatcagaattacttgtttgttacaatatgattttcttcaaaaatagatgctctgaggcaaaaggcgagccacaggctatatgttgaatagaaggttgattagttggccgaacttcaggagtgggagcctgaagccatgcttcctagggaaataactccctctctgatagtttgttttgctaattactagtcccaatttgagctcaatattaccaacaattgctttatagttacttatgagtcaggttcaacattttatgctgattttacttgcacttaaacaaatagaaagtatattttctgaacacctctttttggtaaagcatgttgtatatttgataatttacaatttagtttgctgttttcttttgttctttgttgcttactttctgtgcttcaagtttattgaacttcaagtttattgagctagaacttatcacagatggtaaatgtggaaaatgtgatggatgtagaactcctcccacataggagtgaaatgggagactacttttgttttgtaattgatagtatgaagccttacatggactatcttcaatatgcattcattacatgatacattcctggtattaaattgtaatcgtcgagatagcactgctaaacgagatagcactgctaaagtttatgtctgtggtttactatttagtataattattcttagcttaataagctttctgtactattaaatgaaataatggaatctcagattaacatttctttaaaaaaattgtattcagcatattaccatacatttactgagactgaactgctttcttttcaattttcgtgaaacttaaatggcttccgtttttctgtgcagtaaattaaaggtgcttacacagttatgatagtttccaagaagaatttcaaattggcatcaactaattgcagtagcaagtgatccaggttttacaaggaaggaaaatgtgaaagaagcatgtctgagtataattttgttcctgataacaaatatatatatatatataactgtgattcaaaaatatatagtaaaattaccttccatcatccctagaagttattcaccttcattataactttataaccagtacataactagatgtgtgttttatggcaagaaaagtttataaaataatgacttttgctatggcattcttttaaaataacactaatgcattttatgaacctggtttttcacttaatcctctgttttatgcacttagagcttaaaagtcctgcagtaaatattatcatccttagctttccatatttttgttcaggaagaaagaaagttcattctacacttaattttaatgtcttcttgattctgggaacccataatttttttctcttttcttactgatgggagaagcctgcaccatcatggtttgctacttttataacttgtgagcaaacagaatatttatctctagtctcttaagtagagttttaaatccacttgcacagcttttaaaatattcccacctgccctctccaatttgtttttacttctttacattttgtacatttgaaaccgaaatttgccttatattccatgtgtaaataacagaaataatttttttctgaatattttaataagtgtaattcaattctggttagtttgcaacaccattgaacataatattactcacttctgcccacttttaaatacagacactttcactactcttacagaacagtaatctgttctctcatctcactgacagtggaacaagaaaaaaatttaagctacaatatgagagaagtaaagtgcataacccagttctataatagtatcattgctagaaagagcttgcaaagtgctgtgaattttttttctctagaaagttttccatttacccttttattttatccatccatccatccatccatcccagagaattttctcatggtctcagtgaattttttttatagtcctaaacaaagttaaataacaaaacttctgaggttctaacactatgatcttgacaatccaagtgaacaattatcagtaaatataacagaaaactctgccatttacagcacttcacattatcagattattaaaatgatctaaaattattcatttaaatgctagcagggaaataaatgactctaaattccctgcattactcacaaatactacaaaaaggaatgttccctggtttctgtggttagaaaatgtatagagcagagtatttcatctaaacctagagtcttctttttttatttggatttgccacttataacatgaatgattttgaaattcccatagcagaaagcttttcatcattgtctcactaagaaagacttgattctagtgccgaaaactgaagaactccttagggcataaagtcagagaacagcagcttattccagaccactcctctaaatattaatgaaacttacataaatcatacataacatatactatccctttgtgctggaaaatgccatgtttttatggttgtggttgtacagctaggataataggaaccaaagacataaaacagtaattaatatatttcagaagtgaagtgttttattggatagatgctaattaagactgatagatggcagtgattgaaataagcataagccatttggtcaacacaagtgaaagatcagctatcatcttgaatgctttaattaaggatgctttgctttttgtttcttcttccctactcttctgaatatatgaaaaaacatggagaaaaaataataataactgctttttgacagggaaactgatgtgtagtgcatgcctgatatggtttggctgtgtcctcactcaaatctcatctaaaattgcagttcccataatccccaagtctcatgggagggacctggtgggaggtaattgaatcataggagtggttaccctcatgctgctgttctcatgatagtgagtgaattctcatgagatctgatagttttataaggggcatttccctctttgcttggcacttctccttcccgccatcatgcgaagaagaacatgttttcttccccttccaccaggattataagtttcccaaggccttcccagccatgtggaactatgagtcaattaatcccctttcctttataaattgcccagtcttgggcagttctttataacaatatgagaatggactaatacagtaaattggtaccagtagagtggggcactgctgtaaagacaccgaaaaatgtggaagaaactttggaactgggtaacaggcagaggttggaacagtttggaaggctcagaagacaggaagatgtgggaaactttggaacttcctagagacttgttgaatggctttgagtaacatgctgatagtgatatggacaatgaagtccaggcttagctgatctcagatggagatgaggaacttgttgggaattggaataagggtgactcttgctgtgttttagcaaagagactggtggcatttgccccagccctagagatctgtggaactttgaccttgagagagatgatttagggtatctggtggaagaaatttctaagcagcaaagcattcaagaggtgacttgggtgttgttaaaagcattcagttttatgtagtcacaaagacatggtttggaattggcacttatgtttaaaagggaagagagcataaaagttcagaaaatttgcagcctgacaatgcaatacaaaaggaaaaccaattttctgaggggaaattcaagcctcctgcagaaatttgcataagtaacaaggaggcaaattttaattgctgagacaatggggaaaatgtctccagggtatgtcagaggccttcacagcagcccctccatcacaggcccagaggcctaggaagaaaaaatggtttcctgggctggacccagggccttgctgctttgtgcagtctcaagacttgctgacctgtgtttcagctgtggcttaaaggggccaacttagagctcaggctgttgcttcagagggtgcaagccccaagacttggtggcttccacgtggtgttgggcctgaaggttcacagaagtcaagaattgaggtttgggaacattggcctagattacagaggatgtgtggaaatgcatggatgttcaggcacatgttttctgcagtggttgagccctcattgagaacctctgctagggcaatgcagaagggaaatgtgcggtaggagcccccccacaaagagttccccaatgaggctgcctagtggagctgtgagaaaaaggccatcgtcctctagaccccagaatggtagatccactgacagcttgcaccagttgcctagaaaaactgcagacactcagtgccagaccatgaaggcagctgggagcagagctgtaccctgcaaaccacaggggtggagctgcccaaggccatgggagcccacctcttgcatcagcatgacctacttgtgacacatggagtcaaaagagatcatttcagagcattgatatttggctgccctagtggatttcggacttgcatggggcctgtaattttgttttggccaatttcttccattttgaacacgtgtatatacccaatggctacacctccattgtatctaggaagtaactagcttgcttttgattttacaggcttgtaggcagaagggacttgccttgtttcagatgagactttggacttggacttttgggttaatgctggataagacattggggaactgttgggaagtcatgattgtgttttgaaatgtgagggcatgagatttgggaggggtcagggcagaatgatatggtatggctatatccctgcccaaatctcattttgaattatacttcccataatcttcacatgtcctgggagggacccagtgggaggtaattgaatcatgggggcggttaccccaatgctgctgttctcatgatagtaagtgagttctcacaagatatctgatggctttataagcggcttttccctctttgcttgtcacttctccttcctggcatcatgtgaagaaggatatgttcgcttccccttcttccacaattgtaagtttcttgaggcctccccagccctgtgaaactttgagtcaattaaacctctgatctttataaattacccaatctcaggcgcttctgtatagcagcacaagaatggactaatacaataccctacagcctgaggaggaggtagataggtgctgaaaagttggattgacctgattccccatgaaattgcatcacactctgcaaacaaatacattagtgcctttgagggctctagaccctggctcacatcagctccatctttacgtgatatttgcgttaatcacagaagcagaacactatgttgtacagataagtgctacccacagttaaagactctatgcctagaaataaactctgaaaagttagaaactaaatatcaactccatctaaagaaatgcttattgtctctaaaatcatcttaaatgcaatcttaaaggaatgtccccagaatacagagtagtaaaaactaatgtttttttcatgtcttgtggcatagagaatatgaatcattgatatgttagtttctaactttaattttgcagccccctttatccatttggttacatttgtttaccttttgttgttcttaaatattatatactgctacaggtatattttatagaaagattcttccatttctgcggctaagattaaaataccttaaatgattagcctttaataaaactgtattgaccagatgaaacaaaaggacttattttttaaaccaaactaatgtctgattctaatgatacacaagtacttgttattcctgttatatacataacattcacaaataaggcaacaataaggtaagataggcaatgatcttttatgaaattatatgctaatatatataattatgttcttaatatgtaaaaacatgcaccaaatgttttaaataaatggaatacaaggataagcaaacagcatttcatattttcaaattctgatagctatcagatcttgcatagaattattttgattgtgcattgcattatttcttatttcaatgtcttagtcaaagactagaaaggacattaagtataaagcaagtatgattgaagtcctctgattcacagaatgttctaccctgagagtagaaaggctaataattctgctaaaacaataaaaaaggcaaatgcatcaaagagaagtgcttaggaagttcttgaagttagtattccttgtggctagagaagcaaagagtaaaaagacattgtcctttaaaaccctgtccttgttgcccaatcatagagatagtcaagctgtcaaagaccaaagcatatccaaggctggacatggaaatattcatgctgatttcagtaatagccttttatgaaattaattgagagatttacttttccagacactttcaaacaagctggactgtagtcaatgggtagcattgatatggcatagtggttggttttaaaaaaacaaaccaggctgggcacggtggctcacccttgtaatcccagcactttgggaggctaaagtgggcagatcacctgagttcaggagttcaagaccagcctggccaacatggtgaaaccccgtctctactaaaaatacaaaaattagccaggtttggtggcggaagcctgatttagggtatctggtggaagctacttgggagcttccagctacttgggaggctgaggcaggagaatcacttgaacccgggaggtggaagttgcagtgagctgggatcgcgccactgcactcgagcctgggtgacagagccagactccatctcaaaaaaaacaaaaacaaaaaaacctgactgtagcccattgaatgttctttgagaagaagcaattatatgattgtggctcattcattgtggcattatggcaaagccatagctcaaaaaaaaattccttatttacccatttactaaagataacaccaggttctgtcttcttagcaccagttaatgatgttctagttaatttgtaacttgcacagtatctgttcatgctattgctgccaaacatattgcagatcaaggagcctgttatgcaactgtgaataagaatcttaggccacttcacactgtttcatcttgtcaattgggagttttgtttggttcagcatgtgtgtgtgtatgtttttgtttttgtttttgttttgagacagggtcttactctgtctcccagactggaatgcagtgacaagataatggcttactgcagcctcaacctcccaggctcaagcaatcctctggttgagcctacgaagtagctggtaccacaggtgtgtaccaccatgcctggatatttttaaattagttttgtagagacaggggtttatctatgttgcccagactggtctcaaactcctggcctcatatgatctcttgtcctcagttccccaaagtgtggggattacaggagtgagccaccatgcctggccttaaattctgatggcttttaggcaaacaagtaatgtactatgtatatccctttttcaaaatgtattatgagttctgtagcttataattgcttcctgtgtgcatatatgctttgtggaggattggagaaaacatcagtataacaagcagttcacttgtttctcgaaatgctgtgctggtgaattagtcactctgttctactcttcaggttttttgtgtgtgtgtctgccattgaggagtataaaacttttttcaaagtcgtttacatttggctttggcaagggttttaattgttcattggagagtatctgtaacctgaaaattcttgagacacggtaaccacagagttaatatgtgactcacaaaaggctggaaactgcctactttttccatcctgtccctctcatcagttttgcttccactttattctgggagttaatttttatcaaccttcacacagaagtactatttgtttgttcatatatgcaagggaaattatttttattcctaaagcatttctccctcttaaaatcctggattagattaagcaaatatcccgtttatgtaaataaatcatttaattaagcagaataggtaaggatgtcagaaataataaaacagatgatttgtcagaaataaactgtagggcatatgatcctttgaagataattgaaaattcactatttaaaaatatgaattaaaaaatatatagaacttgatgagttacagttacatacattactatgctattcgtatttcggaaattgaaactcagaaacaaaagcagtgctctagtttgtcattccttatcagtgaagtgtggaatagtggaatcttcatggggaatttctgtaggcacgaaaaatctagaaaacaaaggctgtggaggaggctgcctcagtcattctaattgatgtcgtacagcaggactactcttgggtaacatctctgttgtgcccaaggttatggagattttcttgcagtcataggaagaagctcaggttatgatcaacctggggagaaatgattatactccttccttagatagcagagaagtttgaggtgtactagaagtgtggggttatttacacagtgagctaagagtagtgataagaaattttatgttcaggactgctttcttatcctattgaacgtcagtctcatcccccttagtgactttatagcttgctagctatcacattccatgttattccccttatgtctgttaatgtcatttccagtgctatccttctagcctatccctttttaaaaaatgtgtcttattctctgtcctggctcctggacactcatatcgcaatataggaaagcctaataggtagaaattcaaatcacagaaaagttcagaataaatgagctttatttgggtacaaaaggcaaaatagagatactgactttttttttttttttaacaaaaggtcaaattgcttcctttaaagagcatcctccattcacacctcagtaccactgatttctttccaacacagtgttcctggagcatttttaaatcattgagtgggttttgccataaagcttacatttgccacttgccttccacaggccagagctgcttttttaagcaggaaaggaaaaggacactgccacttcatatgacagaatcaagtaacttgtaaattggaatgcattttttttttggttcgcaatttccccaaattttaaataaatcagtgtgctccttccctttacataaatgatttttgtgagaaacaagaagctgttctaagaataacattcaaaatttctttaagaaaattcaaaccttgcttccaaaacaggcctatggtgagatcgtaccaaccattacaggataagattacaaagagaaaattatttttattccattctgaggggatgtctattaaagtagcgcataatttccagagcagttctcttgagattaactttttttttttaatggcaaaatgaagcaatgtaacataatgcaaatcacactaccattacaaaaaggaaattaaagttgggagaatctgtcaaaatattatgaaagttgaggagttaaagtttattgctttatttttagaatttgcaaaggtgttccactgcagaaatgcctctgggcatttgtaaaatgggagggacatgaaaagagcagtccctactcaaatggctgtgtgttaattgagctctttgccccgccccccttctcttttatcctgctccctccttaccctgaaatccctagtatttctagatccacagccagtttgtgtcttaatgggctttgtgatttcagaagtttccttcgacataagctcttcggcatactaattgtttctcatggagaaactatactgtgtttcattccaagcccttcttcactttactgtagagtttgcattaaagtttcagaaatacaatcaagctctctctacatttagggaaaggaaataaagcacttgcctcaattacatttgtcaacaatttccttttctgaatatgctatgacagagtttatgatattatagaattatgtttcccctttaacctttcagtcaaactgttgataccagtttctttaaaaaatatataattagtgctatcatccagttttttgtttgcttcgcctatggcatcagagaggaatgagttaatccatttgaaaaaattgttttaagttaagctgaagtttttttagccaccactttccttctctcccatgttgattactgaagccggattataattgatacattaaatgtaaaatattgaggcgataatatatagaacgtttatggttttagcagttggaggtttctggattgaatttgaatgcacaagcagagtttgagctaccgtgaccttgttactacctgcatttgtacaggaatccttcatgatctagattgacaagcagtgaatctctactttcaagttcaataagcctctcttttattgttttttaaaatacatatttaattttaaattttcctatagataacagagactccaattaattttacaagttattgctgctttctgagattataatagatgtgagctgttataagctaaaatgagccctcatatttaagtggattttgtaaatgagagcccagcatttctgtcatattcagttcttatggataaaatgaaagatcatacttttgcacagaaattaggtctgctctaggataatagtgcagtgattcagttccttctcaagtgttcagacttaataatattacctaggacagtatatgtatcttttcaatggatagaccaatgggtgtatttaagagaattttataggtcaatgaacgtacataagagaatacaacagacttacttattttttatataaatttaaggcctgggaacttcaagtacttaaaattcaaagctctgtccctagtgttttggaatttctctttactacctaaaatgttgcctttgatgtttcctgttggccaaggcagagagtgaaatgtaatataaagctttatatgaaaaattgtaataatatgtttaaggacacatttttgatgctagaactatgtggaattgatttctaaaagcattgggaatttcttcctaaaactcggagtaatgctttttgaaatattaccctgattcaccaacaaaacagcaattataatagaatacattgtaaagatttttaattttccgtttgtgttctcgtgtcctttggtggttaagtatttaaaatcccaactctgaagtgaaattgaaatgttcttaagaaatctgttgttacaaagtctagggtgggagagaataattacacatagctttttgataaacaatctaaattgtgcttcaaaggacagatgtggctttaataatctgaagcatttgcattttcagattaaactttgcttgattgcgttgtacttgatatgtatacttaaatctatatgttaaatgttatactttgatatagcacatcttgtttgactttgttcctatgatctgacaagcttcattatataataacctagtttaaataaatcttaaagacataaaagtgttcctgacagtaagaaaaaatttaaggcacacaaatgatgtatcggttagatgttccagagagagtcgaagttttttcattcaaatctttgaacatgtgttttgaataaagctgtaaggcattttccagtaaccagtgttgtattacaaaaatgagtaaagtaaaacaaaaggaaaacatgtttcaacattttattcagttttgtcacatattgttgcacatttcctactggaagtaaatgtgacatttgtaatgctaagttttcaaacctaaccttttctatgatataaaaaatgacatagaatattgtgcccttgtgagacaagcacaaataatgaactacactctcagacttcagacagtttcctaaatagtttgagtgcaatagtttgatgtaagtccatcattatagtttctgaattttctctactgaattctatccaggaataagcaacgataaacaggtcacagaacacttgatccaatggcctaccattgtataaaatcaaacagggaaataatatcactctagttatactgattgccagggtggacaaagcagttggataaaataatatttcagtgcaatgaaaagcaagaaatttacttaaaagtaggaaaatctgtgctctattactaggctttcactgttttatttattggaaattaattagctgactttgaaatgcaaaaaaaaatcaagacagctatttggtgattttgtttttttataataaacaacagctaagtactaactactaagaggtaagaatgtgaagcactgagcatgtgcaagcaatttcaatatttaaagtgggaattggggagagagatatttcacattaagctataaactactttgtaggaagatggatgtaatttatttcagtgttatattagttattttatattatatattttattaaaatactagctttgaaacaaatctaaaacatgtactttataagctgtggttaacactacatttctactaaggaaaggtgtgccctctgaaataaggaaaactgaaatttcatatgcaagctgggagcattctctttcaaaatattaatttattaaattatttttaaatttaaatttgttttaaaattaaaaattgttgaatacttgagagctgaaatcaatgaaatacttgaaataacctgctcctttagcaaagtagttatttcttcaatgagggtttccatgttgaccggtcatggatggatatttggtttcatacactcactgagtgtggtcagcagctgggcagactcccatgcaccactccatgaggtccccaaatctgacctctcaggttaggtatatttacatgaattctgtcattgttgtgtctaggaatttagacagacagaatttatgaggagagtggcaaaagacattgcattttatttcattctttctctgaggataaaataaatatctcagaaaagggtgaacatttcttttcttcagttttcaaattgcttatactaaatttaatttttatgtacaggctttgtttttaggagagcttatgttcagtacacctaagaggaatcgtagtcacggaataagtttccacctaagctctgtgacgtgattcatgattcattccctaccttgatagatttatgaatacttctaagtgaacctatctcagcagccaaatggaagtgttaatatcatgaatgcatttattcaaacactttttcagctctcacaaagttttgttataaagacgattttatttcctctcacagcaacatacagaaggagcagctgttattgcccttagtttacagatgagaaagttgagacttaaagccattaagaattttgtggtagcaaagaaggatcctgtatttggtaaatttgggtgtaattatgagtttaatgtatgcctttttggcagtatcctttctggcttcatcatgctatatccccattgtccacaacattgactggtgcttagtaaggtgctcaaggacgcatcaaatgaatgaacaaagactagagacagagttgcctggccttattctttaaatacccacactataggactgcaacaaaatacagagccctagtgattagaagacttcaaaagtgtgttttctttttccaggtgcatgcctttgatttcttgagatgatgaaaaaaaaaaaaaaaagagagagagagagagaaaagaaaaacaacaaaaacctctttattttgtaaagttttgtttgtggacctagaattgaataaaagccaacatttgtcctgcactcatgtgtcggatgtcctctaagcatcttacattcatgaatttgcttaatttgcaccattcaatgaggtagataccattgtcatctccattttatacattagaaagctaatatatgggggaggttaactggattgcccagggtcacaaaacagcaagagtggatccaagtaactactgcattagactgcccttcgctacactataaattctcagtctgttggtttaagctatcgtatgaagatgactagtcacaatgatttttctgccccagtaactgatagattgtctgcaaagatctcttcaccatctttcctgggcactggagttgcttgggagctatcttgttccttgagagccagttgttatcacccagggtattgttgagactttgagagtaagatcatatttcctcagaataccttcattatgaatttcattcatttctggccataagccttgctctgttgacacaagaatgatatacgttaaattttggttagtagctacctgttggaaagtagaaagatgaaaggtgttgaagataggtaaacaggaagcttccactcattggttctgggtttggtttgtttgtacttgtgttgtttgttctttttttaaggttggaatttgttagattttactttcgttatattatttttatttgtcttcaaaataattcccaattttaaaaatttaaggaaagtaaaatagaactggatgtataggcaatcaaagacagcctttaatcttagcttgaaacaaaaatagtctgatttttactcctagatgaggtttttagaaattagtttctcaatgtagaactcagaaagaaaacttcataatatgtttcaacttaaaaggcctttagaaaccaactaaattgaagaaatctgaggcacagaaatattaattgacttaagagatgccacaaacatagttagttcaggtgttcattagttcaagaaacctttatggaatgcctaccatggggaaggaaatttagttgttgctggggacacatgggtgaataagacagtttccacaagggattcagtgtctttagagggaaggcatctaagtaaacagataattataatgcaaactattgattgcttcaacaaaagaggtaattgatggtctatctatctatcatttgtctattacctctgtcaaatatctacctacttgtgtgggtatgtatgtatgtatgtatgtatgtatgtatgtatgtatgtatctgtctatctatctatctatctatctatccttgtctatttatctttccatctgtcatctatctacccttaaaacatacaaagcagttagcacagtgcctggtacacagagagttcttaataaataacatttgtatgatgactattattacctacaattcccagatttttcattatattgtatgacatgcagaggtgattctgccagactacttgttaaccttatcactgtcatgtttgtgagactgtgaaaccttgcgtgaagctctcaggcaaaactgttagtgactatgctattgtggggccttgtaaatacttctgtagctatagttacttggccatattttaattatttgtaacatagttgagcttgaactgtgagataaattcattctaatatgaggcattgtttcttattcatgagtatgcccaaagattagaatatagtatgtgatcaatacatggttggctgttgcttgaatgaatgcatgctacaaaggttttggcaaggaggaaagtttggttagtcgtccaaactacttcttagacgtttgattaaagaaaagcagttctgagtcttaattgaatcgcatggtcttggttataaggcttcactctaagaaaaaaacagttaagtttctagatcatgtcagtgactgcttttatgatttcacttcagatctgatgccactgtaatctagttgcaaaattttgccctaaaattattttattatttttgtaagtataattttcaatacatttattatctgaaaataaaaataaaatatttatctattattcaggggttttataaatcccaagattatataggaaaaaaaccctgattttttgttttaactccagagaaacttgatgttaggattcaaatatcaatcttaatctgatatatgggcttttcattaaactttaaataagctatcagatttttaatgtggggtgtgtgtgtgtgtgtgacttgatgtactgggtaaactaaaatactaacatttcagaaaaagaaaactttttcagtctgcaatctgggtaataaattttactgagcaggtgattgtgttacaggatggattatttgaaactcatttattaatatactgaacatttattgaacactatgtgtaagtcactattttggcacttgagatatatcagtaacaaaaaagagagagattcctccctaagcaatgtctttctggtaacttaatagtaagcctgaaaacaattaatctttaatgagcagttaatattgtccttgacaagaattcactagtgtgttatcgaagtatattattatatatgtattacatacataatttcatattacatatgtatcattttaaacaatgttattatgtgttgggccaaccttttggacaattttcctttactccactggtctacaaaaaagacttagatatccatttgtataactcaacattctggcaaaatccaagcttgagagacatgtggataacttcagtggtctgaatttgattatgttctacatatgggaaacaatcagagtaatgtatagggatttcatagtgtaactaactacattaaaagaaatgagaactctgcacacctaagcacatgttcacaatttaaaaattcaggcaggcagttccacttaaaagatcactaaatcagcagtctaatagtctttagggatcatcgttttattatctcactaactttctcatttaactttgtcattctacaaacctgaaaattactcaattttctcagcctcatgtgattctggtgatatccttcctgtttcaagagtggctcaaaacttaggtaaatgaggagctatcttagaaatatcaacaattggaacttcagaaaatgtaagatagtgcactgcaagctgtctttaaatatgacttggttaaaaaagaaaaggtaacatcattattattattattattattattattattatttgagacagagtcttgctctgttgcctgggctggagtgcagtggcgcgatctctgctcactgcaagctccgcctcccgggttcacaccattcttctgtagctgggatttacaggcacctgcctccatgccaagctaatttttttgtatttttagtagagacggggtttcaccgtgttagccaggatggtcttgatctcctgacctcgtgatctgcctgccttggcctcccaaagtgctgggattacaggcatgagccaccacgcctggctaagaaaaggtaacttttacaacctccaagacgtgaacaaaatttattttttttagttaaaagttattgtggatagttattttggaaagacaaaatagctatttaatcatatatgcaatgagtgattttttgaagtcttgatcttaagaatttcaaaatgtactgcagaatattaacttggatgcaaataaatgaaagctaattacaacaaatattttcagttttgttttcctattgaagcagaaagacacagaagaacacaattctgagccttctctatgaacacggcatgccccagtggtttattcatggaatacagtagcctgccatgctgattctgtgttctgtgttaatacatttccctggtgctggacgccatactagcaggtgctgcctacatgtttggtaaacaaatcattacacttgttctcagtcacatctgcttgattttcttaaaaggggattgttacatttaaagtatagcaaaattattcacagaatcatagcccattgagactaaaagggccatcagtaggatgcatccaaacctgtctttttacaaatgagacccacagaagtcgccctgaatgacaccacagctgctcgcaggacctggactttgtccatttgatttaattggtcacttcaaattgttattaattatatgattcagtatgtttatgtctattaagatgattaaaaggatggcatgtcctttaaacttgactaaatactcacttaagagagatttagattcatatataccataccccatttacaaaacagtttttctgagcagctcaatggtgcctctattttgggaacaccataaacaatctaagaacacaacctcctgtgagtcattctgttatctaccaaatcgtatccctcgggaatcccatctttgactgcccgcttccatttcctcacatgcagtcattggaagtcaggattgaaaaggaacttaaaagtcatatgcaagtgtcaaaatttctcttgaattcgacccccctccctcattttggccttttcattgtccctgcttagtcatcagaacctcatagacttcttaaagggactgcaatttttacttctccaatttatattccacacttcctgcagatgtctacacctaacacacagacagaatatccaactcaaaactcattaatttctctcctcacttaaagcagttaataccagctttcttgctgtgccagtcagcacacctgcccacccacctaggtgcccatcttactgttcctccagctctgccaatcactaaattcatcttgtcaccatttccacctttgtaaatgttgaattgggtccagcgttagtggtcgtttaggattttgtttttgttttgcttttttaacctttaaagtaaagctacctatattttttaatttattattttttattgtggtgaaatacacatcacataaaatgtaccattttaattttgaagtgtacaactcagtggtatgaaatacattcctaatgttgtgcaaccatcaccaccatccatctccagaactctgatcttctaaaactgaaactctgaacccattaaacaataactccccattccctcctcccttcagcacctgaaaaccacccttcttctctatctctatgattttgactactctaactacctcatataagtggaatcctatatacttgtctttctgtgactgccttatttcacttaacataatgatgtcctcaaggttcatccatgttgtagcgtatgttggatattttttcatttttaaggctgtataatattctattgtatgtatataccatattttgcttattcatctttggacagacaacgcttcctatactttttctaatcagtctaaattaaccacttctttttatcaaaactgtttttggtgcacaccacactttctttcgttgtggctctgataggataattatattttatgcattcttttttctaaaccacatcatttgaatggagcattttgtacctcacttgactataaacaaaaaatgttgtctaatttgttccctgccctgtccttagctcataggccctcaggaagcagttattaaatgagcaaattagttttctcattagtggaagctggattgcacagatttgaacaacacaattcttgaaaatatatatttctatatattttataattaggattttgctaagtcattctctttagcaaatttcttaataaattttgaaccccagatggtctaaaatggtgaggattttatcatatcaaaaaaagaagaagcatgcctatacatgttcctttatgtttttgggggggagtaaaatagaaaagccatatattttcttagtatttctttatgtatttctttatggtttgcttgtacataaatatactgagaaatagtccagaaatttttccaatgtacaagtcttaaggtgatctttgccaaagtgagtagttggtacaagatgttaaattcacttaatttctaaagtatatttattctgttacttaatccttgggtcctataatagtaacattatatcatgtaaaatcgatattatatatagaagatatatcttaaaagttagcaatattttatatgttaattttttagtgtacaattcaggttgcaggtcagagtaagaattgaggaaaaaaagcaatgtcaaatctgaatcatcaagaaagaaaggggctaaaaattccaaagcagtagggaacacccagagaatttaaagcaaataattcagggtcacgtaacatagaataggatgtatacagaggttcttgacacgttgcgtaatttacctaatttttacttctccactttatattccacacttcgttgcacaggatacctaatagaaaaaaactgcaattatttataaaaatactttatctatattttgtatgttgtataagaaagtattttcttcttttagaaagaagccatggccaggcaccgtggctcacacctatcacacctgtaatcccagcactttgggaggcctaggcgggcggatcatgaggtcaggagatcgagaccatcctggctaacacggtgaaaccctgtctctactaaaaatacaaaaaattagctgggcatagtggcgggcgcctgtagtcccagctacttgggaggctgaggcaggagaatggtgtgaacccaggaggtggagcttgcagtgagctgagatcacaccactgcactccagcctgggcgacagagcaagactccacaagactctgtctcaaaaaaaaaaaaaaaaagaaagaaagaaagaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttcatttgctctttaaatacaaacattggacactcatgcagaaccacagaaatcatgtagacaaactagaaattatcgtgcactcacaaattatagcttccattattaggtaatacatgctaaaccctagcaaacattaagtacgtgaactcctattactaaatagtaatcactcaagtaaactggacaaaatgtcttacggaggtacacatctcatgtgaaattaaaccatgttgcaggcagtgctacaacctgagattttacacagttatttacatttcttttgcctttgtggcaatatgtgcctgttaagataggctattagagaactgagcaatgagaacacttacaccttaaagtacaaggaaggtaatgtgacaatatcagcagatattttgcattatttagttagtaatgaatcctcaaactctttgaaaacacaaaggaacttgggcagcaagtgagggtgtttaatttaatcagaatatcacagaagtttataaaaagaaaaacaaaatccacatggtatctggaagcctaaggcttacagagacctcacatatatctctgtcaacaatctagtaatgaattactatgaaaaatttgaggaatgggaatacattttaaaagtttacagagttttaaaatgaaacctttgtaccatgaaaaatttacatttcatgcattgtaacaatttttggaaagcaggatcttttaatgtacttatattctgttatatagagctctttgttgaaagagctctatatttcaaaataattctatgaatttcatgaaaatgacataataaaatttaactcagcaggcttccaaccaatagagtgttataggatttacaaataattcaatccatcatatatagtgataataatatcactgttggctacatcagattgagattaatcaagcatcagtatctttggctcagaggaaaaaaattaagtaatagagcattctatcattgcagtagtgtgaatgctgatgaaagaaatagtggttcaaattctcttgtggaattaaatatgtcaaaacaacttatacatagtggagcttattttgcttaaaagccaaaaaacttgaaaagctttaaaagacaaacaatcatagcatggaagtacagtagtacaagtaggataattcaaaacattaccagaaaactatttgaattttcttaggctagcctatttgaatggctgtatccagggtgatactcaaaatacggtattgaatagccagcatggaggacactgatggccccaacaagacatactgtgaggtatgtctcaggctagcataaatgtgcacatacactgtaaaattgtggggtgtagggaggttaaaaagtagataagtagaccccactaccctataatttccagggcaccatcatagagttgccgacctggggatgaaactcaggcatttatctactttttgaaagcagccaagtggagactaataaataggagtgtggagaccactagattaaacaacctatttcagcttcactgaagttgaatgaccacatgaatacatttccttacaagtaaagttttctctcatccaaaggcttcaagtgtgtcaccgtgggcaagaccaaatgtatacaccacaacaaaattttatctgtgtcaacagcaatttgtacattttatatactctaattcatccaaatcaattgcctgattacagtttgggtactttagaagtggatagtcttataactggtgctgcagtagatgcatgactctttgaaggtgtttcggaaaccatgttcattttcatgagtttctctagtagttattgctgatagatttaagtggctttcccaggatgtcaagacaacaatgtgtttcacattttgagcttgttttcatctttatctgagacatgtgatgaactgtctgaaggcaggtggagaacaggtacactgagatatctacacatacatatgcaaacacacacatactcacatgtacacactcgtgcaaatgcatacacttctgttagcacattgagacatggattcactattgtggacagaattttgtttgcatgattgtgtacatatgtttgtcagtaaacgctcagctgactctatccaactttaggtttaaaaatattggagatgggctgggcgcggtggctcacacctgtaatcccagcactttgggaggccgaggagggcagatcacaaggtcagaagttcaagaccagcccggccaagatggtgaaaccccgtctctactaaaaatacaaaaggtagctggatgtggtggtgggcatctgtaatcccagctactctggaggctgaggcagagaattgcttgaacccaggaggcggaggttgcagtgagccgagatcgcgccactgtactccatcctgggcaacagagtgagaacccatctcaaaaaaaaaaaaattgaaagtggaggacaagcaaaattattttattactatactgtttcacaaatgctcactgagcttttttgattttgctctgtttgatattagcctaggttagttaaaaatctgtttccacattgatatatctagagcgttattaatggtgatgcgacattttatatgtcaggctcttgaaatgatttaggtaaaagagacattcgttttctcagtttcaactaaaatgataaattcttatgttacatctgtgctcgaggaaacaccactaatgtcatctcatttatataaatacttgtcaggtgactgcctaattttacaggcatctgagtcttatccaagcatcccaaggctgcggtacttggaagttcctttgtatttcagttaatggcatcaaacaagcctttgccccgctctacaacaaagcagtttgaacgttatcacatcaaagagaaagatgccattgtctgcaaactgtcttatatctgtcagaataaatcaattatgggacagaattaatttgacataccatttctttcaaacaagagacccccccatttccttctcagaaatgtaaatatataatacataatatatttttttttgtttggtgaaaagataccagtaaaatgataacatctggctgtagcaaaacgctgccagctaaggaatggtttcctctctgcgggtctgaccagagtctgatgttgtgcagatgtgcagccaggcttgactgtaaaagttataaacattgtcataacattgttcgacttctctagtatttcctgtcttctgcttagcactttattactaagtctggccagccgccaagtgaaatgcagggagttagggcctctggcttgaaatttaaaacaagtccagaattcattgggtttaatttgatatgcgaactctgataactcacacttgttaaaataaagccgcttaccattcaagttagatttacacagctttgagagaacataggagaagaaggggaaaacacatttttcaaaactttaatattggcctttagcgcttaagttttagaagtgggggttggggagggagtaggagtcggagtggggaacagctgattcagaagctggacagcttacagcaaacttgtgttcatttcctgtattagatgcaattccctgggcagagaatgggcctttctttcaacacttctgagcacgttctttctcttggctcattttcagattaggaaggccacatgaggctcattgcctatacatcataacaaaatggtgaggtgaaaacaaacgaacgataccccaccaggctgatttttctgcaaagggtatcttgtgccagggttgaacagaacgtcattgaagcaccagcataaagacatgttaacccaatttttcctgtaatgtatacatgattgattggcaatttttggaccacaggctgtggttaggattacatcaatcaggaagcagtaactcttgagggacttcccttaaatgatctagtgtttattggcgaaaggggttgcattttttgcagtctgtttctttcatgtgttcatcagttccattcctgtttgaaatttggtatcagtgcatgagataagtcacttttcttccttttatatccccttctgtcatttaaaatgcaagatgatgaacctagcacaatgtctggtacgtagaaaatactcattgaaaaaaaaaagagagaatgaatgttgaatgaatgaggaatgagtagtgaataagaatacatttgtgtgtatatagccacatttggattttccgatattcagaagtggtaggaacacagcatgccacacatttagctatagggcgccattcttttaagtagagcactgcacatctaatatagcaatcaacatgaatatacaggttttaccttctttgcattattatattatgtcacgtcatctttgtaaataacattaaaagtaaagatgtgaagaagaataggcaaggggaagaatttgccgaatgctaggagtccttgttcactctaaccacccttttgtacacttttggggtaacaggaaaaattttatctgtaatatgtgtaatatgtcatcagaattctgatggctctctttgttgttctgtgggttttcgtaatggtctcaaacatatataacttgttatgttcccaaaaggatgcattatggatctatgaaatttttgtaaggtgtgaacactaaaacgctgtcccaaggctctgctgttaatttgtttttattgaggaagaggcaagaatgaggcacatgtgtgtggaaccacttttcactgctggggtttttttcatgtatatgtggtgttcagggatgtatgggtgtcacatgagttacagttcctaaatctggggaagaaagaagttcctgacgcagaccttcccaggccacaagattctaaatttataaaaaggagaggtagaaaagaaaaccatgtggactgttactcccagttcagggttaaaagttttttttttttaaaaaaagagtcagcgcattagctagtgatttcgtttaagtggtcctcacaaaatcattggcgctttattgtattatctaatttttggaaatggaatgtaaggcatttgaaagttaaatagcgtgaagaatgaaaagcatgttcaaagcatttaagatggtcggtgaggcctgtgccattcagagcagctcctgcggacacagaaggactctgagtacggaccgtctaatctcattgggtttggaattcactttctggctccatatcacgatcagaacagatgtttcccaggctgcataggtgggtgcaagaaataaatttcagaaataacttacttaaatttttaatcaggtttttgtaagaaaactctggaatagtacttctcctaattctccgttacacacagcctcatggctctgcacaggatgtgactgtgtgtagttgcatcacgttcctatatactctaatttgtttatgcaagaaattccctcacttttttcctcttccaagtattttcctctgtgtgtgtatgtctgtgtgtgtgtgtgtgtgtgtgtgtgtgtgtgtgtgtgttaaatcacatattactttggcatctccaagagaaggcaacatgcattttaaagtgttatgtgtgaagctcaaagtatttcctgttatttgggaatgcttctgaccattatttctcttccagcagtctgatgggaacccagcattaattatgtatgccattattggactgatcaggttaaatagctagttggtgtttaccaatctcatttgaatattaaacaggcagataagaaaacctcaccttaatattatgctcttcatctctgtagattgttacaaaaggaatatgttgcagagaatatggagaagaaatcatgaaattttggtgtggggccaacagacctctagctagctgctggattagtaagaaagcagctttctgctgtcagaatcaacattactcagacagttgcagaagctctgaagcctttggatttgtttgcaatgagagatttgttgtggatttttaacaaggctcctgtgtgtgtgccatgcttagtaaatattggccttcagggtatttttcagtcacgctgaatggactgttagtttccccaaactgcaaagtgcagaaaatccatttccctgattttgttgccattgagattgcatcataggttttgcacagcaaaagcaaaataaaatctagcaaaaatctttttttttagagaactggaaaagtgatcaggaaaaagaaagatatctgtgattgcatatacaaatggacctagaatagagaagttcttaatagttaagttgtaacttaaaattatttcagctaaagtaactgaaatattttcctttctttataacagaggaaattagtcatattgtaataattgtgactaatataatcaaataatgaccttttcaaatattataataggttagatccttcttttaaatcaacaaatattatttttaaaaaggaaattcattagaaagtagaatatatgtggttccaagtgtttttcctacagcaaaggggtctgtattgacagttacgttgaatcaggattgcttgacattattaacaattaatatttaaaactcactttcaaaagatgatcgacgaagttttatatttggcctctaagaaggagtttcaggagacattatgattttgtcaagggcaaactaataacatcaaatatccaggagtcagagttttgttatagttgtttaatggtgatggtccgaaaaataaagttgtctagtagaattagtatgcttatactttttaagttattttagaaaatggtcagttcctatagaacatacttgaaatgagtgaccagcctctcaaagttgtgataaagtgagagatgaatgcatttcaagtgcattgtctatctcggaattagagacacctatttgaggatggagtttgggaacccttctgtggcctgcgtttttgaccaaaggcctaaagcatgaaagaatagccggaaagagagctcttttccatatgttgtccatttggctgtcagcactcgttctgacagaaaagaacagagtcttgagtgactgctagtctctcttaaagtatggtaatgaggctaattaggagagatgagagctgaactacatttgtgaaggcaattatccatatagcttttgtgccatgctgtatctttgtaagattcctcttctcgaattttgtcatttctcaaacatcacaagaataatgaaaatgtctaaaacaatacgagcaatgtggtcagtagaaaagaataaattactaatgaaattctgtgaacctgatgtctgtttgcagtcttcctgaacaaagatttggaggatggctaagataatactcacaagtgttgttgttgttgtttagtttacaaaaatgaaaattatttgcactttattatattgaatctatatatcttctttggtatgtgaacaggattttgcatggtccttttatgttagtcatcatggcaagtcagtaatttagtataattgaaaggaaaagacatcagaggcttactaagcaagcataaaatgtattctcttttatgtgatttagaaagttgagacattttcatttctattttcaaaggtttaatgcactttaactttcacaacagttatgaaagtaaaagaatggacctagatctctgtacagtgatttcatagtaggtgacactgaacataagttttgggtttttttaagtatttaatcacaaaagttaacagttaaaatacttgtattttttaatctgctgaattatttttgaatggtattgctgacatttcatattatatatatataaaaatatgacattctaaaagcatcaaactctttctaaagtgtaactgaagttttttcctccaaaaagaaactaggctgatttaattcaataggaataccaactggatttggttggtaattgtttgtactcacatttacatctggacataatgttttattgtttttaagtctattataacttttatatcttatatcttttgctcaaaagctcattagcctataagcttctaaaacacataaaggagataatttttatttttgttttgtaggattaaagaaaaaatcaaattaagtgacacataggtggaaaatctgtctgaattgcttaacagtgttcttacatatgaaattttattacttttaaatacattcagtagcaaatttgagcaactccgctttgtctcttgtttcaatcacatgactaagctcctttggagcaaggatagggcaaaggtatagtcagtagctttgataaagaagatgtagcagaacccagaaggccatagtacagctggagctaaaagactggaagtgactctcaaacttgagcatgtctgagactcactacaggagaccctgctaaaaatggctaaaaatacaggttcctggaacttataactatagtgattctgattcaccgggtcttggagtagggcaaaagaaacatatttgtaaacaagtactcctgggttattctgatgagggtggcatatgggtcaccctcacctttgaaaaacagtattgtagaccaggaaatgtgtcatcccaaatatcatcatattagaacaaggctaagcactgaaaactgctaaggagactcaactagaaacataaaaagacgtcagaatagagcagaaaggaagtctgaattggtgactccaattgaataatgcccaatgtataagtcagtctgtcagattttgtaatccccataacttttctgggttcatgattgttatctataaattctttagctctaacattcgaggattctagaatagccatggatagagcgagaatgcatggtagactgtaatcaggaagatgtgcctatcagggatggaaaaatacaagtgatcagaaaccaggccaagagtggagaactaagaattttagaggaacaacaagcaggaaactaaattgatgcaagattcttgctcctaactgaagcagccttctgcctcaggcccaggtcacttttggtggttgttttgaaacaggaaccaatctcaatactagacaaggtcctgcaggtggaagcaggtaattggaagcagctggtgcaggtgaaaagtgtgagatcaggggaagaaacagtttttgggttggttttttttttttttgtctgacaggaaaaaaaaatatttttttgatggtggaagcgaagagtaataaatagaagtaatacatacacagcacattcctttttatgtagatgatgtttcaaaaagcttgaaaacacttatctgagtgttttaaatgtttctgctggaaacatccttacattttgaatgaactctacaaagaaacactttgcaaagtcaaaacaaacagcagtccatatagccgtacctgccttatcatgaaatctaaatgtgtgcaagccaaaatggtgcatttcacagtccttttatccaaactcagacttaaaaagtgatcagtgttcgaaagggggaaaaaagagttatacaggaaagaattgaatttactgggaaaaaaacttcataataaatatattcatcatatatttaagtatacttctataaatgtgtcctgcagaaattttgacgggcgtgttacattttatgttaaaacccttatgcattgatatttataggtaagtttttttacattgctgtgacagtacaacaataaggtattaccttagtaatttttcgttgcctactctatctcaccttctgcgattttagccttttattaaagccatgtcttgaaagaaaatgaaagaaaattgtcttcaagttagtgtgcctgtttttcttaaatttatatattgagtcatttaattcttctcattttgttagtgaacaaagtttttttaggcaattaagagtcatagtttcctgcctctccgaatttgcgatctcatacagtaacaaacacttgttttacctcattgactcttttgtttcctcaagtgaaagaggaattggggtataatttagttttaacatctctggaccaacttaaaaaggaatgtaactcaagatgtatggtaagaatagtgaaattcttcaacagaactcactaaagaaaggttttggggatgttgcagaaaatgataagtaggaagacagcataaaaggtttagctgacgaggtaggcttggaaagcatagtagacataaagcaagttgcctgaagcttcttaagaagaagccctggaaacaaaattgtagcatataaagtttcatggaacgtggagtcttgagctgagctgtgaagtttacacaggtttctgacagttgagaggaggggagagaagaatgtatgaagtgcactgagctgggagtgtatgaggtctgtttgagggaacttagaataaactagtttgactgggagggttcagagaagggtgatgggtaattgaggaatctaggttatgaagagccttatgaatgtggcacaaaggattttggaatttatccactgagttgtgaaaagatgaaagttataaacgaagacatgatataattaaggttgtcttcagaaatttaacctagaaatgatatcattggtggattggaaaacaaagacacaagtgcaaggagctatcccctcatagaaggaaaacctcaatactagaaacaatctacaggacttggtgactaattggatatggtggaggaagttggtgccaatttcaggatggtggagtcacactgaatgatgaaaaggggaagaaaatcatctttgttggaaaataccatttaaaaaaattgttgagttttgagatgatgagacacaattcattttattaattgaggactgatgatttgaaagacatactggggagactcccccaaaaaagggtgctctttgccctctagaagctcataggttagtgggagatatagtcaagtttataaacattgtagaaaaaggtatactttgaaaatgttagaactaccaataaaatgaaatgaacagattgaagacagacagagatatcttgaggagctaaaagaagtactttgacctggacctaaaaagatggataggaagaacgtacatcagttggattcactcttcatttatttatttaacgaaaatgtattgagcacctgttctattgtatgtaccatgttggacaccagacatgatggtaagaaatcacattccttatcagagcacctgttctattgtatgtaccatgttggacaccagacatgatggtaagaaatcacattccttatcagagcacctgttctattgtatgtaccatgttggacaccagacatgatggtaagaaatcacattccttataaaaactggcaagtacacagtctttgtagctggcatgtgatcccatgtagagggatcaaaggggtaaggatgggggaccttagtggaagataagatgctaatgataaactacatggcgaaggagtgagagccctaggttgcttttctctaaataatggggatctttaaatgtttggggagaggtgagatcttcattttagatctatattgaatacattgtaaatctatgtttttagaaaggtgacaaaatactcaagttgaagtatttgtttatagatatattagacactgagatacattttatatgctcatccaaatgttggtgtcagccagtcacaggaggtgtgggattgctgagtttgagtttgaggaaaggatggatttctgaaatggaacgatcataaccaatatttattgagtacttaatgttatccaatcactgaattaattcctttagtcctcaccccagcctgctaggtggatgtcattattatatgcttatacagatgaagacattgcattgaggagagtctaatcaacctgcccaaggtcacatggctagttagtgtcataggcaggatttgaacccagaccagcaggctccactacctccagactaccaaggcagtaaagacagaaaggcttaggataattaatatcaaaggacttgaaggttattttagcaaaattaatgctgatgagaaccgagcagattgtgcaaatgtcaaggccaagaggtttgtggagtgaggaatacaccttctaaaggaggcagtcacaggcacctcagctatgtcttgccatgtgagaaaatgaacctagtaatatgagacattataactgtcaacaaaacctagaaagtatagatttttatgtcaaatcacccacttcttttcttttcaaggagacagtctcactctgtcacccaggctggagtgcagtggcatgatgtcagctcactgcagcctttgccttctgggttcaagcgattgtcctgcctcagcctcccaagtagctgggactacaggaatatgccaccacgtccagctatttttttttcctttttctttttttttgagatggagtctcgctctgtcacacaggctggagtgcagtggcaagatctcggctcgctgcaagctccgcctcccaagttcacgccattctcctgcctcagcctctctggcagctgggactacaggcgcccgccaccacgtccggctaattttttttgtattttttttagtagagatgggttttcaccgtgttagccaggatgatctcgatctcctgacgtcgtgatccacccgccccagtctcccaaagtgctgggattaccggcgtgagccaccgcgcctggccttttttttttagtagagacagggtttcaccatgttggtcaggctggtctcaaactcctgacttcaaatgatccgcccgcctcagcatcccaaagtgctggaattacaggcgtgagcccctgcgcccagtcaaatcacccaatttttaaatgttgataacttaaattctcattttgcactatgctgtgtaaccccttccttcccccaaacacacacatgcacacacacatacacacacacacacacacacacacacacacgcaccatacttggatgcttgctacccagatatggacctctgttcgccagcaagaagaaagtatgtatgtacattatatatgtattagtgcagccccctatttattgccatagacagaattagagaattttccaaagtagtatcaacctcactgcagtttccaattttaggtgacaattcatgcttacctttcttccatattcctgcaagcaaaaatagaaaattaaatgtattttttccttcagaaaatcagtgggtaaaagtgtttgttgtggcccacactgtgtcatgtacttagagaagttggctgtttctataataccagcgaatctatatatgacattcaaagtccattctccaaggactcctaaatatctacatgcactacatcatgtagactaaataatgaactttacaacaataatttttactcagttttacccagaaaagctaaagtatcagggatccaacattcttaagctttgtgaaccatggtgagaaacccctgtatttgtgaagaagttttgtaataataaaaaactataaagttatgctggtgcttcaaagggaataacatcaaaaacttgtggagaaaagccagaggctaccatcccacctccaacctgcacacacacacacacacacacacacacacactctctctctctctctctctctctctctcactctcaattgggagacctatcatggtagaataaagtctggttcaccaaaaaagagggataatgaggccatttttcattattttcccagtggattctaaaatagttacctcataaaataaatagtttaagtttccacattactttttgcctttaatctgtgcctgcgatgcaaataaatgagtggagatttttatactcccaaaggtttatgtagaggcaaatatattacaaaatgaacacctaaactaagcatgatttcttactaaaacagcatcttacagaatgctgtggttgacggaagggagacactttaggaaaaggaatctacaaaaagatttaattttatactcattgttcaagtatatgctactcttcccgatcttgtcttctctagattaaatttaaatggaaaactttcagaactgaactgagcctagccaagtacagaaatatgtatttcgtatgtgagctcctatggaaaggatgcaccaaaactgtttttgatgtgagtagagtaaggtgttaagagcgccgtaagttttataaaattaaaaacccatgtgctaaaactagaaatagtttattgtccttgtttaagaggcaactgaattaacctagttatctggctaataaacataaatagtccaccttagtgaagctctaattacagcctctgaacctttcggtgtatttacaacttaaaacatctgagtgattctgccttttgaaagctatgtgaagttagaaaggcggcctaattaaaacaaatcttgaataaaccacttcatggagatagaagtttgatggttggatatatcaaaaattgttaccagatgttgttcagaggccttaacagtttaaagatcatgaggtttttttttagcaaagcaaaaatattctaattgaagttgtcagcaggagtgagactaatatgcctgtatttgattaaataatagtttatttaacattcagtgtggcccaaaattggccaaaagtcggaaaacattttagccagcagacttcaaaagaaaaacgcaacaaaatgacagtactatctaggtaactttcaggcattgtggtttgataatgtcagttttcatcctgcttcccattcttcatgtcttactgtatatactctgcaaatgcctttgaatctttattctgtaatgtattttgtattttataaaaagaaaggagagcaacacaaacttattataagacttattgctgaaaccttggcaaggaaacaccaggacattttccattatagaaatgtaaacatctatatttttaggagttagatattttacagaggctgctgtcctttcactgggacatgaggatattagctgtatcaaaaagaagaatgtaagacccacatggtcctgttacaacttacaggcaccttttcctgatgacatgagaggagcacataactacttccttcccattcagtgtacagctgtgtgctgctctcagatgaaatgcaagaattccctttgaagaacagggaggcttgtctcagccagtcggtcttcctattggcgtgagcctctctctccttacattttctacttctcaggcatgcacctagccattaactcccgaatgatgtggcaataccttggttcttccagaataagtttttcagacttttcttggacttggtgtacgtaaaaatttaagaaatcgcccacatagatgactaggaaataaatgcattttaaaaaatgaattttcatcattgtgaccaattcccaagctagcgtttgctttccgtagtacacagaggtctggatttttaaactaaattgcagcaaactctgtggcaattatgagaggacaactgcactagagggccattaatcatttaaacattcaaataaaactcaatgtttctttttagatctaaagtgcagcccataacacaattgaaataacattaatagaagaagggaatgaaaagacagaaaacagctgttgctgtctctgcaatgtgccatgggctctaatcagagagtgagacactgtatacagtaaaggagaggattcttgttgattcaattcattttctaccatcctgagctttctcggtttaaaggaagttagggtgatgttcttgcatgtcataacactgcatttctggatattcagcagaagggacaaacggctggaaggtttagttttacagctgttccagaacagtatttaaaagttgcttgttagctgcaaagtgctaataataatgtaaacagggtacaaaatgtcccctgtggctaatgaggaaaaactgtgctctttaaatgtaactttttcactattaaaataaattttagttttaccagtgatttactttaaaaataaactttgtaaaaacctgaagaacattacatagttaaccacatttgtcctagaggatagtatggaaaataacttacagcctggttgaaaaactaatgacttcataatgactttgctttatttgtctctgccatgtccactagctcaatgtctgtccatgtaatcctcttttaaatcccttgactttgtaacatgatttttacttccatgtcagtttcacaagctctaactgttatccttttagcatcactgtaaacgacagtgcagagatcataccgccccttttctaaagcaggtgtaaataaatgaaagaaagaatcaattagcttgttctagtcaaaaaatagtcccaggtaggaccacactagagtgtaggtctctaaactcccagccccactgcacttctcactgtgctatgccaggaagtgaaaatcacagcaaatcactatcttgtaagaattaccgccactaccccatgtcccagggatagaacaggtgagtagactccacactggtttatagaaaaatgcatgactgaagccagcaaggtcctcgtcatctatgatcctcaggtgctttattttcgcagcctagcaaaaggaataaatctaatgcttgctttactgtgaatttacaattttccttagaatttcagtgtatagtgactggaacttaggcagtctgtaaatgataaatggaaaaagaatgaaacaaagcagaaaaggggaatggaacaagggagggagagggagaaggaaggcaggaggggcagggagagggagggaggcagaaaatgtaaatctcaaagccgatgaggttactatagaccatctggagaaagatgaattattctttaaatcctagatctagaagagatattagagatcatttgttgtttatgctctctgatttccccctccctgtatctaaatatataaagaaagaaggaggaaactaggttactgaacaccaaccatgtgactggcagaggtagaggcattctatgtgcttcatattcatgacccttcatcatgattgaccagttgctcttcttttattttcctctgaagcagaacctagaaaatgactttattagagcacctatcaggtctttgcttatgtggcttccctgataattgctgagcaacttgagaccttgggtcatgtcttttaccattgtgtgcctagttatgccttttacaggtagagcatccaacatggtgctgggcccagggcagatactcaatgaatggcatttaaaatgaatgaaagaatacatgaattacaggtaaatatcacagggttgtctcatttagtgtgccatggccttgatgcttatgcagtcctgtgcctataaaactatatggtactaggtttacatgctttagggagtaagtgaaccttgcagtttcctatttttttaaatttgactcttgtgtatgtgttgatggtattgacttgctttcatttaaatgtagaaaaaaaatgccatgttttggtattttagccttaataacctcataaaacacatatgagattcgcttgctagattataagatgcctttggtttatagaggaaaataaaactcctggcttttcttttctggagaaagaatatagaaagtagtctcacgatctctatgactccgacctgtatcccagacaaaccaaaacaggagtacaccaactccttaaggatgtgaagacagcaagagttgacattaatagtaaatttaatatttacaataaatatgagatagggctagacatagtactggaaatggtacctttcccctgcccccccaatcctatttagctacttcatataaaagatggcaaaaacttccttcttgttcgtgtagacattcagcctttctagaagacaaggatgacacttttgtcaattatttattttttgacgtatgtgccaatgggaacaattattagcctattaaatactttttgatatttgacccaggatagtaaatacatgcattcagaaaagaatccaatgctacctttgtcatcattgtgacaactgaagagctctagtggcctttcaagtacagataaactttcaggaggattctcctatgagctggccacaagggcttttattgtgaaccttccagcatatcctgtatgctcattgtgaactaaggaaatggcagtgatggcatctcaaatagtggaccatggcacccgtcatgggggtatccctgctttttgtgcccattaaaggtttgccaagttcttctaaacagactcttcagcagtatagtgaccattatactacttcctcatagtgtggcttttgtaaaaaactaaaagaaaatgtcctggattgattttgtcaaaacagttacatgagaagtgtagataatgatggactctttcaaggattattcaaaccaaagtaaatactagatggcacggatggactactcaaatgtggtcagcagtactatccaatgctctacttataaaagactcctcttttggacagataacttgtagaagactgaaaagaaatatgtatacgtctgtatctatgaaatgtattgactttttttttattttttactgctttacttctggtaccattcctttattttgtcttaagaatctacaccccttcatttttagttcatctagttcaggtgaagctgattttgccctagattcaaagccaaattgtgtgccttacattcttgttactcaaactgggagcttactagacatgccagatctgagatcctatcccagatcaataaataaaaatctgcattttgacaagatcccagggtaatttgtaacacagatgagagtttgagaaacttagccaagtgcagtggtacacgcccatagtccagctactcaggaagctgaggcaggaggatctcttgagaccaggagttcaaggctagcctgggcagcacagaagactcctgtctctaaaacaataataataagttttagaaactgctgtacaccagagccagtgtgggaattctattcacctggccatggtggggcagggacatgacccaagtttgcccaacaagaccctatttgaggacattggtttgacctctcaagaaagtgcacttagtattttccacgtgacttgtttaaaagagcataaaatactagatatgtggccattttaccatccgggcctgtctgactgagactggggtctgtgtagaggaagcatactccagaggaagaaaaatggtgctctcagggtatcacttgaatcccggccaaaatatgcctaaagtcagagtttttcccagattttcagttgcatgagtcagaagatttccttcatagtcatacaatgtgagttgtattttctgccacacacaactgaagaaaaataaaagatagagttatgagtaatgattaaaggcttatttgagtctcaccacctatttgcatgggctccttagctgaatgtgtgtgtgtgtgtgtgtgtgtgtgtgtgtgtgtgtgtgtgtgtgatttctcatttgttgtagcatttagaagtataagaatcaaaaaaaatcctagtatcgagacatgtctgctttcttgcatcgttctcttaattgcttcatgtatatttaccttacttcccctcaaaattataaacacttcaaaggcactggacttttcttccatgaggcgataatttaaagtaataagacgtttataaataaacataccagaacttatatcaagtgagtgtagattttcaaaaccaccacctgaggaagctgctaatttattctggttttgctgactttggaaagaacattgtagtaactctctagaataatgatcagcactagtttctaagccctgagatcacaccagtgctttgttagttacatctgatttttacttaaagtgacactacagggaatcaattgaacccagtcagatcacttcaattcccatgaaccagcccaccgtgagtcccctatggatcctgccagccccgagtaccccacctcttccctgaggacctcgtgggaactgctgccatccagcagtaaagggatagcatgtgcctcatggggagtctttagaatcctcttccttcactgcagccagcactggttctgatttcgatcagtcactcatgccatattaatggttatgtatttcattatcacccttgggtgctaccaaggttgttctgccaccttattcatcaacattactctgattaagtttgcctctttccagaaatgcgattgacatccaggaaagtagatcttctattactgtgagaacttcagtagctagctagatagataggtcaataaattgattgatggagaatataataactattttgaatataaaccactgagaagctttagaagtagaaacataagtataaactcggaggccttgtcatctttgtttaatagaaactgattagcacttgtattaaatgctgttaatagatcaataatttataataaataagtaaataagagcacatttcttatgttcttcgatgtgttatagtgatgaaaggttttggattttgtgggaagcagactcttttcctaagagagaagaggaggcagagtttataagtaaggtagtaaatccctaaaggataaaactcttccttattgattaaatatcaggcatttgggttataagtttattcctttcctgtctgctacctttaaaagccaagaacatttcgacaggttataagcattcaaagaaatagaggggcagagaatgctatgcatttgttgctacggaaaatctaaatcaacttagaaggcagctaaaagaaaccaatgtttatggctaggaccaaaatgcattttaactgtaattccaagggcgaatcacaccaatattgccaagttaaaaatgactatttctctaataaaaggaattccaatcatttaaaccatgaactcaattatattttctgaatattgattttaatcaattttatgaaccttaagtgataaaggtaactttttataaaatgtaaggatattgctgttgttacagtaatttggtatgaatgatgctgttagactattaaagtaaaacctctttgctaatattcagggattatgttacaataacatattgcatagcacaataaagttaatagcatggatcaacttccagaagtctctctgttttaaatgaatattgttttcagaatgtatttgttttgaaatatgaatttcagatctataaatataaggccaagtattttaataattgttattatatctcagactaccaatagatgttacattctacgtaaaatatttgtctaacttttgtattaagtcaaaccatttgtaatcacctatgtaaaatacatgtttatgtatatacatacacacaaaggtaagtctgaatggatatccctgggcttaattatcatgcagcgtatgggccttttgcatattcacttattaacagcagtagaaagcttagtgtgatacaataatcatttttaaataatcctaaatctactcagggtgaaaagattctgacagcaggcgctttaaacagctgccctgagcaaaatagacactgctttcttttaaagttgaaaaggagaaaggtaacaattatcccagagacactggaaacaaagttgtctgatttttccccggcaaatgcctccacctcttgtaaaaagaacagtgtatttgagatgttggaaaatggtggacccatcagaagcagtcatcagataaacagataattaatgtattaagagtgtaattgaaattaacaatggctttcatatgtacgtttagtactgtgctacaatttattacttgtctgaagtactttcttgcattataagtcaagaagccttgtggagccaaagtaggataataacaattaaacataactacctctacaagattaaacttgatactgaattgagtagcggtagaaatcatgacttaaacatttgttttctccctttgtacttcatttataaattcagtactgcttttaccattaagagagaattctgaataaaaccataattcagattaaatcaaactaaatattatttagttgcaatactaaatattatctatttatctaaagatatttttaggatatattaaaattcccaatatgcctgcaagtttttgtgttctgtaagaaacttagagaatttttcccttgaaattgactatcttaatcctgatttatgttttttttcaaaagtaaaaacctggaaagggccttactaacaggccgaacattttgcagtttccaatgggtatataatggcatccactctgtgattgggagtttaaaaatcagaacattcaaatattctgatcccgattgctttcccatttgaataatcgtacctctttatattaacaaactttatggtgatattttcaaattctttctatatcacttcttaactggccacaaatgtttgtaatacttgagtgtcttctctgagtttcaaaatgacttgctcagataggaactcacattatttttccatttctgattcctcccttcccccacttttaccaaagaatacacatgcgttagtaaattcagcctattttcatcattaagaaaaaaaaaaagtcaagttcaagaaagaatagcacagctgttcacaatgtcatatcttataaaacaaatctattaggaaggtcaaatcctgaaagaggtcaagttaatgagataagtggagtaatttggtcattttctgaaatttgtaaacttacacaaatctatttttttatcctgcactacatttttatcctgcactagattgactaactaaacctctgctaatggtgattttctacttctttaaaagttattacttttatatagcaggcacacttttctgtacctaaatgtttttaatgtgaattgagttcaatgttagtttgatactaatcagtccattctgtttatttttgaattactgctttcatttggaatgcatttaaaaaataaattttaaaaaatacaaatataaataaaaattatatgtctgtattcacacacacattttgtgtatgtgtgtatatgtacacaagttaattaaataaaattgtggacttttaaataaaattatagatcaaataaattgtagacaattggtggaaagaggatggcctatgtcagatctagccacctaacatttctttcagagagtacaaacattttgaagcatgtagtatctgcacgtgttttaaaattatgcataaattaattcttcgttaaatcctactgctgggtccttaagtgtcattaatttactgattctgccattatatttttatatttattttatttacagaaaaaattatctaagtcagatataactccttatcttgggagagaagtatgacttccatttttttcaagttgacattttaaaagataagagcattagcctctgaattttttaaatatattaaactagaggaccttgaagctactttttttgaaaagctaaggaatatatgtgtatatgcctatacatattataaatgtatgtttgtgtgtgtattaactataaatgcatgcatatatatttataaagtagccaatgttagtcaaattccaaatggaataaaatttatggatataaatgtgcagctaccacccaaaatttgctcaaaattagcaaagtttctatgtctgggtctgtataaacccaagtgagtcaactttatttataatctaggaatcaaatatctatttttatattttgtgcgtgtaatctatgtggctacactatatgaaagaagaaagctacctgcagctagaaataagtaataaaacatgcatgagggaatgtgatctacaatgtgttcctttatgttctagaaaggaccctgatttccttcctcaaatttcaacttagtttgtgtgtgagaaatatgtatctttaaaatggaggaagtcaccaccagagttatgtaatgtaatccttaaagatcttttagaatgcagtcaaaaggagagaataggaaagaaagagaggagagatgtattcatatatttttaaatgtgtcattgatgtaataaactctttaaaagacagtttcttatataagggagttttagggtcaccattaatacattttctcatgttgtaaaaataaatatgaggcgctttgtataagttttgtgcatatgcacattaacatagatattgagttatacacttgtatataagtgccaaaagtgtattcagttttcaatatctttaaaatctaatgtctattgaattattcaatctcttctgaaattaagagagaaagaaaaaatttaatgatctctgaatgcctcatatatgtcaaacatgacattccatagtctcacatacatcattatgtttatgttaactgagtatgtatgtgaattgagagaactccaacatagtaataaaaataagttggcaataaaaattaatcataagttatcagtgtcttattttcctcctactaaagtaaataattataaggctgacatttacagcattctcctaggtactctattgcttcatttttttttcagttttttaatataaaattaacatataaccaattatatttattctccactatgtaagaaactcatggaatttcttgacaacattgttggtgttttaatcccacttataaaatatgatattgctttaatgaaaataaagacaactagtgatgtctcactacatggtagtgctgaaaatgattccattcatttacgtgagtgtatgtatgtatatatgtttgtatgtacatgtatatacataaccaacgtatgccatttctacacattttgcaaattgctcattagctcagacaagcagggactgttcctttcctctcctctcctgggcctaaacatggcccagaatttattaattttcttttgcatttcacaaaagtgaaactgttttcaatctaagttctagtttctgtaacaatggctgtccttcatatttcatgaataaaggtatgcttaaagcataatgcttgtatgtgtacacacacacacacacacacactccaaagtggcagtagcatctcttctgctagaggtcaattcaattaagctatcactaattaaatgcccactatatgcaaagcactgataatataaagattaaaggaaaaagtaggtccttcttcaagagcctcctttcccctgtgtgacttgcacatgaaaataattggaatccagcagtctgtctcctatacctatacagagaaagtaggactattttgtgatttaagacaattcaagatatgaaaagccgaggcaaaactaacattcgaatgctccaacagttaagtttgtaccttgtcacaaagttcctcttatgatgaagagtagttttgatacatttggggtaaatttgtaaatgtgaaatagcaaagggtaagtcacaactaagcatttttgtttgcttttcattttttgtatgtgttttaaatttcagctacactatgaatcctttttcaaaatatctttaagagcttggtaatttttttcttttcctttaaaaaatctatattacttcacaatagggagaaatgacatttctttaacacagatcactttaaaaaataattgtgggtaatttcttgctataatttatttacgtcttttgccgagattgtgtgaccaattcagtgtgttcatctagaggaaaaataatgccaacagaaaaagaatataaacataaggcaggggaaaataaagttgttgaaaagttagtgttatattttcagagcccttctcatgaaataaaatctcactcaccaggagttttgtgtctcaagttgggctgccaggtctcggttttggtttcctgatattctgctcgatgtacaaaatgtcaaagtgagaaacagctttaactgttccttttggtacggatgactgaggggcactctccagaatgcttgatgcgatgaggtagttcttactttggtatgcgatatagtgtgattaataaactccagatcacagagagagccgggtgcgagtaaggctcgtatgagtgcagtttcctacccaagacaatgtattaccttgagctaatctggtggtactgaagagagaatttttacgtatgtatacataacaaagacaatcactgctttcttcttgagcagctgcagccagtcccactaatggacgtgcaaaagcaaaaactggcagcataaggtatgtgttcgtttttacagatggtactgcagacaagttggtaattgaaaaggaagtcgtgtacgtgagctatttgacggggcagggagtagggacagcctattataggactttcctgtgtaattgactgggtgagttattgaagaggtagttttcccgtgaaagatttcagttattacaaaattacatcattattgttaaggaaattcataattccacttcgtcttttaaaaatcatgttattaaaactttagaaatcagctcagtttccctgcctgcacagtacctctatcatgaaattatctgctcatggtcggtttcaccaatagtggtcacagagctcttatttaaagacaaatctttcatttgaataatgacataacattaagtgcttgttttaatcattggaaaggtgtccgtaaatacctatgattttacccgtcctgaggacatacaaaattgaattaaatgagagagaatatttttaatgatttatagtgtcaaaaataaatgaaattcaggttcatttttttttagtctcccactgccccattccccgtgtttctaaaagtcagacagaattgcgtggtcccagaggtattcccgagatagtctgtgaagtatttaatccaaattgcatatttggtgtcaggctctttttgtggacacattcatagtttgtcattaactcttttaactgttttgaacctctgtatatttaactcatgtattcccgtatgtttttgttgtttacattaaaataagcagtggttgccatctttctgctgagcagactcaaggctgcgttttaacatctgacttgtactgaatactctcaattggatagcctataaaaaatgtttagagttaggagtatttttgtcattactcttctgtgatgaaatgcaaaagtatatcacatatgagaagtataatagtaagcttcatagatagatgaagaacatgaagttttatatataatagtgggggagtttttaagcagacattatttaaaatatttttatattatctgattcttgaggaatttggtaaaataacctcacctttcagaactgccagtaatttatcttgaataaaaatgataccaaatatcacaaaaggtctctgccttggaacatacacatatataaaagaaatctagtaaattgttacctgaacatgtgtgtttacagagcatgtcaaaaccccagcaccatttttcttgccccaactctagccaagtcttctgcaaaagcaaagagagactttcattcacagctaacctcccatgtagcaggcgctatgagaggctaagtcagtggtgtcaccaacttctgcttttaagcagcggcctgtttcacatactttttttattttttttgacacagcaggatcaaaacacatgtactgcacccctcccccctccccagcactgccccctccatcagccaagtgctctgttcctctggctatgactgtgtctgtcgacctcaaaacagctcgttgccatatctgatgaaggatgactcatttctttctggtacctcaaaacttgcataatttcaatcagctgttattgggtggtttgaagagataagcgttctttaaggccaggatatggtgtaatatttttggtaaaaattccccaatctcctctttagtaataaggcctgaaacatggttcactgtggctttgaagtgagggcaacctgggtttatatcttagccctactattcagcagttgcaaattgcttctaagcctcagttttctcatctataaagtggagggaataataataataatgataataatacttgcctcttaggatcattctgaggatatcagataatgagactaggcctatcgtatgttatcctgcaaacatatgtgcaatgatgattatttaaaaagggacaaagatagtcaaacaagagtattctattaaatagttgattcaaaaattcttttttatttaattaattttctatttatctattttagagacagtgtctcgctctgttgcccaggctggagtacagtgacatgattatagctcactacagtctagaacccctgggctcaaaccatcctctctcctcagcctccagagtagctcagattatagatgcataccaccacacccaactaattttttttttaactttttgtagagacacgttcttgctgtgtttgccttggttgatctcaagctcctagcctcaagcaatcctcccaccttgacctcccaaagcactgggattacaggcatgagctaccacgcctggccaaaaatgctttttagaatatgatcctgtcatattgcctagacttagagaccagaatgtgttctttgatgctagataagtcaaagaactattgtcagttttgtacttcatcaataaaaggagagtaatagtaattagtaattcaccgtaaatctgaactgggataatatgtgttaggagttcttaaccttgggatctggatcagtcggcactcaaatccacaggaaatctttggatacattttgtgagggacatgcttttgaccatgttaaagttatttgtaaatattttacactttatttttttctggagagtgtcatacatttcaccaaaagattgtatgatccccaagagtgtgagaaaccatcgaggaaccactgaattgtatatagctgcctcgagggtggcaacacttcataaaccagttattatgttagatactatgaaaagaattattgattttttttctgttttttcccaaaataaccattatatattataaaggcagccctaaaaaggtgtaatacatgaaatattaataactgtatctgactctctaattaaatgcctagaagctgagacttttggcttttaggacttttctagaaaggtcttcatcgctgatatttttatttttagaatatgaacctatcccagaataaatctgcttattaaatatattatataaataaaatatgcaacaaatttattagaagaatcaactcttgtgctgtcacactgaagtttaagaggtgctaaaattgtttaactgtgcctccaaaaggccttttagtatttttttccttccagtgtcagattttggcactggcatagaagaaagtccccatagagctactttccagccattgttgtagctgaaggaagggtgaaaacacatacaggatggcaaaaatagaagctctgagagacttgagtagttcttttaacaataatgactttcacgtggaatgaaaaaaaagacagtgcagacataaattttcaaccatatttttagctgtccaaatgcatatttgctgtaaaggcagaacattattacagaaacagcgtggttagaactccagaaatctgggtttttccaattctgattctattatgtaatttcattatgacacagggtgtttggtttgctcctttaccaaatacagggttagctaccaaatatggggttagttaaagaagggagatggggtcctcagatctgtgtaataggttttatatctgtgtgataaatttctaaaaccttgagatgtaaagaatctgtatgaataaagagtgggatatacatggggaaatagtgattttctgctctttcactctgagaatcaccagttacatctcagaagagatggagctaatgtgtttagcacagcagcattacctgatatatcgggtagctccctatgtggcgacattgtcagtgggataagtcttaggtgcattcatatctcagtgcaaggtatgattactggagtatgtattgcctcatgtcctggaacaaaaactgttctattgctcttagccagagatgccagtttagtttacactggtctccattatcattgctgatgtgttgaggaagtgaatttaataagcagggtaaacaggttttgtttccaagctctatggtgattataagatgggtgcttggctgaacctgatagagtcccttcagttttttggcaagaaatctgagggcaaagaggactgttttaaagcaggcaaagacatgctgtacagcccatttcaacggattcttcacaattttatttgaaacaaaagttggccaggatattggtaaactattgctttctgttggcagagtgctttccctggtcttgttcaattgttggccagcctgtgctcctggtaagagtctggctattaatctaaaggtgtttattgcaaaccaccatctatttttaagttgttttagctcctgaattcagtatattccatagggtctactggtgtgtagtcaacagctggttaattctattttggaggggaagaggggagggacatggccttcgatgtctcctagtggtgcatgatagagataagaataaaataatattcaacacttattgaattatggaatatcaacaattattgaatatcaactacatatctgacagtcatgaacacattaagtcatgtcaactctattggtaattaatagaacaatgtgattgataggacattattactaatgtgaaaataagcaagtattaatttgtttctgaagtgacttaaactgttacacgtttttacaaaggagcacaggaagtaacccctctgattattaggtaacttttagcctctaaatgagatttatgaatgggcaatactttggtatcttcaggaaagtttccacgtaattcacatgatttcagctgtcaatgttcatgaacaatttctgtttgtgttgctttagctccataattagtatgtttttagaagattccactggaaaatctgcaagattacagaccatgtttgtctcacgctgtgaccctggcttgtagcacagtgccaggcacatggtggacacgcaataattactcccagaacttaattgacttaatttaccactgaaattgtattactgtgaaatcgtaccagaagctttgctcataaccatctatgcatttcgctaacatgaatgttgcaaagactttttgatataatcagataaacacagaaaatatttaaagagttaaaaatatttgaggtatattcatactaacattatataaatcagatttcagattgattcgatttaaaatggctaagatataaaaccataaaaaatgcgagtaaatattctgcctatcagggcttgttatgtaattacatggtttcagtatggttcttattcatagaaaattattgtaaaagatcatttcttcacaaattccttcaccaatggaaacctttaatatcttgaagatgaatatccatgtctgtaaatgttaagccactttaataaatcattcaatcaaatttacttcatattaatcagatgaaatcagttccttttcaaaatttggagatttggaaaccttaaaatttttatatttggctggtcttcaaataataaaataaaataaggaataaaaacagccgacccaatttaaaatttaaaaaaaaatgtcttaagtcatatctgggtttcctaacatgtatgccaaggctcagctatttatcaatgttatatagctgactgaagatttaagtctcccaaaagcaaaacttaaattggaaacttagagaaaatttcaactattgttacccgcatgttggtgttagccgtgaacctaaagacaaaaggtgttgtgttttgtttgtttgtttgtttgttttaaatacttagtcattatacttattggtttactctaaaggggaggaaaaaattacactggatttaaagggtattcatattaaaagttaggtatgtcattttctatatctatttggatgattgttcagatccatcacctacattgctgctgtgaaaatcagtattgtggctataatatttgaaataccgaaagggatcaagtgctcaaaagacaggccagttatcactgaaaagcatttgccaggcaatcactggcttcgaaactccttgcagttaactgtttgtaccattattcatcctttttcacataggaaattaccagccaacggaaatggcctggagacaacacaaatgcaacctaaattgtactgctcaaagcattaaaagaaaagcaaacaatcattttctcgaattgttgattccagaattttttctgtagcaatttttagttgagctgcctcatgtagctttgggttttcagccaatcctccttcactcttgccctctgttcaaaccacgtagatgtggaaggtgaacttagagaagttcaggggcagagattgcagctactctttgcggctttacatgtgtgagtgagcagtcttccctcagtctgagaggagagaaagttttgtgctatatatgcccctcaggaatgccaattggtgttatcggctagctacttattcctatcctttttccctcccagcactgatcttatccatatgacccataattcttccctctcaggcacgaggtgatggaggtacaaattattgtctcttaagacagcttgtgggaaaaggagaaatttattatttaaacataaacagacacagatagaaccatcagcaatttgtgactgtaatgttaaagataaaagagagctgcccccagcacttagcaagtacctggcatcagctccttctcaaaaatacatgtggggctgggtgcggtggctcacacctgtaatcccagcactttgggaggcagaggccggtggatcacctgaggtcaggagttggagaccaggctggtcaacgtggtgaaacccgaccccactaaaaatacaaaaattagccaggcatggtggcgggcgtctgtaatcccagctactctggaagctgagacaagagaatcacttgaacccgggaggcggaggtggcagtgggccgagatcgcgccactgccctccagcctgggcaacagagcaacgctccatctcaaaaaaaaaaaaaaagtgtggaaagtaggagtggacaatgaattttcttgaatgtgtcttctatatcatcaaccatctctgcccaactccagattaatttgtcagcctgaatggacgacatttaaaagggattttaagaaaacaaacactactttttttcctaaaatattttttttttctaaaaataacgatagaaatagcaggcaggattattttcaactttcttaatgtttagcctaacagagcactgtcctaggtgcttattccttagaatgttcagtgacgattaggaaacaggatttctgtccttaataggcttactgcaaaggagagtgacaaagtattttaaaactgccatgcaggataaagtatgaatgaaataagatcgttagtgcttttctttttctttaagttaaagccaagctttgtttttgaaaatagggcacaggaggcttctactctgcgttcctttggtaacaggctgcttccctgtccttgattgggctaaggatgttgataacttcaaaggaaatcccttactgtgtcctgccaggttacattgtacacagtgtgaccaggtcagggctcgcatctgtatggtgttttagaaagatgtggttctgtagtgacacagctcaggacactacccacttctcccaccttctctgctacttccagaaattttaattgcaccaaaaataaggttcgactaggcttaccaaagtactaaatttgtttagatgggaggtaacttcatgtgtgaaagaatttctcacctacctcccactctccacccccatgcaagcttgctcctattgaattctaggtgcgaacacctagatatttcactctgactcaactttccattctcatatttgataagattggtatgaaagaaacacattgaacaatatccaaccatatgctttaagcatctctcaaatattcaataacaagattcaagggctgaaaactaacaaaatatttttctcatacaaaagaaatcacagttgaatcctcttggcaaataggatttgagcacttactacatccctggcaccgttttaattgcatctattaatctacataagaatcacagtagcggggcatggtggcttatgcctgtaatcccagcactttgggaggccgaggcgggcagatcacttgagattgggagtttgagaccagcctgaccaacacagagaaaccccatctctactaaaaaatagaaaattagccggtcatggtggcgcatgcctgtaatcccagctactcgggaggctgaggcaggagaattgcttgaacccgggaggtggaggttgcagtgagccaagatcgtgtgccattgcactccagcctgggtgagtgagactctgtctcaaaaaaaaaaaaaaaagaatcacagtagctcacactgtaaagatcagagaactttaagcattgaaagattaagtgacttgcccagtgttgtacctggcaaatgacagagacaggttttgaatatcagtgttctggcacctaaatctgattattaacctccaagctctactgactctgaataagtgtattcaaagtactcctgatatatttaaaatgtgatatggtttacctaaaatatagcaaactatattggagtctaagtgctccttttaaagcaagctatgcttttggaaactagtgctgtaatttcaggattttccctctaactaatgaaaggcattttctttgcaagagaattaagcaccaaattgtgcaagggttgaaacactcactgaaatcaggattacacccactttggcatggtgtgtcaagcacccagggcataaggaaagaacagcaggctggagtgaatggttacacattcacatttgagcctcagccatatatgtgggttaatttccaaatggacatttacattgcccttgtgtggaccaagttggtgtttatttgcaaacatgttatttagatctaggaaaatgacaggatagccccaggaaagtttcacaattataacttaactaggctcccagcttactttgcacaaagggagtccccaaaatgtttgataaacacaacttctaatagttcattgattttgggggaagcagcagtccacttttgcagtaggccttcactgggacttgcagactgacacccaacatttgctattgcaatgttattgagacttagaaactcatgatacattcctggtccagagtcgggtggggggaagtagaaaaaggggagccagagattatctttggaaatctagtttttattacatcacctaaagtagcacaacctgctacactaatgaaatcgtgttcttggtttaaaagggcaattgttagcctgactttgtgctcactaaaaacattcccccaatcttgttaagttattgctctcatttcagatttttatggctgtgcagcttaccagccctcatttctttacgtttcattcattttccttgtattgatgattaatggaggatgtcgaatgttagagtgagcaggcatcagcaattgcaagatcataattagtttagctgacgagagcctctgatagcacttgcatctggatggaaaaattaccctatagggaactggctgctcaccaggtctttttagtgatacattgtgaaacacccgatgaatcaaatgccctttcaatgccaagaaagtgttccagtcttgaagccaaaattatgtctgcagaaagctttccatttgaaatgtatcagagtacaattataaccattgtattttcttggcagggataccactcttctacagtatggacttgagttaaataaattgcctaaattttatgaatccctgaaattttgacttatggcacatgtaatatttaatttataataaaattaggttccagcaagactttttccactccttatctaacacgcatattttatcattaaaggctttgcttcctagagaaaggagagctgaactgcaattcaggctgtctttttttttctttttttttttcagcaagagaattccatttcctgcctgttagtatttgtgcctacaaacacagcctgacttttgtttaagtgagaagtttaatggaatcattacttgatagcaagaatggaacaagcaatactaattatctagttttaaatattcttaggttatttttaacctgttgattacaaaactcaggccactagaatcaatttgtatttggaaacccttgtgatttccaagtctaagtcaaataaaataaataaatagccattgaagggtctatgttgcctaacttaagtgggcacctcataagggttctcattagtaatactgtacttttaattggctgaagtttctacaaaccctctcacgtttgaggaatagaggaatctttcagattttacaattgcaaacgaaagaccagaattgagtgtcttatattctcgtaatacttacgttacatgaatgacatacaaaaacacacaaatcaagtttaattttaaatgatttacatttattccaaacttgactatattttaaagctcaggtagcatgtgctcctcctttccaaagtgtattaaacatattgccatgttctgtctttttgacgtatgttttgacacttttaaaaggtatattttagggttcagcatttaggagccatcattaaagccataaaacccaaagttcaaaaagttaaagctgtttctgtgaaaagcctttggtgttccacacacctcatccatcactgtaggtttaattataatgaaaatcagtggtgcctattaaacacaattgaacctgacctcattatgggcagtgtggttttatactgtcattgttgctagtttaaagacaaaactcctgggttgatttggtctaactccactgatcatgtgactcacctctgaccttggtttttttcccctgtttcagaggcgtagaggctccggtgttttttgtgccaattgcctgaccacaaagacctctctctggcgaaagaatgcaaatggcggatatgtatgcaacgcgtgtggcctctaccagaagcttcactcggtaagaacttgttccactctttcaggaaaagctttataaagcagtgttggcctggtctgtggtgtgataagtcccattccctggcttgcagtgcctgcccccgcagggttgttttaatacagtcactttgagtgcacatgtgatttatggtgaagggggcttagatgtgatggggagataggtttgaggtcattagtaatgcattatgcttcttttgatataaaagaggaaaatgattgatttctgggaacttcacagcagatagttgaactaatggttatcagaattcaatgaaattattttaggtaaaaaggagaaaatttttagaagtttcagaaatatgcaaaacgttttaaaaaatgaaaaaggactcggtcatgttcagtataaaatataagtcagggaaagaattcgtgttttctagtttaccttcggaattcacaagtgttatcttgaccgctttaggggctggaggggcacattcggaaggacagttctgaactgaattaggatcagagaatatcacatgaatctccccagggccttcagtgggtatttcgatgaggtatctgaagttctgaatagcacacacaccagggtagagtaaggtgcaaagatactttgtcttttaagatctccagctggctttggctcacggaggttctttgaattacttttcctcaaattttagttagaattctgtaataaaattaaaactcacaaatcctccatctgaatatggatttgacttactgaaggatttttttttttagtttagcaagttcatctgctgacaagagctgactttaaaataggcatcccccatttagtaaacaaaaatttatttccctgtgcctttttcatttcgtttggcgttttaccatagctcttagcgcaagccagtgaatacattatggctacagggaatacacttttagacaaaatgttctcatatatggaccattagaagcactctttaaaaaatgcatgctgctaacactactaattggcagtaaactgtaaaaaccttagttattagcatgtagcaagtagaaagattccaccccccaccacataccaacttattttttttaaccttcaccatttaagcatagcaataagtttctatttaatgggaactgacattaatgattttaattgaagtctggccaatcatagggcaaaaattaattaaaatactgctctgccagattatgggaacttaaccactgagatataaactaaagtattttctaaaaattattttaatattcatctctccagaggtaagatgttttcagttttcaggttttttaaaaaaccatacattgaaatacataaaggttatgttcacatttcgtgtcaaaaactgacacaaaagttatgacagtttaaaaaaggaatttatgcaaatttcaggttctttacagtgtatagattaaataatgcatatgtttataatgctaatatgaactctttgtaaacctggatattctgagcaaaagaaatgcacatggcataactaagctatgttgcattttctttcttaaactaacaatgaattgtcaataacaactgtgttatctttcttcacttggaagtatgtttgtaacaacagaaatgttccaaaaaagatttatagttgtacttatttaagatacaagaggtactccctttctttcaagtgtatcacttctaggaataatttacaaattacacttatatttatgtttttttaaatttatattatatttatattattataacatgtttatgaatatttatgtttatatttaaaattttataatttataaaattatacattatatacacataatgtgtaatttataaagttaaatttataaattatatttattgtcatgttttatgtggaaattattttctgatttcagtaatcttttagaaaaatcagactttagcccatttaaagattaccctaaatttttaacctataaatacgcattaatttatcaaactgattcctttgattttatacatcaaagagctccaactgcaagtaaagtttttattatagtcttatccatggatttaagtcatattatataaatacctgttgaacatgtccataaataccaatcatgtaacgtttaagctaaacaaaatacttaagctgaatgaaagttagcacttactttaagtaaagagtagaatgacagatcagatatttaaaccaaagctacacatgaatttagattttcaacacaaaactaatgcttcactattaacaagtaaaatcttagatcacaaatataaaatattattaatgagagagaagtagaaatgagaagaaaaaaaaaatccctctctattgttttgatgacctgatatctttcctcacaattctgtcagtttatctttgattatttatgctctgatattaatattttatatccacatttgcaattatttagaagcacgcatgtatttgttgcttaggtttccataacaaaataccataaactgagcagctttaaacagccgacatttatgttttcacattctgaaggctagaaatctgagatcaggttccagcatagttggattctgaggagggctgtcttccttactaagccaccttctatctgtgccctcacatagtggagagagatctctttctcttcctcttctcataaggccacagccccattggattagggccccacccttaacaacctcatttaactttaatttcctactaaggaccctgtctccagacacagtcacactgtggtttagggcttcaacatataaacttattctgtctgtagcaatgtgtaatttttccactgttaacaatatgtatctcctgtgttactcttatatgctggcattttagtgcacaactcaaaaattgaaaaaaaatttcagaaaaatcacatctcttcaagtgactttctacaccgtttcatcactaaatgatgcaatctcaaaatctgttgcatctggaaaggttattttcaagtagattaaagttttcagtcccccctgcaaagatggacatgatttaattaggctaaaatagtgcactttggttacttcctctgatcctgcttagggcaaaaggaggagatttagtaaatctacagcagaaagcctatccctgctttgaacttaagcatggtttatatttgtgaggaatttttaatgcattttaatgtattttttaatgttttccttttatgtattgtatgtgttctctgcagactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggaccggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatgttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcagtgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgtttttttttttttttttttttttttttcccaacatatgaactgcagcatatcactttttctttttgtgcctcaggttcctcagctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatactatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttcaaaaacattcattgagtatcaaatattgagtgtcgagtattgggtaatgattatgttacgatgtgtaaaaacacctgcttatgaagtttaactttgaattcggtatactcatgtgaacatgatgcaattcctaatcaatcatctcaaaaagtttaaattaatatatcaaatatcttatttgtttggttaaaatcaaattaatcagggcaagttccctgaaagatgactttgaaagagaaatgaggcagaacagatccagataggaaaggacgttggcaagactcacctgcatgtttttaaccagaaggaaaaatacaaaaagacagaacataaagtatataaataattgattgcttcagaagatttgcttggagagtttaaaataattagtatctcccctcattatacaatcttcatttctcatttttgggagcccaaattaaggaacaaatccttctaattattatttttttttcttttttccctttttctttccatgttttgaaaatagcagagagtctttgaggggctttcataatggcaatgcccttgctttgcagctggaggcaatgttctctagataagagtgtaataataacatttaatgtgatatacttccttaagtagaacttgattcttgtgtcaaggaccacccttcagataaagaatacacatgatctcacccaggactgtcagaaccccattagaggaggaatatgtagccatcagctatttacccttgtttgcggggagagaagtgagtgagtcatcattgtcactctgctctcacctctgggtcttccatctctgtgtggacggagcaggggtccagaaaaggaacatacaaggacacaaaggaataggcaagtagcctccatggatacagccagctgggtagagactttgggaactggagagctcattccacacgtataaaggtagtctttcttcagccctaagcatttgtgaagggagaatgcttaacttccgtttgccagattttcagtttttaataaaaactggacaaagggaattttattgtatgaaatctccctaagttttaaatgttagttacttacttttttgttttaatactgcaagctgaacaaaacacttgctcagaataaattccaccagtagattgccatagtatgacccctggagcttaaacaatagtgaactctgataactagcaaggtggaaattgggcaaatggctgaggttagttgtttttcctctgggttttgtcttgggttgcagtctgtctccagctctaccaggaagcccaacagaatcacggttgtagcagctgtctgattccttcagagccaaatttgctcaagactaagaacattggcacagaagagaaataaatcctattttttcagcataccgcaaattactttgtacttctgttcttcatctttgtaacctcaagtacagttgtgttgtttttaaaacatactgatatgaacaaatttgccctttcatgaacaaagaaatgtcaaaaactatcaaaagtagctggaattaatatttgccaatgcccaagatgcccttatagtcagtcctctccaagtcatattttagagtgacaatgccagggatagaaaactaaatagaacaatagatagaaggaaggagtttttcatgtcagagttgatcatattaatgaattaaaaaacaatttgtatacaaaataagaaattttataatgaaatcttatttctagttttataatactgttatctaatgtattcaggatgtcagtagt

SEQ ID NO: 13250 - DNA, 34266 bp, Human
ttttgacacagtttcaccctgttgccctggctggagtgcaatggcgcgatcttggctcactgcaacctctgcatcctggattcaagcgattctcgtgcctcagccatctgagtagctaggactacaggcacgccaccacgcttggcttttttttttttttttgtattattagtagagatgggatttcatcatgttggccaggctggtctcgaactactgacctcaggggatccacctgcctcggcctcccaaagtgctgtgattacaggcatgagccactacgcctgacctggggctatttataagaagccctcaaggtagcagatcaccctctgatggccacatggagatctgggaaacgaacccccggtcatgcctctggacacctgcccacttctatctgtgccttcctgggccctggttttcagagctatgtgggtgcctgacacactcagggccacagaacatgggaagggctctaggccaagagtcccggcatcattcgagtctgctctggcccgctcctgccctaagccctcctgctcacttccagctgtggaggtagcccagagagtgcctggctccctggctcccccctctgccaggcccactcagtgtgacctaaatccttgccgaggcttggcagccctctgcgggcgcccggatggcctctggccttggtgacggtgaggcccagctcccctcagttcccagccttcccggaaccccttgcctaacatcctgtgtggtaatcatgcctgttggccccattcagtcctgccggccactgccaagttgccactgctagttccagacgctcccacctctaatggaaccatcgggaaataaaaagctgcagcacagtttctctctcaggtcagaatctcctcccagcactttgggaggccaacgtgggagaatcacttgggcccaggagttcgagaccagcctgggcaacaaagtgagaccccgtctctacaaaaagttgaaaaattagtcaggagtggtggcgaacatctgtgatcccagttacttgggaggctgaggcgggaggatcacttgagcctgggaggcggaggctgcagtgagctgtgatagcgccactgcactccagcatgggtgacagagcgagaccctgtctcaaaaaaaaaaaaaaaaaaaaaaaagaaaaaaagaaaagaaaagaaagaaaaaagaaaaagtggggagcaggttggggagcatggtgagggccacctactgcctgataatggtgggggacaggaaggggactgagtgctctgagaggcagctgatcccgttttctcacttaaatacctctcaccctacagagaagccctgattccatttgctgtctttcttagcaatgtcttagcaaaagtcttctatttgccacacgggtccaagcttccgcttactaagcacccaagtgccagacaaccccggaggcaggtactcccattgtccccactgtacagatgaagaaactgaactcagggtcacacaagtgataaggggtggcagagatctgaagctgtgcgcggaggcgtggccagcgtgtgcgctccgacttctaaatccctactctggatattgaagacgggaaagaccgagccgctcattctacagatggggaaaagcgaggcctgaggagtcccagagcgggtgccagatcgtagggagcagccagcaccccgggtcccctccacgacacaaccacgtccctcggccacttctgggtcccgcgcgcgtctcggacgcggcaggacagctctaggacgcacggccaccagggggccgaagggaagggcgggggcggaggctcggagctgacccaccgcctcgccccggaagctccgaggccccgccccggcggccgccagcggagggcgtggcctcgccggcgcccccgccccgcccccgcccccgccgcgcgcgcccccgccgcgcgcgcccccggcccgggccccagtcttgctgagcgcaaggcggtggaggcctgaggcctgaggcctggggcggggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagtaagcgccccccgccggccccgccgccgccccggccccggcgcctccaacccgcgctgccgccgggcccgaggccgcgccgagccccggagcctgcgctgccagccccacggagcctggggctggcggctttggaactgctcaggaggcggccaggctccctccagggtcgccccgagcggccgagctgtcctttccctgggcttcccggaactgagttccaggagagggggaactccgagatttcccccgggacctgcttaatctttggcattgattggccctcgggtttcacatagcgtttcccgtacccggatctagtgaacggttttccaggggcaaacctctctggatctctgaaaatcagctcacccaaccttgaatgcttagccagaagtgagaacttctggaaagaagtgtccttgcccactccccctgcacccacaacaggcccatggctcatgaaaggcagcagatgagggaaaactggtgtcaaatgggcatattttttattttatctttttacttttttatataaaagtaaaaaatcttttacttataaaagatggggtcttgcttggttgcccaggctggagtacagtggcacaaacacggttccctgcagcctccacctcttgggctcaggccatcgtcctgcctcagcctccggggtagctgggaccacaggcgcacaccaccacgcctggctaatttttaaaccttttgtagagacagtggtctcactatgttgccctggctggtctcgaactcctgggctcaagcgatcctcctgcttaagccttacgaagtgttgggattacaggtgtgaagcaccacgcccagacagcgtattttaaattatgcatcatatccctttaatttttcatcattatgattggaagatcatgaaaagctgtctgagtttttccttggcatttttctgtggttgatggttagttgttgcccaagctggagtgcaatggcgcgatctcggcccactgcaaccttctcctcctggttcaagcgattcttccacctcagcctcctgagtggctgggattacaggcgcgtgccaccacacccggctaattttatgtattttttagtagaaacagggtttcactatgttatccaggcttgtcttgaactgctgacctcaggtgatccaccacctcggcctcccaaagtgctgggattacaggcatgaaccaccgcgcccagctggttagttggttttaacagcagttcaagaagctagcaagaaggacttcattcgtgaagctaatggtttaatgatagaaactaacatttctggccgggcccagtggctcacgcctgtaatcccaacactttcggaggccagggcgggcaggtcacttgaagagttcaagaccagccttgccaacatggtgaaaccccgtctctactaaaaatacaaaaatttgctgggcatgggggcagcggatgcctgtaatcccagctgctggggaggctaaggcaggaaaatcgcttgaaccgccctgcctccggtgacggaggttgcagtgaaccaagatcgtgccactgcactccagcctgggtgacaaagctagacttctccttaaaaaaaaaaaaaaaaaaaagcagctaggatttcttgggtgcttactgtatgccaggcattgtgctaagtaccttacatgcttcccatcgatttgttttcccattctgtggttgaggtacagagaggttaaataacttgtctgagggtacatagttactgagtggcagggatttgaatccagaatattcttatgtaaccagttctccaaaaactagcccttgaaggtcttccacgtttcaacaaagcaactgaggcttatacatgatgtcttcatgatgtcagaaggaagaactgtgaaaggcaaagcggacccgggaggcagaggctggttaccgcagttagtgttcggaacagcttgacttcatggagcagagaaacagcctgtctggtttaaaccactgttcagtatctacactgatacagtgtaaatgtaatacagtgttttacattttgccattcagggatgtagtcacattttacgggaaggttagctctgggaccagactgcctgtattcaaatcctatcacctctagctgcttgacctttggtaagttatttgacttctcttttttttttttttttttttgagatggagtcttgctctgttgcccaggggcgcaatctcagctcactgcaacgttcgcctcctaggttcaagtgattctgctccctcagcctcccaagtagctgggattacaggcacctgccaccacgcctggctaatttttgtattgttagtagagacggggtttcaccgtgttggccaggctggttttaaactcccgacctccaatgatcctcctgcctcagcctcccaaagtgctgggattataggcgtaagccactgcgcctggccatgttatttgacttctctttgccttagtttcctctctactccctgctaagatggggataatcatgttacctacctcatatggttgtggcaagatttaaatggtgtgatgcatgtcacaccgatagcctagcatttggcatatagttaaatactccataaatagctcttttattattaaaagtgttgttccaagtagtaagctgctgctgtgtgctgtgtcacagtgcttgaagtcaccattagaggtatattcctttgtgccgtatttcaaatgcagaaatgacagtggtcctgtgcaaatgggatttatttgttcatttagcagatatttatagagcgccttctgtatgccaggccttgttttggatactggaggtactgcggagaacaaaacaaacaaaagtccctgtcctcattggcacgcacactcttgggaaaaggaatggcagacaataggcaaaatgaatgtaattatcatacagtatattagaaagcgatgtactgtggggagaaataaagcaggagaggaggatgggggtgggcggtttacaattttagagtggtctgagtaagcctcactgagaagatgacattttagcaaagaaaaattagtgagggagtaaaccacgtggacctggtgggggacatgggggagttggccaggcggagagaacaagtgcaaaggccctgaggcaggaggctgggcggccagagcctagacaggcaggatggtaagagaagagatcaaagaggtaatgggtgggaggccagaatgtgtagactctgcagacatctgcacagaggaatggcatgatccagctggagctataaaaaggtcactctgactgccgtgttgaggctcagccatagagggtccaggtagacagaggaggccaattaggaagttcctgtagtaatccagacggagatgacggtggctggcactggagtggagtggtggaaggtggtgagaagcagttgtattctagataaattttgaagatagaaactacaggatttgctgacagatacgatgacctcaaggtttctgggtctgaacacctggaaagatagagttgtcatttactgataatggggaaagctacattggaagcagattgggagagaaatcagttcagttttgtacatattaagtctggcaaacatcccactcatgctctcagaatagcaattgactgcatgagtctggagtttaggggaagttcgggctgtaaataaagacttggacggataggcagttgtgtgctggtaatgtttaccaactgactctgtgaggggtggggttggtagtggggaacctgatttatagcctttgcctatatctgtggtgtaaatattctgacgttggccaacttcaaatacactataatagaatatcttcacctcatagatgcagtggatataaataatatcaagagcatagatattagtgaaatgtagtcagatgattaggaagtaatgagttttgagtatttattacctttctttttaatttaatggtttttttttttgagacagagtctcactctgtcacccaggctggagtgcagtggtgcaatctctgctcactgcagcctccgcctcctgggttcaagcaattattctgcctcagcctcccaagtagctgggattacaggcacccgccaccacacccagctaacttttgtatttttagtagaaacgggtttttgccatgttgcccaggctggtctcaatctcctgggctcaagtagtcctcccgtctcagtctcccaaagtgctgggattacaggacaggtgcctaaagatgggatgaggattctctgagatgagagaggaacaaggaccccagagcccgatctggaagcttttgtccccattctggcccttagggcagtgaatgcagatcagaggtcattgatagcaggcttgatttttatctgcattgatgggttcagcataaatggaccagaacaggaagattgcaaaaaacagacaaaaaacaacaaaaacaaaaaccttgggttggctattgtaaaaagactaggcacatcaccttgtgctttagtttcaaatgatctttagtttgaacttttgttttactcccacatgttctttttaaaaaattccaaactcatgggtcatgatttgaagaaaatttcccttcctcctgcctggcgcacagaaggtaacgtcaaaagctgggaaagggaacagggcagcagcagacattgacctttacctcccgctcctctctcccaccccttgtctgctgggcatagaggattagaactgcttcctcctgtggtttaccagaaaacgctctgcggctagagcttcagcacaggctgggtctgctgtgccgggtctgtatggggacagctgcacgcctcttccgcttgtgtgagaacaaaggccggaacctggattctgatccaaaccccctggcccccaccttctgggatgttagcagagccttttaactggtaagtctctcccaggatgactcgtaggagcctctcaggattagagttggagacagtgaagggtgcccaggactgggttcacgtgcctgcagtccgccctggctctaagatgagccatcagaagaaggccttttccacctccctacaggatgcccccacagcattttgtttcgtagtgagtgtatttctggcaagtatcttaaataagaattgtaaatgaaattgcatcctccacacacgtaagtcatagcttcaagagtttttgtcttaactgctgaatgacgcacagttctcagctcttggcttcatattttagttctctgtttccctgcctggctgcagaggtcaaggctcgaagcactcatttgccttatagaaaagtggagggcagttcccggataatagggtgcggatcacctttcctcggaaaacaggacttagggacactaaaagatcacacagatcctttatctcaccctcccatttcctcgatgaggaaactgaggcccagccaggctaaatgacttgtttaaggttatgtggttgtttagaggcagggcgcaggcaagagccaccacacattcgggttcccagtgtaatgccccctccccttacagctgctcaaacttttcactaaagattttctcattgatttgttaattttttgagcagaagtgattcgtagttggataagcttttggaaggctacttccatgctctttggctaacttcaagtatgtaatttcggaaggtttatttcacagcccattcctctcagagcaggcaaggaggcagaggggagaagtgcttcagaagaaaaccttctgaagcagagccgtgcagcatgaggaggaggcttggagcccaggagatgtgttggagccgtgggtgcctctgctccagaggctggggtccccctgtccctgactttgacttaactgggcttctctgggcctgcttctttccctgtcagggcagcagggaggatgaccaagccagccttcctcctgctgcttccagactagtcgggagtgttgagttaggaaccagggttggttctccagtgctgtctgcagggcctggctctgtagccccaggagaggagggaggttcacaatgtttttcctgagagcaatggtatactacccttgggggccaggaggaactttgcatttaattaattaattaacatttgtatagcatttttgtcaaatgtatcatctcagtcttcactgcccctccccccacccccaccttgggttgatggtatttgccctgttttgtagatgaagaaatgtggatgctaaggctctaatcacctacccacccttatggaaaggtggagggcatctccctgatttaattagctgatttatttatttattttatttatttactttttttgagacaggatcttgctctgtcaccaggctggagtgcagtggtgcgatcatggctcactgcagcctggacctctcgggctcaagcagtcctcagcctcctgagtagctgagactacagacatgtgccaccacgcccagctagtttttaaatattttttgtagagatgggggtctcgctgtgttgcccaggctggtctggaagtcctgggctcaagtgatcctcctgccttggcctcccagagtgccgggattataggcatgagccactgtgcctggcctaattagctgacttaattagatcacgaagttaggcagtggtcttgagcccaggtccttggaccccaatgcttccttcttctgcttgacaaaggaagctgtttagcatcgtgactgagggtccaggctttgtggcttgacagtttccttcacctcccagtttcctcgtctgtagaatgagactcctcacagaacctcctccacaagactgttgtgaggaatgattggaaaggtgcgtttaagtcatctggcacacgccgactacttggttaacataggtattattattggattcaggaacaaccagtttttacaaggggatgggcgcatgaaaccatttgagactgtttcgaaacacctgtgttaggacccaccctacacctactggatcagaatgtctctgtcttgagaaagggagcaggaggcgaggaccgcgtgtttgttctgatgccctcctttgatgagaactgctgctctggtgctcgctgctcagtattccggagtctcactactcaaagtgtgctcttggaccagctgtcagcacttcaggtcctcttccttctgcatcagaatgtccttttaaaaagatccccaggaaattcaaatgctcattaaagtttgagaaacactgtaaaggttaaaaaaacataaaaaaaaaaatacccacacatactacccccacccatttaggaaagagttgttttttagttgttttgcaaccacagagtaagcaatcatgttgtaatacccaatatcttggatttgtttaaaggagtgctggcaacataacagataagggaggccaacctcagaaccggggacccacaacaggactggtcagggaggactgtggcaaacctcagagtcagaacaggattaaagagagggccaggagtcagttcaggccaggtggccatccgtcacagctgtctgcagtcttctggggtgggggcagaggtgctggcccttggggctcccccacctgcccatgccaggactctggaggcttagctcctccctttgtaccaggcacgtccagagccctggctaccaggatccgatcagcagctctgaagcgcagcctgccagctggcggctcctccttctccaggctgttctctgggcttcagatttcttgctgcctctctcctgcactgaccttgcagcttctccttctctccagacgagcgattgccggttgaggaaaaaacgcttgaagggccaaggacagggactggaaagcaggaggaaaaagcagaatggtcctgtggtccgtgtgtgtatttaggggtgagggcagatacagggagagtgggagaggaaggctggggagccacccgtgtggccctgatcctctagttaaagctccagtgatggacgcgtcgtgtgtcctgtagacactggctcagacactgtggttgggtcctcaccttgggttggtccctcactaggaccctcttggagatggatcttgagagagatgaggaagaggcagagggggtggtgggaggagggggtctgacgtcagggtcaagaggcagattggtgccctctgtatagggatggtggagaggtcattgggctggttctgtggggacttttgtaagttatctctttaaacctcaacttctccatttgtattaccagattatggcttcctaaagttgttaaagattttgttaatcctttacctggtaaatgcctgacatataataggcgctaaatcagccattcagttccttcgtcactgctcccacctgcaggctgagccccatttccaccgtggatttctgactagttcccatgggcatgccggccgtgatgactttccccctcacttccttcttcctttccctccaacactggccttggttggaagctagagagccagagagctgtggaggaagaattcagtgcaggaagccctacaaccttggttagaacagaagggcagaacaaacaaatacttggtgtgtttgtgacccaccttaggcctctacttctcatgcatgtgagtgcctcagtttaggctgaacactagcccaggtggtttgcttacctgggagaggttgtagccactggcccagacactgttgttggtcctcaccttgggttggtcactcactaggaccctcttggacatgaattttgagagagatgaggaagaggcgggggcggtgggagggggggtctgacgtcagggtcaagaggcagatttggtcccctctatagcggtgctggagaggtcattgggcatgtcatgcagtggctgcacagtcagtcccagctcccctgctttcttaccctgggaccttcattgacctgagcctcagcttttccatttgcagaatgggaggactgtcacagaaccccatgtggttctttcaggattcttgtctggattcattgagctctaatacacataagtacttagtgccagcactaatcatttgctggtatcactcttccaggatgacacctaccactcggtgcttaataggtgataggtacaggcctcagctcattataagcatgaactccttttatccttataacaactctgtgctgtaggtaccgctattacccccatttcaggtgagaaaactgaggtacagccaggttaaataattgtgcacttactaaggggttgagctgggattcaaactcaggcagttagtctggagtccatgttttctgtcactatgctgtagcagttattagtcatcacttggtagttggagcccagtggacatggagaagaggcaagtgagaggaggtggtcctgccctctcactgttccaactgtcgcctgaggacctgccactatacctaggctggggctgccctgcttgtccgggtgacctgtgctcctagaagagactggccttggtcataaaatggacagctccactcccaggcctgcggccctccctggtggcctttgccgctttcctatgctcctggcagcaaagtggttcatctctagcaagtggtctctaactttcccaggcagagtccctgtctacagggcaggctccctacccactgacttcctggaacagaagccaagctgtcaggagggagggacaagctgtgggcttataacattttcttaagaaacacgtggtggtttcttgccaggcaggaagtgtttgtttccacatcgtagccacctgaaccatgtctgatccttccttgttcctcgtctgtctctctttgcaccccaggcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggtgagcatcagcatggagcctgccagggctagggtgagctgggcgctggtagaccccagcaacaaagccgctcgctcattgtggagctaggccccaaggcattgtgaactcagagctcccatggtctccttgaaggtgggcaggaggcgagcgggtaaaggaaagacagcagcagggcaggactgttgggtccttgtccatgtgtctggcctcttttgtcctttgcaaagcccccgttctcgttgtttcccagtctgggctctggcttctcacggttgccctgcatcccctgtagcggtggctcagcaactctggtgtctggatctggcttcctgttgggtgtgctgtgggaatcagaatgagctctcttctcctgcacccatccaccttttttttttttttagacagagtctgctctgtcaccaggctggagtgcagtggcatgatctcggctcactgcaacctccgcctcctgggttccagcaattctcccgcctcagcctcccaagtagctcggagtacaggcgcgcatcaccatgcccggctaattttttgcatttttagtagaaatgggttttcaccatgttggccaggctggtctcaaaatcctgacttcaagtgatccgctcacttcggcctcccaaagtgctgggattacaggcgtgagccaccgcaccctgccccatctaccttttttcaaaatgtttttcttcctgagttctgttttgagccagaaggttggcaacaagagcttaaaccagggagcagtaggaccttaagtcctgggcaggagcatgggttaacctcctgggtgacacatgtccgttgaccagttcactcaaaatgccttggaggcccttgggggcatcctgccccaggaaccctggcagagagtgcagcagccctgtgttctggtacgtggtgcgggtgggcataggcagttgttgaggacagagacatggccttccatcccaccctgcctggagttgcccatagtaggattcctaaataggggtcctcagaactgggccagtcctggggaggttttcacttgtttatggcaagatgagaagaaatacagaatgtgctcaattcagagcttttctttgctacatttttggtgttaaacctatctttattttattaaaaattgattgtaatagaagataggtaattctaactttttttcttggcaaaatacaaatctggtaaccctttggaggtcacttgcaagtttttggaacctttactggcctgtgagatcgtgaagtccagaactactgctcagagggcatcttctgctctgagcagggaatagaaaggtcagagcccttcccgggagtcagggttcctccttcatcgtgagagtatcctgcagcacgcccagtcttccccccccgacaggctgtggcgcagatcctgcctttccgagaccagaaccgcaaggctttggacggcctctggaaccggcaccatgtggagcgggtggagatcatcatgaaagagaccgtggatgctgaaggtgtgtgagtggccctgcgcactcggtcccccagcctctgcctgcccgctgtctgcggtgaggcatggggcgcttctcagagggaggttttctgtgggtgtgtggtctcccttcgagcctgccgtgtgcctagctctgaaccgggctaaaccccagggtgccggctggcaaagcccaagtagccattgctgcccatgaggagcgtatggtccagagaagtaggcctggcacagaggcgggaaaccactggcacgcggtagaggctggagtctccctgaggtcccccaagtttttgagtgcgtggagaccatgggaactgcgtgagggcttccccgactgtggtgcttgcagccgtggcgccccctgcctggggcactccccctcgcgtccccctcaccttctgacccctctctcgcttgttagttctcagctccatggccctccaggaagactttctgagccctgcaggcccactcccctcaccctcacggcgccacacacctccctcccctgccctgcacagtgttacccttgcctcgtccttgtccaccctgtctcttctgccagcctgtaggctccaggaggacaccgcctctcccgcactgccacacacctcagacacactgagtatacacccgggaggcgggggccctgcgtcatgcccaccgctgccttcagctgggtggcctcagcatgtcactccttgcagctgtgagatgagcatgtcctgtcggtgaggacagctaaggtcccttagctggcattctgtgatggtagcaaagttttggagcattgaccgtgaagatgtaaagcactggctcttgcccagtaacgataagagctgaagtttactgtgtccccagtccccagccgccaggtgaggtgggcgctgttactagcctccttacagatgaagatggtggcgagcccacagccccacagtagaaggcggtggagcctgatcctgggggcaacagtctggccccagcactcaggcctggcgccgccgcgctgtgctgccagcgctgcgtcagtggccagctcatccccgcggccgctttctgcagctgcagcgggagcacccgaggccactgcccccccagcccccgcagtgcgtgcccgccacagggcagggcccagagccctggacccagggatgggccaggaggtttctcctctttttctctctcccttgctctttctctgggccattttctctttttctttcccccgccccttggtttctcttcagctgcttctcccttcctctctgaatgtgtatttagtgccagaagctctctgcggggccgaggtgccacagtgaggtacaaaactcagcctctcagatatggctccctaatactgcccagattcacgggtgctgtggggggtgatgatctcatcacactggctggtgggacaaactccaaaatggagctgggcgcagtggtacacccgtagtcccagctactcgggggcagaggcgggaggatcatttgagctcagtagttggacaccagcctggggagcatagtgagcctccgtctctgaaaaagaaaacaaaatgggtgatgggtgttgcaggcaggcagcgtggtggggggacaatgtggggggtgggcgggaggccaggcaggacttcccaagccaggccttgaaggacattgctgggttcgagaaggcactgggtttctctacttcagaacccacagcagaaaagaggccctaccccctgcagtgagccttcatgggtctcagggaatcgtcctccagcccttccaaatttccctcccagtcctcagccagggcgctggccgtgggttgccccccgtgcctgtctgtgcctgatctcccagcaggcacgtgtgctgggcctatgcctgcttcatcttcagagaagtgagctgcacctggtgcagagagcctagagcagaattggagggggtcctgcccctgctgaagccagcgggccggcgcttgcccttctctacctggacttggccccatccccagcgaggctgggagactcctctcccctttctggcaactccttcctatctccgccctgggctggggaagagccatgatgtctggagttacctgttggtactgttgcctcttagttcttccagccctcccaccctgtttccttcttggtatgtggtgtcatttgtgggttgtttgtaggtcccatggagccagggaccaggcagattgcaggcccgattatcctagcaaaggtacttttggattttgaagaaagaaacacggaagatatgaaagacagacaggtggagctctgggcaggtctgtttgccgggacagtctgaggatgttgggtttgaacagcaacacaacagcctgggctggctgtcctcaaggtccaggagggagaggcacctggagccctgttgtcacagctgcagggactaaaggaggcccagccttgcctgccatatggggctctaggggagggtccgccgctcctaagctccagagtccaaggcctttagtacagctgggccctgtaccttcagcccaggggcaaagggagcctcagcgcaggacaggcagtgggagatccactagtcctggaggcttgcagcctgtcgcggtgagaccagagtggggctagttcagtccacgttccttgtcagaggtggccagcaggactgcaactgtcctggggtttggccctcactggttggcttgtttacctgccatttacaaacaggtccttgatagctcgtagcagggagggacagcctgctgctgagcccagccccccagcaagtgggccttggacacagggtgctttggcaacagaatgagcttgcttgctgcctctctcaattttgtgtgcctgcgtgccaggggacacattctttctgcattccaggaaggtggcctggtacagccctgctggcccaagcactgctctgtgctgtcctctctgagtcctgctttggagccagtccttcaggggcctcccacctgtggttcagactggaaagaggggacaggcaccgcagacctgcagcacaccccagcatggccaggagccctgtgcccagcacagcaaggcctaggctgccactgctgtcccgggtgagggcgggaaacaggcaggagtaaatgctgcctcctactggagcttggtggacttggcaggcgagtgctgctgcagtggggctcagcatgggcagaatgtttccaaggcaggattcggagcccgcggtctgactgctaatcagaggggtcaaagtgcacggcaggccattctcccccactccccaccccacacacaccgcaggccattctcccccactccctaccccacacacaccgcaggccattctcccccactccccaccctacacacaccgcaggccattctcccccactccccaccccacacacaccacaggccattctctcccactccccaccccacacataccacaggccattctccctcactccctaccctgtcctctgccctgccaagggttctggtggatcccagctgctctccacccctgcagtggtgcaaccctagctgactcctaggcaggagtggcacctgcgtaaccgaagccagcaccctgagtgctgggaagggaggggctgcaagccaggcctgggaaatggagcattcccggtccagagctgctgcaggccccgggaaagggacttctgagctgcaaggtcgtttggatgtcttcccccacccgcatcacacacatctaagtgggtggaagccggcttccccggctccctcccctccatcctccatgctgggtgagtgttgtttttttttcctgctgcagcctctggcccagaggagtttgctgcagagtcaaggctgctgcacaggccggagggggtggggaggaggaaaggaagacgcgatctggttcccagctccctctcagcctgacctggggtgctcctcctgtgcgtcccagtccgtgagcccctgagagtcacagcccccctgggtaccctggctggggtctcgaagcagcatgggccataaaaggagagtcactgagcctccttcatcccagagatgaccctggctggccctcatcatggcatcgggagggctctgcagacaggcgggcccatgtgattaatgggctgtgttcagctgtctgggtccggctgccttttctgtcgggagtgctggaattggaactgaggtcttggcacctcagagcctgagcctctaaccactgagctccacagcctccccagctggccaggccctcagcagttggcctccctgctggaacgcactcagggccagtctccttgctgccctagtttcccctctgtgtagaaggcctgctgttgttgttgttgttgttgttgttgttgttgttgttagaaagaaggagggagacttcctgaggacatcactgctgggagggtccctgtcctgacatgggggaaaggagcctgatgcttgcccacctctgagggctggagtgaccgttcagtgcctctcaccgagggaccagggcatccagggtccttccaggcacacaccagctgtcccgccttccagcctggtgtgccagaaggggccaggagctcactcagcagggccggttccccttcccgccccctctgcagagctgtctgcaaggtgagcccagggcagctgccggatctcctgtccagagagagcaccagcaagcacactgtgctctccttggccctcacctctttttatttttagtaatcccagaaggtgttgatggggattgcagctggctcttagttgtcttttttttttttttttaatctatttttgttgagaaaacctggatttcccacaatgtggaagcaacgaggaaggggtttctggtcccggttctgaaggctgtgaccttcagcgcacatctatacaatgctgatagccccggcacctctctctctcgggtagttctaaggattaaatcagataatgcacacggaaatacgttacaaatggaagtgttgttgttcttccaagtttgcaaggagaggcagcggcagtgttcttgcagtgtgtctgagttccacgtgacttatattggattattatataaatcctgtaattgatctgtcatacttttatgtccattctttatgtcatatttctctctcacatatacatacacagttgtatacatacttaaatctctatgtattagcagtctgcacaacatataccttttaatatttatatttctgttcagttctgttcataccacagaatatgtgttataaactcttttattaagctttttggttgtttctagttttttgctattttattattattatcttggagtcttgttatgttacccaggctggtcttgaacgcctggtctcaagtgatcctctcttgctttaacctcccaaatagctgagactacaggagtgccccacctccccggcttctatcttagatggtactttgtgagctttttttaaaattgagatacaatgcacataccacaaaatttacgcttttaaaatataaaattaagtggtttttagtatatttacaaagttatgcaactactatctaattcgagaacatttatgagcattttaaaaaacatattccctttaagtatatacttcggcagtagaatgacggggccaaaggggagaagtgctttctagctgttactctctgttatgagtctgagcagcacagctggcgggcacagccatggcccccctgctttgtcatcctctgaccttggacgagctctggatgtgcacaggtgggagccaagtttacagggggtctttcctcccagtgtccaccctggttgtgcttttctctatccttttcatatactgatgggtttcaaccctcaactttcaacccgggaaaatacactaggagccaatatagatcatttttaggagaaatcagtccacaataacgggcagtaactagaaaagatcaacatcagcaggagggccagcccctcgcctcctgtccttgcactcagctgcatggcctcttcccagggaggtgccaggccacagtcccagtcactgcattaaactctgaaaagacggagccaaccaggcaaagtccataaatctacaggccgtgttaaacacaggcgcaccccctgaagcttgaaattaaggaataaaggaagctctcttttacccagcaggtagtaaacccgtggaatgcattctttttgagaattgagagaggataaaaataggaaaggggccgcttagggattcgctacattaatgaatagtaagcagataacagggcttttagggactctgttgtgttcccttcatcaaaaattcatctgtttttaaagctttaagtatgctgttgacatataaatccactgtaattcattgattggaagacatttttttcatatttggacgtctctgaagttgggtttatccttaatagggtgacatagtggaactggaaacccttttctttcttaggggttataaaacagcgatgcttccgccactgatggcatttcaggtttgatgaaatccagtttatctccagtgtgcgttgtctccccaggccctagtttatacctccagccgccttttagatcatttcatggggtgttgcaccatcccttcagattcagcagatttagaatgaaaaccatcactgcatttttctcatgaaataccaactgtgttttctaacctctttatttcaaatgggaacagtgctctctgagtgaccaggctggtagcccttctcttacagcatctgtcataagaaaaattccaaccagtctttatcagtgtttcctgtgtgctagccactgttccaagccctgtgtggatattaactccttcaggcccacagaagccctgtaagggaggtgcggggattgttgcttgttcgtatgtgaggtgatgtcagttgctggagatcacagggctgaaagatggcagagccggtatttaaaccggggcaggctgggcacgggggcttatacctgtaatcccagcactttgggaggccgagacgggtggatcacttgaggtcaggcgttcaagaccagcctggtcaaatggtgaaaccccatctccactaaaaatacaaaaattatccaggcatggtagtttgtgcctgtaatcccagctactcgggaggctgaggcaggagaattgcttgaacccaggaggcgaaggttacagtgagccaagatcgcgccactgcactgcagcctgggtaatggggagactccatctccaataaaataaaacaaaataagataagataaaataagataaaataaactggagcagcctggctccagagaccacactccagatcacagctctgtaccaccattcaaggatccagccagtcaccaagtagtttgtattcatctgctataataacttctttgcagttcactgtgacttcgttccctcctacctttgttacttcctttgatggcagcaaaggctgcctcactgatttcactaccaccagtcccatcctgttcatcttggaggtcgcagacagcttcatcttcctgaagtacctctttcgtgcttctgcttccctgttctaaaaccttttttaaaaagttttattgagctgtaactcacaaatcctactacactttacccagttaaggtggacaggccagtgagctttcgtgtattcacagagttgtgtgtcagtaccacaatcaattttaggacatgttcatcacggcaaaggaagccctgtaccccttcgttgtcatcccacaatttccccctctccccagctcctggcaaccacagaaatgcattctctctgcggggttgcctgttctggatattttgtacatataggatcatacggtgtgtggtttccatcagttagcatcctgagttcagagttcacccatgttctagcatgtaccagcacttcatttctttttactgctgaataatatcttattgtatagatataccataatttatccagtcaccagttagtggacatttgggttgcctctactttttggctgttatatataatgctgcaatgagcattcatgtacaagcttttgtgtggacctgcatttttatttctcttgagtataaacccaggagtggggttgctggaggatcatgactctgtttaactgtttgaggccaataactcttatttatttatttattttttattttttatttttggagacagggtctttatctgtcgccctggctggagtgcagtggtgcaatcatagcccactgcagcctcgacctcctaggcttaagtgatcctcccacctcagcctcccaagtagctgggaccacaggtgtatttcaccatgcccagctaatttttgtattttttgtagagatggggttttgccatgttgcctaggctggtcttgaactcctggactcaggagatctgcccacctcagcctcccaaagtgctgggattacaagcataagccactgtgccaggccttaggtccctttcaaatgcaagatattcctgattttcctgttctattattgcaggggaagggaagaattgtctttttacattctcccgaaaaggagaattggaagatttggtcaccctgggcccacactcctgtgaggcaccacctgaatgcacctgaggtacttaactgtacctctgagggacaccagccttactccatccttttcgcttttgctggccccggtaggcattggaatctctgagctttgccctagacccctccttccagaagctcagccggcttcttcattgtgctctgtttctaaaggccagtggtgcccacgccactcaacttcacaccgttctgttgtagggttgaagagtgggtaattaaaagggaaatgttttggtggtaagaattgcaggctctgggtcgaactgcctgggtttgaagctatttttacctctttaccagctgtgtgtgaccttgggtaagttatccaacctctctgaacttcaggttccttatattttaaaataggggaaatagaggggcctccttatatgttgttattctgaggataaatggactgatccacaaacattgctggcatcagtttctctttttctggatgtcttctcaacaatagcacaagaacttgaaggccacaacactacagagctgggggatctcagccattgttttcccagtggagaccactcttggcattttggttggcacagttgggctggacttcctgctcatttcaaggtttagtatccctggacagagctgcaccctctagctcctggttgttatggccggggacagagtgccttcctacgagtggctgccggcttcatttcttgccccccaacactggtgctgctgtcgggaatggcatatcgggctggattcagggcaggttgttcccccagccatgacctggacatgcttgctgtctggttggcccgagagtgcacaccaccaacctggtcagggcaggtgcccaggactggcgccatggacccagagtggctgctgggaggggagcatgctgggctcagcaggcctgaacttaggatctgctgctttttgtctgttggaattaaatgttaactagatactaggtaaatttaaagtttacagaatgcatggaagagatacagaactatggtataagaaacggggatgcacctaccacccgtttttaaaaaagaatttgattctcctgcgtgtccctccccacgttctgacctatttcctcatcttacacttccaaattgtggatagattattccctcgcttctctttctgtttccatgcacgcctggttccctaaacaacctgttgtttaattttgaacaagagtcatcctgtatgtgtccgagcatggatctttttgtctctgtgtccagcatttgggagaatcgcctcagctctgtcttctgctagctgactctttacagctgtttctcatctgtaaggcccatctactgaatttctagtttccaattatatttttcatttattgaagttctgtttattttggtcactttatatcctgttttctttttctttcttttttttttttgagacagggtctcatgcggtgttgtccagatggggtgcagtggcaggttcacagctcactgcagccttgacctcctgggctcaagcaatcctcccaccccagcctcccaaatagttgggaccacacttggctaattttttttttttaattttttgtagaaacagggtctcactttgttgcccaagatggtcttgaactcctggactctgggctcaagtgatcctcctgccttggcctcccaaagtgctgggattaccagcatgagccagtccgcctggcctatatcctattttcaagttaatttttattttatcaaagtaatcatgttgctttctcaccacattacgtcttggaggtttatccgtgacaatgtgtggatcttcattttctctgctgtccactgtctgaacgtagtgctgtgttaggggctagggatgcagcagagggcagatgccactcagatggagcctccctcgtagtggggaagaaagagaaacaggcctgaattacagtcagctgggctagaagaagccagggcccctcagaaggggtaggccaaagctcctagaagctgagcccttaaggatgactgggagtttgctgggtgaacaaacaaatcccaggttaggggtcctacgtgcagaagcctttgagaaatgatggctcctcgtgtctgaggccaggctctctctgtaggtgagggtgtgaggagacttgggcattggaactctcctgcgaggtggtatgcgttggaaccctgatctctgggactgtcctgtatattcgagtcaccgataatcagtgctcaccggggttcagcctcagaggagggagtggagcggagctcgtggttaagcagtgtctgcttctgcccccgcgcctggtcacctgcctccttcctcactcgcggagcaggagtgatcacggtgcctgcgtgcagggtctttgtgagtatggggaggagcggcgcgggccggggctgctgtcagcgttggtgttgttatgctggtgttgttacgttgctattgttacaccggtgttgttacgccagtgttgttatgttgctgttgttacgctggtggtgttatgttggtgttgttacatcagtgttgttacgttgctgttgttacacccgtgttgttacgttgttataccgatattgttacgccagggttgttacattgttgttacaccagtgttatgttgttgttacactggtgttgtcattcttatcccagtgttgttatgttgttatgtcagtgttaatgttgctgttgttatgctgttgttacaccagtgttatgttgttgttacaccggtgttgtacaccattgttatgccggtgttgtgttgttacactggtgttatgttgctgttacaccagtgttgttacattgctgttaagctggtgttatattgttatgctggtgttgtaacattgctgttaacaccgttgttatgttgctgttatgccggtgttgtgccagtgttatgccggtgttgttttgttgttgttacgctggtgttacattgttacaccagtgttatgttgttgttacaccggtgttgttatgttgctgctgttacatcggtgttgttacattgttatgctggtgttgttatgttgttgttacaccagtgttgttacattgctgttgttactctggtgttgttatgttgttgttatgctggtgttgtgttactgttgttatgttgttgttacgctggtgttgttatgttgctgttgttacatcggtgttatgttgttatgccagtgttacattgctgttacgatgatggtgttatgttgctgttgttacactgatgttttttgtttgtttgtttttgtttttgaggcagagtctcgctctgtcgcccaggctggagtgtagtggtgcgatctcagctcactgcaagctctgcctcctgggttcacgccattctcctgcctcagcctcccaagtagctgggactacaggcgcccgccaccacgcccagctaattttttgtattttttagtagagacggggtttcaccatgttaggatggtctcgatctcctgacctcgtgatccgcctgccttggcctcccaaagtgctgggattatgggcgtgagccaccatgcctggccacaccggtgttgttatgttgctgttgttacaccagtgttgttatgttgttgttacactggtgttgtatggttacaccattgttgcgccagtgttgtgttgttgttacactggtggtggtgttacaacaacttgttgttacaccagtgttatgttgctgttaagccagtgttgttatgttgttatgctggtgttgttatattgttgttacgccagtgttgttacgttgctgttatgctggtgttatgtggttgttacactagtattatgttgctgttattccagtgttgttacattgtcacaccagtgttgttacgttgctgttacaatggtgttatattgctgttattaagctggtgttacgttgttgttatgctggtgttgttacattgctcttaacaccggtgttatgttgctgttgttacgccagtgttgttatattgttgttacaccggtgttatgttgctgttgttacactggtgttacattgttgttacaccagtgttgttatgttgctgttgttacggtggtgttatgttgttatgctggtgttgttttgttgttgttatgctggtgttacgccggtgttatgttgttgttacaccagtgttatgttgctgttgttacgccagtgttgttacgttgttgttatgctggtggtgttatgttgctgttgttactctgctgttatgttgttgttacactggtattatgttactgttgttatgttgttatgctggtgttgttgcactgctgttatgctggtgttatgttgttactccggtgttgttacgttgctgttgttacgccggtgtcgttatgttgttacgccagtgttgttacgttgctgttagctggtgttatattgctgttgttaagctggtgttatgttgttgttatgctggtgttgttacattgctgttgacactggtgttgctgttgttacgccagtgttatgtcgttacaccagtgctgttatgttgtcgttacgccagtgctgttatgttgctgttgttacgccagtgttgttatattgttgttacaccagtgttatgttgctgttgttacactggtgttgcattgttgttacaccagtgttgttatgttgctgttgttacggtggtgttatgttgttatgctggtgttgttttgttgttgttatgctggtgttatgttgttacaccagtgttatgttgctgttacgccagtgttgttacgttgctgttgttacaccagtgttgttacgttgctgctgttatgttgccgttgttactctgctgttgttatgttgttgttacactggtgttgcactgctgttattctgatgttgttatgttacgccaatgttgttatgttgctgttgttacattggtgttgttatgttgttgttacgctggtgttgctgcactgctgttatgctggtgttgtgttgttaggctggtgttgttatgttgctgttgttatgctggtcgtgctgctccatgttctccaggtgttcttcccttttatcgtcacagttaccccgtacacctgacaactggacatctgcgcctgggggtcttcagcctaaacacacctaaaccctccaccaaacccctctgcttccgcctccccgtgtctgtgagcgcctccactgcccatccctctgctcaggccccacttccagggctcatgttgggggcctccattttgctcacacccaccccatctgtcagcaggtccagtcaatcctgactctggggtgcctctccctcccctccagctcctgtactgcccattagtccaggccctgtcgtctctgctgggcagctgtgcagcctcttccttgccttccctgcatctgcacccattctccccccaagaccaggggtcgatccccaatataggtcaggtctcgtcttctcctgcctcagatcctccagtgtcccccctacaactgatcttagaaaaaagtccagcctcttcgccttatcctgcaagacccctgatctcctctccagcctcaccgctgtccccactctttgctcacctccatctggcccccagcacaccaagttccttcctgcctcggggctttggcacctgagggtccctgcagctgagatgctttctccctggctttttgcgaggctggctcttcaggtctcggaggggccttttcattaccctctgtcacaactgctctgtaattttgtttacttccttttctcttcttcccactttccctccctcccactcccctgcacattgcctggcacaggtgtgcgcccggtagtgaggtggcacttgttagtctcatccaagggcaggatgcaggaacaaaagtcaagtaacttacccaagatcacatgctagtaagtggcagtcatactctggggtgctgcagcccccgccatggtgccatagcccccacagtgccgagcctcctactggcagtggccaggcagggcggggcgaggggctggccagtatctacagaggcaatctggcctttgctgggaatagagctttcttcatgtggatttctgtagaggctcacggatttgacgccttctcttacagtagttctcattgacagaggtggcttcaagacttcctccctcccttctcgtggtgaggttggctttggtgtgcaccatttttataggccctgtggactgggggaagaggatgcaggatgaatgtgcgggctggggttttggtgcacctcggggagatctgatgttctggcctctctttagatcctccccacttctccacctccctccaccaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcaggtgggccctggggctgggcatggggcactgggctgcccacttcgccgggagcagctttccaaatgcagacgcccttgggtggagtggaggggacttgaggtgggatttcccccagggtgctcggaggcaaggatggcattcccctgtctccctggcctcctaccagcctaaagtggcaggccagctggtggtgccctcagggcgaaggacatcccaatggccatggcctcgtgtcagccccagttcagtcccagatgcttcccaagggtttgtcgtgcgaggctcagacagacctggttcctgcctcatagggtctccccagtgaggccgcaagccttttgcctggccacagctggagacacttccagcggccaagtgccatgccagggctgtcctctgggcagttccagagacccagggctttctgggagaggctggctcctcaccaggtagcagccaggcagtaagagccacagctgcctgttgagcacgcgccgtatgccaggtgctttatagatgcctctcatacaagcctcacgcaccaaccacgaggcaggggccattagccccgttttacaggtgaggaaacgtaaggctcggtgaagtcgtcagaatgaaccaggcttggaacttgggcatggaatactgtcagcccctggctcttgccaccaggccttgtccctccttgccaacaccccacccacgggcctctgcttggtgactctctcctcaccccgcacctctgaccctgcgtcgggtgcatcctgaatgcttcacaagcaggagggaagcacgtttctctgtaggaccccctgacccctcaaatacctaagagtcagggtcccccaccccacttgcccccactgtggggcgtcctttagagtctccaggttggatgctctcagcccggttctcctttcctgggggaccataactctaagaggggcctcaatgaaggcaggtgtcaaagccatagagatagccccagaggccggttttcaagcatggactgggaagagaaggtcatggaagagatgccaggcgaggggtgagcatggcaaggcgaggggcttccctgaggcagggggacgcccagaggagccggcaaggagaggagagggctggccggagagtcctggtctgtgccagagagtcaccctctgctgttccctcaccccagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctctttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcc

SEQ ID NO: 13251 - DNA, 11211 bp, Human
  misc_feature (1)...(11211): n = A,T,C or G
gcgagaaagtagagcgactggacctctcttgtatttctgggggagtgtaaattggtagagacattttggaaaactggcagttttctaatgaagccgaacatatgccacctctgtgatccagcagttccactcctaggctgtcaacacccagcagaaatgtgtaggtgtgagcatcaagagggtgcatgggaatgttcagagccctttcataacagccccaaactggaaataacccatcaacagaatggaaaatgaatgatgccctactcactaccatgcacatagacacagcaacgggattgacatgcccggctacacacagcaacatagacaagtcgcatgatgaaatcttgagtgacagaagccaaatgcaacagtacatactagatggttccaggtgtattacgttcagaaccagacaaaactaatttatagtgcaccaaagtcaagatagtgatcgcccttagggttgggaggggacgaggggagagcttctgggagctgatccagttctgttgtgtaatctggtgctggttccctgggcatatgtattctgtgaaaatccatcacatgacttaaataaaatgtacattacttaaataaaatgagtgtgtctttgttgactttatttgaggctggcttgtcagcagataagaccatgtcaaaatttgtgctgctgttgtgtgtgtgtgtgtgtttcaaggtgtggctgttgtgtctgtgaatttgggcgtgaccatgtccagaggttaagggtataaggggttaggagcatggttaagacagcatttttttgagccaagctgcttaggtaaaatcccagttgtgccacacctaactgtgttaccctggacaagtcacttctctctattccgcatctataacacaggagttagttaatgtgcatatggctcttagaacagtgcccagcacatggtaaatgcccaataaatatttacagttaatacacatgtgattgtgggccctaccaattgtctggctcaattctatctgctgtgccctctccagttaaactctttcttcttttattccagcaattgtctgctcacggcaatacacacacccactcacacgaacacacgcacacacatgcacgcgcacatgcacacacgcgcacacctgcacactcacacgcacacaaatccactcgcacacacgcatgctcacacgcacacacgtccgcatgcacgcacacacgcagacacacgcaagcgcacacacacacgggcctcctcgtcttcattcacaaaccccattagcttctgttgtctatgggcttcctcgacagaccgcgagcccctcgcggggcgcagaaaccaagtatggatcatccctatgtgccttcctttccgtctacaccaggttaatggggttgacgtatgggtgtgacttcctgtccaggtctctgtagcttgttctcctgggggtggggggcggggtgtgattgttactaggcctgctaagaagaggagagcagtgtatctgtctccctcctggtgggtgtgacaatgagattggaagccatctaagataggccaggagatgtatgtctggacaaacatgccccaagcctgacggcccccatcgtagcctccctcgcaagccgcgccccagactagagagagggcctgcgcattcctgtcctgccagtccggcagttccctctcctgtctcctcagctttacacccaaagcagccgctgcctcaggtccaagcctgagcccgcggcagaacattgggctgcctcccaggccctgacacccccagccccgaggtcctgtccacccggcagacaacttgccttccccctcgggccccttcccccactaggccccacggacgaggagctgagctcagggccaaggaatcctgtctcaaaagggggggtaggatgaaatgtttggggtctgggctctgattggctgcgcccgggccacgcccccagccctttcccctttctcccccctcgaaaggggggcgtgaagggagccgggatcagccaggggccagcatgagccggagggagggaagtctgggtaaggggctgagggaccggacgccgggtcgctgaggggcgcaggagtcagagggattgggagctgggggtctgggtttccgccacccccgggtccgggaggggagcggccttggcggggaagggcagggctccggtgtcaggtaacgagtgagcgggtgagttgtgagaaacagcaggcgctagggtttagaggaggcctggggctgaggtttcagggacctgggctcagggcttagatcaccggttcgagtacacccagggggaggactggggtcggggctggggcaggacccctgcgtccactgagtctcgggaaagaatcagagctggggggctgaaggaaggggtagagtaagggaaggcagtcttggagtcacaggaagtagtgagtgacaacaggagacgaaagtctgggctgctgaggatcgcgactggtgctgggaaacttcgggggtggggcgggggcggggcaccgggtcaggactacattccccagcacgcatcgggcgcgcgctgtgcgtttcgggaaatggagtccctcccggggcgccagacactggctcttgcggaccttgattcgctgactagccaggccagcgccttgcatggatggggcatcagggagagaaatggaaatggaagtcagtctccctatctgtaaaatgggccttcaaggcacattttgatatgaagttctgtacttcgatgatgttgaagtccactagcagtcactgaggtagaaatatgtaagccctgtcttcaaagggctctcaggctaaggcagatacacacagaaaagccgttaaaagagctaccctggaactcatgcaaatggccttaagtcaaaggaaggagttcgtttataaaggagaagtgattctggaggcttcactgaggaggcagtacagtcatgcactgcataacaacatttggtcaacaggtggaccgcacagacaatggaggtcccataagattctatgcatttttagcctgggcaacatggcgaaaccctgtctctacaaaaaaatacaaaaattaaccgggcatggtggcgcatgcctgtagtcccagctacacaggagacccaggcgggaggatcgcttgagcccaggaggtcgaggctgcagtgagccaagattgcaccactgcaccccatcctgggcgaaagagcaagactccgtctctctctctctctctctttctcttttgggatggagtctttctctgttgccaggctggagtgcagtggcctcggcnnnnnnnnnnnnnnnnnnnncatttgttcacttattcattcatttattcagtcaatgtatattgagttcttcctatgtgttgagtacctactatactatgtagattggacatggacaaacctgtgttctcaaggaggttgtggtctcaatttaggataggagacattctttatggcattgatgaagtctgagtgtgtctagaaacaatctcaatattccttgacactagactaagttatagctggggctcagggccgggggagccaaaacaaaaaatgaaggaaggacaccagttagtggtgtcctttttatttatttttatttatttatttttttgacacagagtctctatctctgttgccaggctggagtacagtggtgcgatcttggctcactgcaacctccacctcccgggttcaggctattctcctacctcagcctcccgagtagctgggactataggtgcgtgccatcacactcagctaattttttttttttttgtatttttagtagagatgaggtttcatcatgttggctaggatggtattgatctcttgacctcgtgatccacctgcctcagccctccaaagtgctaggattacaggcgtgagccactgcgcctggacaatttttttttttttttttgagacgaagtctcggtctgtcacccaggctggagtgcagtgacctgatctcagctcaatgcaacctcctcctcccaggttcaagcgattctcatgcctcaggccccctggtagctgggattacaggcacccaccatcatgcctgactaatttttgtatttttagtagagacagggtttcaccagatggtcccgaactcctgacttgaagtgatccgcccgcctcatcctcccaaagtgtgggattaaaggcgtgaaccactgagcccaatgcctggctaatttttgtatttttagtagaaacggggtttcaccatgttggccaggctggtctcaaactcctgacctcaagtgatctgcccatctcgggctcccaaagtgctgggattacaggcgtgagccaccacgcctaaccgatatatattatataataaaatacatacctatatatgtattttaactgtagcttttctatgtttttatttatttatttatttagagatagggtcttactctgttgcccaggctggagtgcagtggcacactcacagctcactgcagcctcgacctcccggggttcaagtgatcctctcatctcagcctctcaattagctgggactaccggcatgtgccactatgcctggcttatatttgtattttttgtaaagatggggtttcaccatatcgcccaggctggtcccaaactcctgggctcaaacaatccacctgccttggcctcccgaaatgctaagattacagacatcagcaatctcacctggcccttttctatgtttagatacacaaataccactgtgttccagttgcctgctgtactgtaacatgctgtccaggtctgcagcctaggaacaattgactaacaccacatagcctgggcgtgtagcaggctgtaccacctaggtttgtgtaaatacactctacgatgtatttacgtactctacgatgaaatcgcctaaggatgcatttctcagaatgtatccatgttgttaagcaaggcatgactgtctttgaatttgactttaataggatttcaacagtgatttggggacaggcaatacatttcaggtagaccacctgcttgacaaagttctggtgcctcattttccttcagttggaatgggacagaccctgatggggtcaggaacaaagagccagcgtgggagaggtgatcaatgagcaggaggttggccatcctcattcctcccccctttcccaccagaagacccccagactgattcctcagtctcacttcttccccacttggaggccaagatccgtcagacacacagccttgcgcacctcctcaccaaatacgctgagcagctgctccaggaatatgtgagtgggaatgggggtgggggtgccgggggcctggggaatgggagcagacatcacagaggtcctcgatcacccattctctcaacctcattttccaactgtggaaatcagggctcctgagagggacagcaacttgcccctggccacacagcaaattggaagaggaccctgtctgtgacccagatgccactctgtcctctccagcttagaggcaccctcctcagtgctttgtttttgagaggaggcctcgctctgtcgcccaggctggagtgcagtggtgccattatggctcattgcagcctcaacctcctgggcttaagcaatcctcctgccttagcctctcaagtaggtggggccacaggcacacaccatcatgcctgggtaattttttcattattttgtagaggcagggtcttgctgtattgcccaggctggtcttgaactcctgggctcaagtgaccttggtgctttaagtcagaggtagccaggtagcctggggcagtgaagagaactctgatctgtatctcaggaaaccgaggttctaggctctgcgtgaccttgacacctcccctccatgggccttggtctctccccaacagtaaaaggaggcagctaaatatgattaactctgaactctcccacctgggatattcagggaagccaagaagaggttccaatctggagcaacagttatcccaagagggcactttcacagaagacagggatctgctgacatctttagttgggcagaggaccctgcccaaggaaagaaaatatttccccaaattaccctcgtgtagtgaagggagggtatagctttgaatcagactgcaggcctgccaacttgttaactgtgagcttgggcagtaacaataacattaaaaataataatgtaacaattatggcagcggatagtgggagaatagtggcataatagaactagctttgggctgggtgcgttggctcatgcctgtaatcccattgcttttggaggctgaggcaggaggattgcttgagctcgggagttcgagaccagcctgggtaacacagtgagccctcatctcttaaaaaagaaaagaataaaagaaaagaaaataaaaaggaaaagaaaaaaatagccaggcgtggtggtgtatgcctgtggttccatctactcaggaggctgagtgtggaggattgcttgagccctggaggctgtgtgatcaaaccattgctctccacccttggcgacagtgtgagaccccatctatttaaaacaaacaaagaaaactagctttgtactgctatgaactttggttcaaattccagctctgccacttcctagggtaagtcactatagtcactgtatctccagcccaacattttttttttttttttgaaatggagtttcgctcttgtggcccaggttggagtgcaatggtgcgatctcagttcactgcaacctccgcctcccaggttcaagggattcttctgcctcagtctcctgagtagctgggattacagtcaccaccaccatatctggctaatttttgtatttttagtagagatagggtttcaccatgttggccaggtgggtcttgaactcctgacttcagctgatctgcctgccttggcctcccagagtgcctggattacaggcgtgagtcaccgtgcccagccccacatttatctttcatttgttcattcatatgatgttgattcattgagcccctgctcaatgcaggtacagaggttggggaggatagggaagggaatgaagcccccttggcccctggactatcttatatgatttccatgaagacaggacaggaagcttccccattcattgtacagatgagaaggctgaggctcagagaagggaagtggttttgccccaaactgcacagctagtaagtggtgaagataggatttgaactctggtctgtaaggtaactttaataaaagagctgacatttttactgaactcttcctgggaccaggccctgtcttgaacacttgacatggtcataactgctttatgaagttgctgctgttattaggtcctatttatttatttattgagacagggtctgactctcacccaggctggagggcagtggtgccatcatagctcattgaagccttgacctcctgggctcaagcaatcctcccacctcagcctcagcctccggaacagctggaactacagacatgcgccaccacactcgctattttttttttttttttttttttttagagctgtggtcttgctgtgttgcctaggctggtctcgaacccctgggctcaagtgattatctcaccttggcctcccaaagtgctgacctaaactggcccagtctgggtccagtttagggaggaagaaacaggcattggtgtcaagcgcatgccactttgttttgccttaaacagagcagctctgttaggagggattatcatctgcaagatgaggaaactgacacccccagagagcgggttggagagcccagttaacagccccctgcccgtgctccggggccccgctgacccgccggccgtgtctccgcaggtgcagctccagggagaccccttcgggctgcccagcttctcgccgccgcggctgccggtggccggcctgagcgccccggctccgagccacgcggggctgccagtgcacgagcggctgcggctggacgcggcggcctggccgcgctgcccccgctgctggacgcagtgtgtcgccgccaggccgagctgaacccgcgcgcgccggcctgcgccgcctggaggacgcggcggccaggcccgggccctgggcgccgcgtggagccttgctggcgcgctgggcgcgccaaccgcgggccccggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggccgtctctctgtgcttccctggccaggggcgtgcctgctggtcctatggggggaaggctactccgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaagaaactaaagttacttgtatatatagttgttgaaaatggggagacagctttagggagaaaaggacccttgggatgcagcctagtcccccagacatgcccaagaagcccagcagtataaataggaggctgacagcccctggccagtggtgccctctgccagcccagaacaggaagtggatgtgtcctaacaggaaacagatgtgatgcagtccttagttcttcaagaattgggcttccatggatcaggaagtggagcccctgaggacaggaagtggaacagtagccccagagagacaggccaaggaggggagccaatgaacttcagcaggaagaaggaagcctatccgcttagaaaggcgggctcttcatacagcgaatgaggcagacagagacaggaaggcagccccaaccgtcccaaaattacaaaaaagggaaggtctcagggagagcctaggaaggggaccaactgtcctctccctgtagagtgacaggtgaagcctctttggagaggtgcatctttccaaccaggaagtggacacccagtaccactggatgggtaacccatggaatggcatccatggaggttgacccagacctagaacgcaggccagaggacctgggccggaaggccctgaaataaggaaattgaggcctggctcccaggaaatattcccatacatggcacccaagccccatctgctagatgaggtttatctccttttctagcccacaagcaaggcagaaaagaggccattgtgaaagaggaagtgctgcagcctctgacaggaagtcctacccctctatgctgagtacttagccttgagcagagccaagtctctcacagctcggtctgtccagtggccatattcccgggtcaccacgtagcctcgacatttcctctcaaaggccgaggccccaaaggcagcaagccctagagtatcctcttctggggggattggcagccccagggccgtcatgatggcggccatattgcccagcaggccttgggccctgagtctcgcagccccgagctgagccggcaggatgggactgccagggttcaggtcgctctggtcgtcctccacgagctggaggtgctgggtcaatggccctctgggcaaggctcagccgttccccgtcatccagggcgtgccaggtcttaaagaaggcggtggcaggaggcaggctgctgagctggagctcaggggctgagaagccagggtcactaaaggggctgccctggtactggagctgcaggagggacagagacagacaggagtgaggggaccagagcggtgcctgggactctgacttcacgcctgcccactgagactggcttcttcccaggagtcgtcacttgctgcatctcagggagctgctgggatgtcctgacacagggcaagggccctaggaggctcaggtgtgtcatcctctgcacgctagctgtgcaacgtggagtcacaagcttcagaaattcccacctggcagtgttatgaagattataggaaataatatatataaagcccttagcaggccgggcacggtggctcacagctgtaatgctggcactttgggaagccgagatgggtagatcacttgaggtcaggagtttgagaccagcctggttaatatgccaaaaccctgtctctactaaaaatacaaaacttagccagctgtggcagtgcacgccttctatgccagctactcaggaggctgaggcacgagaatcacttgaacccaggaggcagaggttgcagtgagccgagatcataccactgcactctagcctgggcgacagagtgaaactgtaaaaaaaaaaaaaaaaaaagcacttagcacagagtctaatatacaatacagcatctgatatacaataagggtgtgataagccat

SEQ ID NO: 13252 - DNA, 10148 bp, Human
ctgcgccccgcgaggggctcgcggtctgtcgaggaagcccatagacaacagaagctaatggggtttgtgaatgaagacgaggaggcccgtgtgtgtgtgcgcttgcgtgtgtctgcgtgtgtgcgtgcatgcggacgtgtgtgcgtgtgagcatgcgtgtgtgcgagtggatttgtgtgcgtgtgagtgtgcaggtgtgcgcgtgtgtgcatgtgcgcgtgcatgtgtgtgcgtgtgttcgtgtgagtgggtgtgtgtattgccgtgagcagacaattgctggaataaaagaagaaagagtttaactggagagggcacagcagatagaattgagccagacaattggtagggcccacaatcacatgtgtattaactgtaaatatttattgggcatttaccatgtgctgggcactgttctaagagccatatgcacattaactaactcctgtgttatagatgcggaatagagagaagtgacttgtccagggtaacacagttaggtgtggcacaactgggattttacctaagcagcttggctcaaaaaaatgctgtcttaaccatgctcctaaccccttatacccttaacctctggacatggtcacgcccaaattcacagacacaacagccacaccttgaaacacacacacacacacaacagcagcacaaattttgacatggtcttatctgctgacaagccagcctcaaataaagtcaacaaagacacactcattttatttaagtaatgtacattttatttaagtcatgtgatggattttcacagaatacatatgcccagggaaccagcaccagattacacaacagaactggatcagctcccagaagctctcccctcgtcccctcccaaccctaagggcgatcactatcttgactttggtgcactataaattagttttgtctggttctgaacgtaatacacctggaaccatctagtatgtactgttgcatttggcttctgtcactcaagatttcatcatgcgacttgtctatgttgctgtgtgtagccgggcatgtcaatcccgttgctgtgtctatgtgcatggtagtgagtagggcatcattcattttccattctgttgatgggttatttccagtttggggctgttatgaaagggctctgaacattcccatgcaccctcttgatgctcacacctacacatttctgctgggtgttgacagcctaggagtggaactgctggatcacagaggtggcatatgttcggcttcattagaaaactgccagttttccaaaatgtctctaccaatttacactcccccagaaatacaagagaggtccagtcgctctactttctcgcctccacacggtgcggtctttttcactttagccattctggtggtggagacccactcgtattcgcagcgcctggagcgtaattggcactcagttaacaagactgttgaatgaatggatgactgagtaagttgggcggtgtagaccaacagcctggcgagggcggacacacgcacgcactccacacacagcgtttcgcggacacccaccgcggctcacgcagcgcaggacacagaccctgtcgcgcaccccgcgcccacgtggtctgaacacacggcctcggccctgcctcgcgcgtccggtcgcaactcccgctctccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcgccaactccaggggggacgcaggccgagagcgcggcgcccggcctggcgcggagcctgagccgccggacgggaggcggcctccgcgcggctcggccccggccccagccccgccagcatggccggccggactgtacgggccgagacccggagccgggccaaggatgacatcaagaaggtgatggcgaccatcgagaaggtccggagatggtgagcgctgctcgggggccagggacgggacacagcgggaccaccagcaccaaaggcgtctacgctgccctcgccagctctgggccccgggtgttcggtgtatctccacccactagctttgccctggatccacagggctctgtccccgttcgcctggctactcctgggggtctacaaagcgtgatccccagccgtgtcctcccagagcgggagccccctcttgtgccccgccccctaaagctttgacacccctcctgcaggtgcgccccaggatctgcagggctctgatcccgggccaggcccatagccacgccccccatgtgtgccccaggggtccgcagagccagggccccaaatcatatcctctctctagaggcacccaccgcctatgccctggggtttgcaggactctcttcctccatgtaactatgccccattagcaaaactgttgctatcctcctgtgcctcctcaacctctgcaggtacccccagatgtgtccagctcctaggggggtgggtctcccctcaggcctctctgacccagccccccaccctcccacagggagaagcgatgggtgactgtgggcgacacttcccttcgtatcttcaagtgggtgccagtggtggatccccaggaggaggtgagcaacccccattcccacaaggccctgcatctgtgcaacctcaggcaagttcctccccacgctgacctctacctccagctccccgagacctcagatgcagcaggacagacgggaaccatcattagcagctcctccccttttgccctcttttctgctccacaccccctgagtttgagcccttttgcttctcagtgcctcagtttccttaggtgtatggtggggctttccaagagctctgaccctaatcctctaacccccaggagcgaaggcgggcaggtggcggggcagagagatcccgtggccgggaacgtcggggcaggggcgccagtccccgagggggtggccctctcatcctgctggatcttaatggtaggtagggatcctgaaacgcggggggctgtggggactgaaggagtgtactagggatctcaggccaaccatctcggctcttgctcccgcagatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagaggtaggaccaggtacctcccaggagctctctcctctaagtcctgtcttctccagagtctaacctaccagctcatccctatacctgctccccgtcttgtgcaccctcctcaaggcgccttccgactcctgcagaatctccctgtagctacagtctcattcctctggtctcttagaatctatacagacatatcactgtctgagattttcatgtaaattaattttttactaatttatctttctcctcactctcatgtcagtttcctgaatgttgggcccatattgatcctttttttttttttttttttttttttttttgagaaagggtctcgctctgtcacccaggctggagtagtatagtggtgtgatcatagctcactgcagccttgaacttcctgggctcaagcgatcctcccgcctcagcctcccaagtagctgggaccacaggcatatgccaccacacctggctaatttttgtattttttgtagagataaggtttcaccatgttgcccaggctggtctcaaactcacttgctcaagcagtcctccaccttcagcctcccaaagtgctgggattacgggtgtgagccatcacacccacacccggccctccccccccttttttttagagacaaggtctctgtcacccaagctggagtactctggtgcaatcatagctcactgcagcctcaaactcctgggctcaagggatcctctggccccagcctcccaaatagctgggactcaggtgtgtgccaccatgcccagccaattcttaaattttttgtagaggtagggtctcgctatgttgccaaggttggttttgaactcgtggcctgaaatgatcctcctgtctcagcctcccaaggtgctgggattataggcgtgagtcactgtgcctggccctatgtgatcttgttcactactgtatcctcagaataatatgggacacatagtaggtgctcagtaaatatctgttgagtgaataaataatagtgatagtcataggggtgattaacaataataggaataacaacagctagtatttattgagctcttactgtgtgctaggtgccctggtaaacactttacgtggttgggtttttttcttttctctttttcttttctttgagagagtttcgctcttgccaaggctggagtgcgacggcacaatcttggctcactgcaaccttcacctcctgggttcaggcaattctcctgcctcagcctcctgggtagctgggaatataggcatgaaccaccatgctcggctggttttgtatttttagtagagttggggtttcgccatgttggccaggctggtctcaaacgcctgacctcaggtgatctgcccgccttggcctcccaaagtgctgggattacgagccaccacgcccagccttttttttttttttttttgagatgaagtcttgctctgttgcccaggctggagagcagtggtacgatcttggctcactgcaaactctgcctcccaggttcaagcgattcttctgcctcagcctcccatgtagctgggattacaggcatgccaccatgcccggctgatttttgttttttttgtttatttgtttgtttgtttttgagacagagtttcattcttgttgcccagactagagtgcaatggcacaatctcagctcaccgcaacctctgcctcccgggttcaagcgattctcccgcctcagcctctcgagtagctgggattataggcatgcaccaccatgccccgctaattttgtatttttagtagagacgaggtttctccatgttggccaggctggtctcgaactcccgacttcaggtgatccgcctgcctcagcctcccaaagtgctgggattacaggcgtgagccaccgtgcctggcctaatttttgtatttttagtaaagatggagtttcaccatgttggcctggctagtctcgtacccctgacctcaggtgatccgcccgcctcggcctcccaaagtgctaggattacaggtgtgagccaccgtgcccagccaacactttacgtgtttttttctcatttaatttttactacaaccttataagggtgatgatcttgttatgatccctatttatagatgaggaaactgagacccagagaagtaactcagccagtgagccagcatcttgggcctgtgtcctcatcagctctgctttttttttttcctttgagatggagtctcactctgtcacctaggctggagtgcagtggcacgatcttgctcactgcaacctccgcctcccaagttcaagcaattctcctgcctcagcctcctgagtagctgggattacaggctgcacaacaccacacccggctaatttttgtatttttagtagagacggggtttcatcatgttggtcaggatggtcttgaactcctgacctcgtgatccacctgcctcggcctcccaaagtgctgggattacaggcttgagccaccgtgcccagccagctctgctttcttccatgcagtcaaacccgtctgattggcacctcttcctcctaggctccctgtccctggccttcccatttctcacccgtttttggttccagctggtctcttctagtcacctccacacagctgccagaacaactttttccttcattttttaagctttgcttttttttttttttttttgagacaaggtctcactctgtcgcccaggctggaatgcagaggcgtgatcacggctcactgcagccttggattcctgggctcagtcagcctcctgagtagctgggactacaggcatgcatcaccatgctcagctaattagtgttgttattctttatagagacagggtcttactatgttgcccaggctggtttcaaactcctaggctcaagcgatccttctgcctcagcctcccagaatgtgaaaccctgtctctactaaaaatacaaaaaatcagcgggacgtggtggcacatgcctgtaatccagctattagggaggctgaggcaggagaatcacttgaacctgggaggcggaggttgcagtgagccgagatcgcgccactgcactccagcctgggggacacagcgagactctgtctcaaaaactaaaacaaacaaacacacaaaaagaaaaccctgatgtgggcctgtggactgggtctgggtctagacagtgccaagcagttgtatacctttgctaatataaaaatggtagcaagcatttattgagcacttactgtgtgccagccactgtgctttacctgcatccgctcatctgaccctcacaacagccacatgaggtaattactatcattatccccattttacagatggggaaactgaggcccatggaaatgaagtagctggcccaaggtcaggatttgaacccaggcagtccaagcccagaatctgtggcaacttagcatgcattccctctgtctcacgtgtcatactttcctgtccaccgcatcaccctcgagctcccacatcagtgttccctcctctgcttcctggggcacagccaggttcctgctctctcctctctgctcccatggccctctgccctctgtgactggggcctgtgaccatctgtttcccccactgtctgtgctgctggcacagagtggctgttcaggggatgtttgttaccttgacgttccagatcccgggggcataactgctggcagcaccgacgaacccccaatgctgaccaaggaggagcctgttccagaactgctggaagctgaggtgagagaggccagaaggctggactcctgggtcttggagggaatgggggatctgggcagtcgaaggcttggagcctgcgtcctgagggcctggaggagaggcagacctgggacagagctgaaggcttaggggctgggttcttgggactgaaaaagaaagggtgtttcagagacaaagtgctgagggctggatcagggctgattgagaccattaaaagcctgacaaagctgggcgtggtggctcacgcctgtaatcccagcactttgggaggcggaggcgggtggatcatgaggtcaggagatcgagaccatcctggctaacacggtgaaaccccgtctctactaaaaatacaaaaattagccgggcgtggtggcacgtgcctgtagtcccagctactcgggaggctaaggcaggagaattgcttgaacccgggaggcggaggctgcagtgagccaggatcgcgccactgtactccagcctgggtgacagagcgagactccttctcaaaaataaataaataaataaagcctgacaaaatcatggcgctcctccatgcattttcaaaaaatatcaaaaaatatctaactgtataattagcataagaaaattccttataaacctctgacatttctcacgaggctacctcgaggcattttcagaaatatcaaatatcaggttcgttcctccacacagtgtcactgtcgttgttgtttttggtgcctgcttcctctgcatcctgggcatctggccctgggcttgcctcccgggcccaggaggggaggggagtggaggctttggagaaggcagaggctcagaggctggacgcctgggttctgtggagctcacgcctgtccacccttcctctccaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaattttgtgtcatgtcatttccccgtcagggctggggagggtctttggagacagttttgtctcatgcaccattgctcagatgtggtcactgaggctctgagaggaccttcctgtagtgacaccacaaggcagagtggggtgggggcttgagccaggaccctgcctctcagtacttcccaggtctgtcctatctcccgaccttcacctcctcctctgggaggcccaggacccctcttcctgctcagccctcgcctgggcctaacaattatcaaaactctgggtagctaggccatgattcttttttttttttttttttttttgagacacagacttgttctgttgcccaggcaggagtgcagtggtgcgatcatggctcactgcagccttgacatcccacctcagcctcccaagtagccgggaccacaggtgtgtgccaccatactcagctaattttatttatttatttatttatttatcactatttttttttagagagttttgctcttgttgcccaggctggagtgcaatggcgcaatctcgcctcactgcaaactctgcctcctgggttcaagcaagtctcctgcctcagcctcctgagtagctgggattagaggtgcctgccaccacgcccggctaatttttgtatttttagtagagactgggttttgccatgttggccaggctggtctcaaactcctgaccacaagtgatttgcccgcctcggcctcccaaagtgctgggattacaggcatgagccaccatgcccagcctgctaattttattttttgtagacatggggtctcgctacattgcccaggctggtcttgaactcctgggctcaagtgttcctcctgccttggcctcctaaagtgttgggattacaggcgtgagccaccgcgcccagcctattcacgtttcatacataataacacagaggcccagagggacttgggggcctgggatgaccaacccattccctgccctgaagaagccactcctccacctgggatgcctggccacacttctggttgggtctaacttatccccatctcaatcaccatctcctccgagaagccttccctgactccaggctcagtgagtttccccttttttgagctccagcaaccccttgggcttcattctccttgtttcatcatttatcaggctgttctgggatccgtggtttgtgtgtctgtcttgtctacgaggctgtgggctcctgaggggtctccacacaacactgggaacagggcagtcccagcagctgcttcatgaataaatgaatacatgaatgggctggggttttccaggcaggcttctctgaggaggtggcatgtgagctgggctctgagacatgaacctctgtgctagaactcaagtcagaagccctggttcaagtcctggctctgttactccctgagtggctctaggcaggctgtttctactctcagccttagtttgttcatctgagcaatgggaacaataactaggcctcatctgccccaggggtttgtgggaagcttcgagtaatataaggccctctcactctgtgcctatagggtcatgtatattggccctatttttatttttaataaagaaagatactgaggttcagagaggaccaaattggaactttaaagaagcattaaaaactgtaggctgggtgtggtggctcacacctgtaatcccaggcctttgagaggcacaggtgggaggactgcttgaggccaggagtttgagaccagcttgagcaacaaagcaagacaaaaatgaaaaaattagccaggcatactggtgcgcgcctgtagtccaagcttcttgggaggctgaggtgggaagattgcttgagcccgggaagttgaggctgcagtgagtgatgattgcaccactgtgctcaaatctgggcaacaaagcaagaccctgtgtctaaacaaacaaaggaaatgtaaggatgcttccgacagcagctgcagtggtgttggtggagccagtgctgtccag

SEQ ID NO: 13253 - DNA, 9117 bp, Human
ggcttaaaacgtacggacacaggctttggtggccccaacgccttaaaaagaaaatgagaaaattttccccttgaaaaattgaatcatttaatgtaaaaccaggttaaacaaggcacatgcctccttcatgggtccagacatttctgggagtctcctgagacctgtctccgtggctctgagggtcaaccaagccttctggcatcaggcaggctgaaagcttgcctggtttccccaatggtgagtgggtttttaaagggccaacttgtggactgctgagcggctataccccacacccccctacatcttgccttctgagtttgccttaattagggaatggggaagtagggttgggggcccgagttcacgtcaaaactgtcaaaggaggtgggggagggggacagagagagaggagtggagaactccctccaggggcaggaaaaattcaaaaatcataaaaggaaaagggggaacttgaagcccagaagtcattgtttcctttatttcaaagggaaaaacctgcccgattctcatccttttgattgattaaggccctgaatacctcgcggccccggagtgacagtccctgaataggctcgagcgaataaagcgcagtgcagagcgcggggctggcactcgggggtgtaaaggaggcgagttcgctggcacttaccaagttataaataaaaggctatgcacaatggtaccttctctaaggacagacagtctttacaacactcctggcgtcatatcctgctggggacacttcagctcctagccaagacttcgttccttttatttttccagcagtttagtctgaatgccataataaattcctgagaacaaacgctgaacccgggcaaaactttaacatacagacacatctctgtcgacgcatcggggatctatatgtagagatttagaaccgcagcttgccagagcggtttttacaccaagaagaggagccaggtttttttctgcaccctcccccatacccccagccttcaactaacgagtgcttgggcctagcgacggctgcctgtgcttcacattagccccgcttgcggacggagaagacaaaagaacatcagcgcaccctggactcctcccaggaggagccccatcgggaggaccccttaacaagcctaggccaaggggcactgaccacaggaaggaaagctaaatatgtctggggccccagatgccttcttattggaattgtgccccctccagtggcagtaagccaagagaaatgagagcgagacctacaggtagaaaaaatgagacatagagagagacacaggaaatcacaagaggaatagaggctgagcgagacacacacacagaggcacagaaagagacagagagggaaatagaaagtcaaggaaagagtgatcagagaaagacacacacacacacacacacacacacagagtgacagagacagagagacagagacagagagacaggaacttctccgccctcagcaactgccatctccctggggctgtctctctcagtttccaccgggccaaccttctctcctgggcaaggggcgcagcgcgggtccccctcggggccagcagaggcctcggcaccaccagagatgggaagagaaagtggtcgctgttgcccaatcagcgcgtgtctccgccacccgggacggtctacccgtcggccaatcgcagctcagggctcctgaccaagctttgggtaaaagaactaataaatgctcccgagcccggatccccgcactcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaaggtaagggagggcctcagcgcgccgcctggatcccagggcctgggaccggctgcctcaccccatccccaggctccgcaggctcctttggtgcttccaggaagcccattccctgggcaccccacaccccaagaagcaccagtcgggggcgaggacctactcgatttcctttctgcaaatggagcgcgctgctctctgcaaatcctggcggagctgggcggtcaggcctgcggcgagccggggagacttgtccctgttgttttggaaatgccgcggtggagaaggaggtgaaccggcttctgagcggcagaagcaacttctccgcaatttgtccattcgaaattgtctcgaagttgtctcgaaattgtcccggctgcgcccacacttgtgaaacatatgttagttcaggaagtattttttttttttttgccctgcaaagttgtggtggctaacgccgcgccattgtgattggaatttttagaataattaaataaattagaattctatgtatctcaaatagcatctagaagtttctataacttgtttaggaatcgcctttccgtccacttgaagattctgggaatcccggggaggcaggaagtcttgcaagcctgagccgttttcaatggttttccaggttagggcgccccagcagagatgctcatcgcccccgccacccactcccttcacacccagcctagagtagaatgtaacacccagagcaagaatgggggctgggggcccaggaacagccctgccgctgctgtggtctctgtcccaagatgtaacaggtgacacaggcactgctgcttgggcctcctttctggaccctctttgacccttggctgctgcacttttggctagaaaccccaagggctatcagctggcccaagtcccttagaaagggagagatcccaattggacagggatcggtgggagcagagttcatcaaggccagctcctgggtgaacttctcttcgccaggaggctgtttctagagcaagctagactctctaccagctgcagggtctcctaagttgccactccccgggcccgaaggggaagacgctttctctggggagaattattttgccccatttgctgtctttacacaagattacatgcgctatattgctgaataatttgaacaaatgtgattgaaaggaggtctgggtctgggagtccgatgtcgagcagtttcagcgtcggtgctgtaacatgaggataggccagaagactgcgaaattacgtgctgctgttctttgctttttattttcctccagtgacttttcccttgcttctctttttcaccttcccacagtgtccactcccctcggccagggccgcgtcaaccagctcggcggcgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaaggtgagcgggcgggccttgccctcctggctcccagactgtggtcccctgtgttggggaagaccgggcggggggcaacggctgacatctggggctctccaatgagttatttctgaggtttgtgaaggtgcgtaaaggcgcgcgtgtgtgtgtgtacgtgtgcacgcgccctggacacttcttgatgaacacttagggaaagctcttgcctttttgcaaaggaaaaataacatctgttttttaaagcccataagccttgcaatcctcatcaaattattttaatggataaacacctaaagcaggcaagctctatgtgcccacctgttgccgatttcttccctaagtgtcttcccggctcccacccatggcaccgtcctttccaaaacgaatgtaaggaacttctttaggttttataatggtttgtctcccaaaccccgccctcagtctcccccagtgcaaattgttttcaatgagtcaaatactagggtgatcagttttctttgtaataagccaatgactccattaaaaaaaaataagcagtttggtgctatccttaaattatttttggttctgtttttaaaaagaaagagtcacaccagctagggctgagtgggagggaattacacaaggtctgtcttttcttctagttgccaccgggcaaaatcaagagggttatggtaaaccgaagacctccaaacaccctcctcttccttcccacctactgaaacactttcacagcctttctaagaatctttggaaccttcttcttctttttaaaaaatatatattgggggtagagagaagagtcagtctctcttaattaatatttgttatcgactcgaagttttaaaaacccaaatacatacctttacatttcagtcttcactttagcataaatatccctttggaaaagcacaagttgcagatttaacttgatttttcagctcctttttcaaacatcgcttttttagtttcgttttcatgttggttctgtgtaagcagttgccttatttccagggatgagaaagtataaccccaccctacccccatcaagatgttataattcttctgaatttatcccggttgtctggggcttgtctggggaagttagaggcttcccaggctgctccgggatgggatgggatgtgttctggtctgcccctttctaaagtgcctcagagagttcaggtctttttgctcacaaagggggaccgtcccagaggattcagcgaggagcatcccgacaggcccagaggcggtggggccgccgccacctggcccagggtaccgggtaccaacgcctgcccgcctgttctcttaaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcaggtactaggcccattaacctctccccgaggcgcgacagtcagtcgctattaccccggcacgtcgacccagacgtaatcaccccaattatcgatctcagctattgggaggtggcctctcccgaggccctgcaatatttgccaacccggtgttcttggcactttatggagggaggggtgagctgcttgtcctggggacggagggtggcgagaccaccgctgaggacgccccaaagaagatttctgtcgaggaggcagggcaggaaacgtgaggcggaggcagagcgtttattaatattgatgttcccttttaaagagaaacaaatgttttggtaaccccaaccgaagggagatggggcccgcgccgggagggactttgccgtgtgcgcaaagccgtggaggcttccacaacggccccgatttcctccgagagtctcagggacggtccggagccccccgccacggcagcctgggggaggcggagggagaagaggggcaagcacggggccagcgagagggcgcacgggagggtttgtttttaattaaaaggaaactccctttttccctctgtgagaaacatatttcagagcatggatttgtttaccagactggaatctggaaaaaataagtgggagagagtgcattttcttttgatttttacaataggaaacgattctgcagttgaaatttaaaccctttatagccttaaaaaaaaaaaaaaaagggaagaaaggaaaaaaaagaaacttgatttacgggggggtgggggggggcgcggacaagtcggctttggttcttcctcccttaaggcgaaccgcaggatccatgcattcaggtggggaggaaggagggtacccggtgggctggtgggagaattctcttagattgcagacctagagcccggtcttcggagtccaggaagggaaatgcttcctgcccagaatcgagggacaaagatggcatccggccctaacttggaggcacggttttcccagcctccgtctttcagtaccgagatacagataatagggaggggggtttgagtggcaggatgagagggctggagaaggatgaggatgtccagagatgcaggaggagacacccgcgagcagtgcagggcagcggctctagtgccctggctggtgtttgggggtggggggtccttcccgcacagccctgcttgtctcaaccatgtgcgctcccttgcttccttcctcctcccgcccccagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggtttgatttgtttgaagttgattttcaaatgtgagggggtttaacctgtgtgtgcctgggaattgaaaggaacccaagctctgggttacaaattgaagggatctgggttcttagagtgctggcaccctctgtcttctaggggtacagatccccattccttttcggctgtgcactgtcggcactaagaaaaaaatctcccccatgggagacagaagtgcagcttgcttccccttcacctgccgcaagccatcctcaaactttaagggtacaaacgcaaaaagaaagaaagaaaggaaaagaaatgctgaaccaggaaaggatcattgcagcaggagacggcaggggggaggggaggattgtgtctcagtggctttggccttgggggtggttgcccctcttcaaatgcacaaatggtcaagagtggccaggggtcccactcatgcctgaagtttcctcacctgggacttggagttcattgggcaaagttagttttggagttgccagagggacaggcggctttccaggtgggctcacagccgttgccgactgtgactagctgggtccgagcccttaccagagtggcatccaagtgggacttcttttatcttcattgcccaactctgtggcagccagtggctctcctgagcagctgctttacaaagcaatgcaaaatctgcacacaacctggaaggaacatttagatttggaagttacagatccaaatggctgatttgagggaaaaacaagtgtagatactctgatgcacacaagaaatcaaagacatgtcaaaccacagcaggttgggcagggagatgcttcctttgctttatgacagaggcctcctatggactcagcctaaatcctctttttggagaggtgcatttttctgccttggtctctgagaagacaccttggcttttatcccaggcctagctgcagaatagaggtgctgagaagggaggaaggcagggagtcagacaaccccaaaccaaatgtgctcctgtgggcagtggggagaagagcccagagcagtcacagaggctggggactcacggctttgctacttgttgctggaggctccggcgctggcagactggctgctctctcgcagtacaggcgactgaggcccaggagacaaaacgtcccaaatgagctggtcaaacatttgtacaacttttccagcttttacaaagaagtccttctctacacaatctacacttggagatgaacttgggagacaaagcctggagagtccattgaaactcacactttagctcagcccagacaaagctccagctcggagcagcttgatgtgaacaaaggaaggcaacctttttataattcaaggagaaaagaagagaaaacagcaccacaaaaggctgagaatagacattatgggcttgcaatgagggatgaattattcaatgagccccaatagctgctgcgccgggaagttttatggactcttcagcgtggaaaaagtggccatttcacctacaaaatgtttctagtcttttgggctgtctagctgggccggctgctattcaagggcaattgctacatttttaaaatcagagtattctccccagtgggggctgtgctgttggaaacacacacacacacacacacacacacacacacacacacacacacacacaccttggaggctgaagcctgatttaatttggggttgtcaaggaagatgcagtgtctgtctcttcagcatctctagctcctttttagatgagcctcggaggacaggaggggcccagagaaaggacagagtgaggtgcagtttgaagtctagaaacttcaaaaactcctttctgttgttcgggcatcaaaaatcccaggctgcccgcttgtaaaatagaatgaatgttgataaagcgttcttagcgccctggcagagggggagaagaaagctgagggaggaggaactttggggtcccctgaccagtgtggtgtattcttgcccttttccagttagtgggtctggtgg

SEQ ID NO: 13254 - DNA, 9117 bp, Human; identical to SEQ ID NO: 13253

SEQ ID NO: 13255 - DNA, 7248 bp, Human
gattaatatactgccaaggggttcctgggtaaatttctatgcatttcagtttctttttagggaagtaggaacaatatctatcttacaagattagttctgagaacaatgtggtacataaggcgctggaattctttcaaaaatttataccctgacatttccaagagccatggtcacccttacaaaggagagttaggcatgcatttgtagacaagcaatatgacttttaagctagaaaagaccttaagtaacattcaatctaatcttattataaaagttaagtataccacaaaaaagttaactgacctctccaactaatgtgcagtcaagtaaagatagaacctggaattgagatgtcccattgcagtcactgtttcaccttgcctcaatcattgtagatttgcatatcataaacctgcagagacaatggtgtctatccctgggaagttttcattgtaacatgtgatcattattaccctggagggtctatctgattttaatttttttcccttcatacttggtctctctctatcgagtcagatttctttcattctaatattaggggaggggtggagatacgaagagaggggaaggattggttagtacaaggccagtcaaggtaaagatgattgcaataatcaccagaaatctctgcagaactacagaggcctcctgggactaattctgaagagctctgaccgaagtttgctttattttgcctgtaccaattctaccaagtagatgaattcagtccatggcttgcaggcttggaggtggaggtggagtggagagcataaattatatttctgcaggtgaaaccagagcatagtgagccgaaacccctttctacccaggtggcgtgaatgggtccaactgctactgtcccccaggacaagagagcaaggaggggcgggcaggatgggactaccttgagcctcccgcaggatgcctggcaactactttcttagtggtccttaaggtccaatcgcggttaaggcactaactaaactcattcttcagcctccttctctaagttctcctcgaatttgggtgcccagaagtaggctcacgatcctttttctgcgggagcacaatgtaggtcagatagcataaacgaatagctacttatgaacacaatagctactctgctattgcaaggtatccacaaccaccactacaaacattaacaccttgctttacttgggaaacaaaaaaaatcatggtcctattcagcagtttccccatacagggagcgtttgcccctcccccagtcaacagggctgttcatccctaggaagtgatttgagagttctccaaggatttaggcttttcactcctccaaagctttcacaacttctacctggcgggggtgcgtgggggggtgggggcgaagctaaaagttcctttgctgcaaagagcctggtataggcagaaacaccggcgcggcctgcagccccctaaccacagtgcgtccttccccttagaagtctggggaaagcaaatccctacgcccagccatcatttccactcttgcgttttcaaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggccgcgcggggcaccggcccaactcggaggggcggcggctgggccctggtggatggcagcgtcgccacacgccccctccccccagacccgtcctctaggccgggggcggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcggaaaacaccgcggcctcggcctccagaaaccccggccttgcgcaatcccccgcagcccgcgcctccctgggccccacgcggtgcactcaccacccctggggtttttccctctcttccccacaggttcctgcacttggccatcatccatgaagaaaaggcactgaccatggaagtgatccgccaggtgaagggagacctggccttcctcaacttccagaacaacctgcagcaggtgcgccgcttgcctggcccgggttctctctgaccctgggacgtagctgatgtagcagagtcaccccagatcctttctgaattcagggccactgagcactatttaccctcaccttttacttcacatcagcccacatcctagagagtgaaggaaattccactgatttggtgaggtctttatgacccacctggagcctctgctatttgccagccctccccacccccctgtctaggaggagcagcacccaaccaggagacacgggttgaggggaactcggggtgtgggtttggtccatggcttactttctctggtctctcttgcattcgtagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggtatgtctgcctccctgccctgccccaccccctcggagggcaggtgacgtggagaaggggcaggtgggccaacttaaggagtccaggcaagagcttaaactcctaacatttggaaggttgagaaaatatgtgtgcaaagtgcctattggatgcctttataaagttctttcagaacccagactgtgggttcttaaaattcagaagataagactacttgttccataaaagaataggtgaaaggagtgagggttgaaacaggtggttatacttttttccttttgttcttccaggccacacgtgtctacacttagcctctatccatggctacctgggcatcgtggagcttttggtgtccttgggtgctgatgtcaatgctcaggttggtgcttcctgcctccgacgcactgagtcaggctcctcgtgcttatgttgtgagcagaaattccaaatgcagccataagcatctcaaattccttttggtttcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgaggtgagtctgtgaactccttcggcgctctaactaatgaggtgccattcccttcaccctcccaggcccctagagctgctccttatcagaggggtatctacataatgagtctctcaaatttctgtgcataaccagtatcccaagaatgtacctgccccccccctttttttaatagcttactctttttttaaagagaagcattaaaggcaaactccctcagcctgtaaagttcattatatttgggctatggagaatggagtccaagagttatttccagtagtggcctccccatcccggtagcttggcagagctccgctccggaagcttaacgtgtcttttttccccttgttttcagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatgagttatcctgatcattttcttcaggctgccgtgggcctccggttctgaagttccatcctccggcagaggtggaggtggagcagtgtgagggaggaggtaactcccagcagcttctcacacctgacacccagcctccagcaaagctttgcaggcaccctgggcccagtgtgtgggagggaggctgttgcaaggttataggaaattaccaatctcaggcttggggtggaagcatgctgtttggcctgtggttggagacctctccattgtcattctgtcatcccgttgatttaaacttcctggaccctaattgccagttgaggaaattattttggccaagaagaatatgctgaattcatatagagctgggaaagatctcactaatacaggaagttcctaaggacataggctcagaaatgggactgcactgacatttgttagcagatgctcacctctgagcctcagttttctcatttattagctgggctgttgtgaaaattacataagacaatccacgtaaaatgcatagcagagcggcaggcacgtagtgctaaagaaaaacaagctgttacgcaacgttctttatgtcataccaggagaaacaagtccagagagaatgtcctgtctagggtcaccttgcaggagaaataggtggttaacatatttcatacgtgctcgttttggggtaaacatcttttaagagcattccatctcttaaatctatgtgttattggctgtagtagaaaagtaataaaggcttgaagggtcttatcagttcagtctactgattgtactggacgattctacaggagcaaatgtcacaagaaaccagtaatgtgaaacttggcttaggtgctctatcttgaggttttcatccctaaaatggctctcttgcctaggtagagagaagaataaagatgggtatactgaaagcccagactttaccgctatacaatataaaaaatctgcatttgtactctgtaaacatttttattaaatttttgggggatagggtctcactctgttgcccaggctggggtgcaattgtgcaatcacagctcactgcagccccaaactcctgggctcaagcgatcctcccaactcagcctcctgagtagctgggactacaagcatgcaccaccatgcctgactaattttatttgtagagacagggtttctctatgttgcccaggctggtctggaactcctgggctcaagagatccacccactatggcctcccaaagcactgggattacaggtctgagccaccacacccagccaaaacatttctgaggaaaaagtaaagttattgcattctagaaaatgcagagtagtgtataaatgcaattcatgtctttgacttatacctaagaaaaaattattacattatccctttcctgatccacaaacgatgtcaaagtcaaaagaatatggtcaccttggaccaaaaaggagccagtatttagtggtcttccacatataaggagtgttactacagactggttaaagccaattctgccccaattctttctctttcttttttttttttttttttttttttgagatggagtcttgctctgtcgcccaggctggagtacagtggcatgatctcagctcactgcaacctccacctcccgggttctagcgattctctgtgcctcagcctcccgagtagctgggattacaggtgcctgccaccacgcctggctaatttttatatttttagtagagacagggtttcaccatgttgcccaggctggtcttgaactcctgacctcaggtgatctgcccacctcagcctcccaaagtgctggaatttcaggcgtgagtcaccgcgcccagctctgctccatttctgtagccttagtccatccggaacccagcactggcggtccctctaccagtcttattctctgtcaaagtgcccgggttcttccctgaaattccttgtccatccccaagcacctcaacacaggtgttaaatgacctaccacaggaattag

SEQ ID NO: 13256 - DNA, 50368 bp, Human
acacacatacacacacacacacacacacacacacacacacacacacacactctcgcatacaggcataggatagtttgctatagttaacaaacataagaatatcctattttcttgagctttcatcaggctttactttgccagaatacatctatcccatttttcagtaactagatctagctaccacatttcctcagttttaacgtgtgtgtttaaagagacagggtcttgcgtcgctcaggctggagtgaagcagcgggatcaaagctcactgcagcctttttctgtctataaatcttcaacacttggctgcgctgcaatctctctgagcctgcccgattcgtgaatcattctttgctcaaaatgttaaatttaacttggctaaggtttttcgtttaacacttcctactaacgctacagcctaaaacctctcctgcaaaatgctttttcaggtggcaacgtaccaattctaacaagtttgtgggagtaatggggaggagggctaaccctctattttctttcagaaaaagggttaggcacaaggagctctaaaggcttgtccgaagtctgctgaaaactcacaaaccactcagaaccaggtttcccacacccaattaattccaagtggtactgtatccgattacccccattttccaagagatagtttattttttcccctcttttcccctccccactacactttccacttagccctttttgaactgcaaaataacctctcaactcccctcaccagaccattctctacagagcaaattcatctacgagatccaagacgcaactcccaccgccaggcggtcgcctcagaagggtaagcagaaagcatgcccacttggccacttttacaacttatttctgctcagaaatgcaccaactcaactacccggtagataaggcaccagctagcagagacctcttgctcatttcctcttgtaccttataaaatgcccgcttttttgctccaaagacgaagcgggctggcttcagaaataaaatccctcttcttgtataccagggctcgctcttgttaattggtgtctacgtgtggcgagcaactaactctcttttccgttagagcactcaaagccctggtcaatctaccccccaagacagcagagaccagcacaacgatcccaaggaaggctgttggcttcaccccgcttaagtcctcaaagtcagcgcctgcagcatatccttgcccccaccacctgcctctagctctggtcacttacacttacggttagttcgcatccactgtaacagcgcctggcggtcggcaggagccacagtgcgaagcggccgcagcatcactgcctgcctcgcagtgggaaattttaccttgctggagcaagccgcgcaggcactggctggcattgcgcatgcgcaagcagagaccgccccaccctccgcggaacaagcctccggtctgcaaagccctaagccccgcccctctacggaggtctcacgtgcgcctggggatccctgccttcagtcacacctctatctctcatctttccgctcttagctgggagtgctccgcctagtcacttttcttaaggtggctcgtcgaggcctgacttcttccccgaaatcacgtccctagacagcctcctattttaccactaactttactcctgcagttattcagcggtaggaaactgaaaccaaaaaccagtgtaagcaagtaaacatctaaactgtttcaggagccgcgtagaaggaacgcggcggtgtgccccggaagcggaagtagattctcctatagaaaggctggactacgcggagtggtgacgtttcctcattgggcggaaggttcgctggcactccgttggtcttccagctggtgggagttgacgacgtggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcggtaagtgtctgctttttcccgccccagactacggagggggagcgaggggcagccccagcgctgctcaggaggcgagagactccgggggaagtcggcctccgtggccaccggccatcgttaccgagactgagtttctgtggctctttatctcgtcttccatgagaagttttattaaagatgcgctgtgccccttttgagttgtcttccgatttacctgagccaaataagatgtaggcagttgcaggcctgagtcttcgttttgctttcctgagcaagaatttagatgaagctacttccccgaaaatccttttacttgtacgagacttttatttttcctatgtgtttgtagtgcttaacacaatgtcctgcgtgtagtagacgttcaataaacgaatatggaatatcagttgaatgccaatgatgatttaagatagactgatagctctctctgtaccatttgacgctgctgaccatccatttcttgaaactttcccctgctgcctttcttcatgctatcctcacctgattctttcacatgcttaatttaacaaaatatatacttgttcttggctacaaggatacagaaatgaataacactaactctgccattgagaagctaacgcacataaatacacattatatcaagatgggtaatgagaaacactagttgcatataaagagctgtagaaagctgtgggagagctaaagtgctccttaggtgctttgtgaccctgagccagtttctattccaatctagcctcaatttcctcatctacttaataggcttgttttgaggaagaaaggagattaggtaagaggtttggtttggtttagtgcctagaatacagcaatcgtggtgccaaaggggagggaaatatttccctcaaatcgctttttctcagttttttgatatggccaactggtattttctaccttaatatagagtactatgcaaaagcatcttcaagtcttccttccagattactcctctgtccccatctatttggaaattctggacctgccacaggattacagtaagataaccataaatgtagctttttaaaaattgattttctcctatgtgccatggagaaagggaaagggaattagtaaaagctcctatctctttggttattttcagtcttggttaacgccgtccttttagttggccctcagtcattgctataacccaaatggtcttccacaggctctcctcgaggcttctcgcttgcttccatggcattgtccctatatgccaaccatgtccaaaccttattcttttcatttccaaaccttgttcttttccaaaccttatttgctctgtcgcccagactggagtaccgaggcaccatctcggctcactgcaacctccgcctcccaggttcaagcaattctcctgcctcagccttccgagtagctgggattacaggtgcctgccaccacgcccagctaatttttgtgtttttagtagagatggggttccaccatgttggccaggttggtcttgaactcctgacctgaagtgatccgcctgcttcggcctcccaaagtgctgggattacaggtgtgagccaccatgccctgcctaaaccttattctttagcctccatctcatgagttgatagttctgtactttcccctaaaacttgcaaactcattaggtccaaaaccaaatgcactgtcttcaccttccttttttttttttttttcactatgacatatgtcatgcatacgaaagtgtataaaagcagtgattgtcagtgcgtttttgagttttgacctctggttgaattttgtgatacaagtaggttaaatttttaaaaggattataagggctgtgagcaatggctcacgcctgtaatcccaatactttgggaggctgaggctggcagattgctttagctcaagagttcgagaccagcttgggtaacatggcgaaactccctgtctcaacaaaagagacaaaaattagccaggcttagtggcgccgcctgtagtcccagctagttggagggataatgaaatgaacatctatgtacacatccttcataaaaagtgaaacattaaaaataatacattaagtccctttgacctcttctctattaactcctctgactttcaaaccaccttccctttttgccttccattcattggttaatggcatcactagccatctggttataaaaactagagatattggaatcatttttgcctcttttttccttcacttgccataaccatttggtcattagattctgcttcatgaattagcccttaaccctagtttctttttctctagttcaaggccacatcttgtctcaactagccttatggagtatgggtagtgcatgtagtgtcctggctcttcagttttttccctccaatgtatttgttacactgtatctaaagatgtttctaaggtatagaacagatttctcattctgttgttttctttgggacatgttattaaatacttaatatagtgattatgaacccttgctgcacatcaatatagctagtgaaagttttcaaaacataaatgtcttgttttgcactccagattaagaatttagatgaagctactccccctaaaacttttttaccttactatctctggagagtctgattgagcatttaatttttactgataggcattatctaaatgtcattgaaataacgcattgcttgagcatatgcctcttatccctccttttccttttttatttttcacttttcctttttcttttcaatgttaaggccaactttccaaggaattcttttgattttcgttttaattttcttcttggtagcattttatgtaaagattctttttatggttgacctcatagccagaaagtatcgtaaagaaatgattcccagtgttcctgagttattacctcttgttgctaattgactttttttttggtataccttttttgctgcaaaagtacgaattggtgctgtgatattattttacataaaatgagttttaaaatttgaaaaacaattactttaatgaagagaaagttgcttgatacttcttgatataattgaatataatctttggtgctaagttaagacagaggtggtatgatgcataatttatcttttgaagggagtcttgtgttaaactgttatatttgattaggaattagaacttctctcatgctgggacaatttctggagtacatagtaggtgtttaatgaatgagtaaatgaatacaagtggcagctccatcccaacctctagtctgttgactagttgcactctaattctcacaaggaacgctttggaaaataattttcccttgacttaaaaaataatgttctcagtcattactaaaaaattggaaattagaaaaagatataagaaaataaaaattgctggtcgtggtggctcacgcctgtaatcccagcactttgggaggctgaggcgggtggatcatgatgtcaggagttcaagaccagcctggccaagatagtgaaaacccatctctactacaaatataaaaaattagctgggtgtggtggcaggcacctgtaatcccagctacttgggaggccaaggcaggagaatcgcttgaactcggagggcagaggttgcagtgagccgagattgtgccactgcactccagtgggcacagagtgagactctgtctcaaaaaaaaaaaattgctagttattcatcatccagagataacaaatgttattttaacagtttattaaaatataattcttggctgggtgcggtggcttaagcctgtcccaacactttgggaggccaaggcaggcagatcacaaggtcaggagatccagagcatcctggctaacaaggtgaaaccccatctctactaaaaatacaaaaaattagccgagcatggtggcactccatgtagtcccagctacacgggaggctgaggcaggagaatcgcttgaatccagaaggcagatattgcagtgagccgagatcttgccactgcactctagcctgggtgacagagagacactacatctgaaaaaaaaaaaaaaaaatatatatatatatgtgtgtgtgtgtgtgtatatatatatacacacacacacacacataattcttagttcacctaaagtgtacaattgaaaggattatagtgtatttacaaagttacgcaactatcaccataatcaattttcgtacatttttattatcccatgaagaaaccccatacctattagcaatcattccctattttactccatctcctgagccctaagcaactattaatccactttctgtctctgtagatttatgtattctgaacaattcatgtggaaccataatatgtggtcttttgtgactgggttttttcacttatgtttcgaagattaatccatgttgtggcatatgttcagtacttcatttctttttattgcctagtgatatacctttgtattttattctacattttacttatccgttcataagttgaaggatatttgggttgtttctactttttggctattatgaataatgctgctctgaccattcatgtacaagtatttggatgatatcttattaagattttgatttacaattccctgatggctaatattttttaatacttgtttttagactgtgtttaacaaaatatggattatactacatatgcagttttgtagtctgccttttgcatttaagcctgtttttagcattagcaagcatattttacaaaagaattttcctaatttttgctcccctctttactccccgccaaaaccataaattcttgggaaaccttgcttaaattaatatacctagaaaatacaatccatattaatatataccagattattattggttgttaccatggtatgggagtgggtagaattaggggaattatattttctaccttaaatatttctgtaatgttttaacttttacagtgaagatacatcattttgtaatcacagaacataaaggtgaattatttccttggggaataagtagattcagcatgaaaaacagttcctaaatttgaaagtcataattaacattgtaaaattagtcattaaaatatatttcactaagctgggtgcggtggttcacgcctgtaatcctagcactttgggaggctgaggtgggtggatcacgaggtcaagaggtcgagaccatcctggccaacatggtgaaaccccgtctctactaaaaatacaaaaattaggtgggtgtggtggcatgcgcctgtagtcccagctactcagaaagctgaggcaggagaatctcttgaacccaggaggtggaggttgcagtgagctgagatcacaccactgcactccagcctggcgacagagtgagactccatctcaaaaaaaaaaaaaaaaaaatatatatatatatataacatatatatatataatgtatatattttactaaatacaatacctataggccattttgttaactaaatttacttttctgtggtcctagactgtgaacacatatgctgtgcagaattaagaaaaatatttagtattaaagtcagaaaagcaaatactggttattagcctttgactgctttatagaaaagtatacagttgtctcttgctatctgggggggattgattccaggaccaaaatcagaggatgctcaagtccctgatgtaaaatggtgtagtatttgcatatgacctatgcacatccttccatgtactttaaagcatctctagatcaatacctaatacaaaatgtaaatagttgttataccatatttatatccttaagaaaatacttgttatactgtattgtttagggaataatgacaagaaaagtctgtacatgttcactagagacacaattttttttctgaatgttttgatttgtagttggttgaatccatggttgtgaagccccagatacagaaggctgactgtactatgtagaagtaatttttctaagtatatttagttcttgaggctaatattgattcaaaaagtcattgacaaggacttagaagaaaggacttttggccaggcgcagtggctcatgcctgtctataatccgagcactttgggaggccacggtgggtggatcacctgaggtcaggagttcaagaccagcctgaccaacatggtgaaaccctgtctctactaaaaatacaaaaaattacctgggcgtggtggtgggcacctgtaatcctagctgctcgggaggttgcagtgagctgagattgccccattgcactccagcctgggcaacaagagcaaaactctgtctcaaaaaaaaaaagaacttttttgtagggattatgttgtaataggatttgacatagctaatcattagactctgtttatataatctcagatcaggcaaatctggcaggaatatttataattgtttatgtagagaaaggtgggtttttggacactgcagcttctgttgaataataatctggcagttgtaattgccactaaattttaaagattccaggagtggttcctgaatgatgggacagacacttctgtaagattgttcagaaaatttccagcttacttacactccatataatacagagagagatagttggtatcattaaaaaaagaaaggaagttaatagttaatatgctaggtttttgaagacagctttatatgtattgtctcatttaatcctcacaacagcccttcagggtaactaccttggtaatggtatcttcattttgcaagtgaggaaagtgaggctcagagagattaagtaacttgcccaaagtaacacagccagtatgtaacagagctaggatttgaatctaagtctgtcagactccaaaatctatgctctttccagtacttcacactgcagcaagtaagtgtgatacttggccctgtgattgccttacttagggcacccaaaacttcagcctgtttctattgcttactatccaaatcctagtcagaccccagttagaagaccctgtgactcgagccaggatcagtccttgtatgtactggtctgattgcagtgatagttatcatttctttctgaacgttgcaattactcctccacaaagaggaatatacatctttaaatatgattaaaatgtgatttcttctattatagcatagcagcaaaatttgtccttgcagtttccagcaggtgtattcaaccctataatttaaagcttcattcatactctagccaaaggactatgggaagtcattttgcttttttttggcagggaacggctgttctattccctatcctgcttatatcataaaattgttgtaagagtgaaatgagataatagatgttcaactgtaagaaagtactgtgtggtaatctcttacctttctaaaagccccatctaagtagagattcttcctttgtgaaattctagcatatacagatttatttctataaatcgttttagttaggcaagagaatcttgagagtgtacttgaattgtagattactccaacctgagatttaggcttagctattaacatacaaaaggtatttttcactttagtgtacatattagaacaaggtgaggttaatttttaagtatcttgttggaaatgcatggcagggaaattctgaagaagaattataagtaatgacaaataaatatatttaatgtacagtacaaattacccaagttattgtttttcttttgattcatcatattatcttcattgatttattttagtggcttttaaagatatttgcagtgcctttcatgactttagttctctggtctcgctttttccctaaggccttaaatacatcatttcattcattcataatgttcatttttattaaggatttactgtataaggctgaggatagataaagcagtgagctcacaggagaaagcaaaagaggcaaaaatccctgcccttgtgcaggttaaatttcttttcttttttttttttttttttttgttgttgttgttgttgttgagatggagttttgctctttcacccaggctggagtgcagtggcacgatctgggctcactgtaacctccacctcctgggttcaagcgattctcatgcctcagccttctgagtacctgggattacaggcatctgccaccgcgcctggctaatttttgtattttcagtagagatggggtttcaccatgttggccaggctggtctcgaactcctgacctcaggcaatccactcacctcggcctcccaaagtgctgggattacaggcatgagccaccacacctggccacagcttacatttcaatagtgagattatagatgacaaataatataaataagccatatgtcagttgataatagaacaataggaaaaaataaagggaagagggttgcagttttaaataagtgattagggaagacctcattgagaaatggcatctggacaaatctgaaggaaatgagggagggagttatgttgtcaagcagaggaagagcatgctggctagtaccgagacactgaggtggaaatgtgtagcagcaatagcaaggaggtcagtatgattaaaatcagtcatgcgtgtgtgttgggggtggggggtggagggggccttacagtccattctgaggactttacatctgtgtgcaatggaagtcattgagattttaagcaaaattctaacacggagttttcaggaacacatcatccttggacattgtagaggaaacactgtaagttaaaggtattattagatgttcttactcctctactgaaatgcaggattttattttgtttttgtgttttgtgttttaagacggagttttgctcttgtcatccaggctggagtgcagtggcaccatctcggctcactgcaacctccgcctcctggttcaagcaattctcctgcctcagtctccagagtagctgggattacaggcatctgccaccaagcctggctaatttttgtgtttttagtagagatggggtttcgccatgttgaccaggctggccttgaactcctgacttcaggtgatccacccgccttggcctcccaaagtgctgggattacaggcgtgagccactgggcccggacagattttgttattttatatattaaaactatatgtattcatgtattatataataaaatatattttttaaatttaaggcaaaaatgttttaaaatacacactgccagtaactacttgcagaaggaaaagtatattggaaaacctcacagaagtttttaaaatttttaaatttaaaacaaccagttaacatggaaagttagatttatatttaagaatttactaggcagccataaaaagaatgaaatcatgtcctttgcagcaacatggatggagcaggaggccattatcctaagagaactaattcagaaacagaaaatcaagtatctcatgttctcacttataagtgagagctaaacataggtacccatggacataaagacgaaagtagtagacacagaccattccaaaatggaagagtttgggagaagactgaggattgaaaaagtacctcttgggttcaaggttcaatatttgggtcatgtgtgtataagtccagtccccaccattacacagtataccagtgtaacaaacatacacatgtaccctctgaatctaaaataaattaattaaaaaaattaaagacacttcctaaagtttgcccccccaaaaagttaactagtatggcttatttatttatttatttatttatttatttggagatggagtctcactccatctcatcacagtgatgtgatctcggctcattgcaacctccacctcctgggttcaagtgattctcctgcctcacactcctgagtagctgggactaccggagtgcaccaccatacccggccaagttttgtatattttgtagagatggggtttcaccatgttggctagactggtcttgaactcccaacctcaagcaatctgcctgccttggcctcccagagtgctgggattataggcgtaagccaccatgcctggcttagtatagctttttaaaatgaaagatgatctgtttatgacatgacctctaaaaaagttaattgtggtgtcataaataggattctatcactcccagtaccaccatggtgaaggatataaactgaaacatctgaatcttatttcttaaatgaagaatattaatttaaggatcaataattattttgtataatgggtatggcataagaaataaaaagtcctggatcttttccatgaggtggttggctctcaggttaagtaacaatgtaattgtaaaaaaatcttatggtaagcaatttttttttcaatttcatcaagtattggtagtaagttttttttaagttctaaattaccaaattgtacttgagtgaaagtgtagtgtttaatttgtagctcagcctgggatatctgtttgccagtgataggtcctcaaatgcattttcccttcctgcctttttatgattcctctcacctctttactttctctatggtgaatgagtcagctatttcatcttcctgtttgtcttaaaattaattaattaatttatttatttattgagatggagtttcactcttgttgcccaggctggagtgcaatggcatgatctccagctcaccgcaatctccacctcccgggttcaagcgattcacctgtctcagcctcccaagtagctggcattacaggcatgtgccaccatacctggctaattttgtatttttagtagagacggggtttctccattttggtcagggtggtctcgaactcccaacctcaggtgatccgcctgcctcggcctcccaaagtgctgagattacaggcatgagccaccgcacctggcccaaaatttattttttttaatacggactttctctcttgttgcccaggctgagtgcagtggcgcgatctcagctcactgtaacctctgcctcccatcttcaagcgattctcctgcctcagccttctgagtagctggaattaaaggtgcctgccaccatgcccagctaattttttttttgtatttttagtagagatagggttttgccatgttggccaggctggtctcgaactcctgacctcagatgatccacccacctcggcctcccaaagtgctgggattacaggcgtgagccaccacgcctggtgctgtttctcttatttttaatctcctgtgtattctgtagaagggatctagtctggataatcttggttgactaaattagactacattagtttggaagggttaccaaaacagttgttttgaagagttaccttttctgctaatattgttcatattggaaaattgatattccccagaccgtgtttttagagccctttgaaatctctgtttccttctaactgtatacacctctgtcctaagcagaatgttttgtttcctgtcccctaaataatgctcagtgatccataagtacagtgcatatataaggcataagtatgtcccagacttacctctctctccatttctgcttatgctatttcatcttcctcaaattcccttttgtcttctccacttactcaaattctactcttatttcaggaccaaattcatactcagtctttccaataaagcctatactctctgccttagtctaaaattcttccttttctgttttctttttttgtggagacagagtctcactctgtcacccaggctggatggagtgcagtggtgtgatcatgacctccttggctcaagcaatcctcccctcaccctcccgagtagctgggactacaggcacatgccgccatgcctggctacttttttttttttttttttttttttttaaagagttgaagtcctgcctgctatgttgcccaggctggtttccaactcctgagcccaagtgatcctccttccttggcctcccaaagtgctgggattacagacatgagccactgtacctggccttttttttcctttttttttttttcttgttccagagaagcagaatcaataaagggtgtgtgtgtgtgtgtgtgtgtgtgtgtgtgtgtgtgtgtgtgtgtgtgtgtgtagagagagagagggagaaatggatataaagatatgtatttattataaggaattggctcaggccgttatggagacttaagtttcaagatctgtaggatgagttggcaagctggagacccaggagagcccatggtgtagatccagtctgaatctgaaggcctgagaactcagagagccattgatgtagttttaatccaaaggcttgagacccacaaagaaccagtgtttcagtttgaaggcaagaaaagctgatgtccctgttagcagtcagacaggaggaattctctcttagtgtttattttagtgttcatttgtgtgccttgtcttaccagctagtaggtaagcatcttgagggcagggactacaaatcatatttgcttgtttatcatccataagcccttgcatccttacaagtagtaagtacatctaatatgtaatacttttataaaacagtaagattttagagctggaaagggtttttgactcttagttaactgaaacagaaagtctgttgcatgtgactattttttggaagaaccaggatcagaattttattttcggttcctcatcaagggctttttctaataattcttattaataataaatgataacttaaatcattatcctattttagagttttcctggaatcagaaacaggtttaaaatgggaagagaaccagccttggcaacataacatagtgagaccccgtctctacagataataaaaattagctgggcatggtggcatgcacctgtggtcccagctacttggggggctaaggcaggaggatttcctgcgcccaggaagttgaggctgcagtcagctgtgatcacaccactgcactccagcttgggtgacagagtgagaccctgtctcaaaaaaaaaaaaaaaagagtaaaataatatacctctttcctttgtggttagaagaataaaatgaaataatgtatgtggaatcacttagtatagcgcttcgatatagctgatagctgaacagttgctttttttgtactagaaaagttattaaaaccttttttcttttttttgcttaggagcaagaatcaaaatagtttgcagagtcctttaatgtgggaaattaggcagtattcctggagatttcacctttttctcctcttttaatttaaaaatgtgcatgatacataattcagttattcataagtattgtgccaaaaaaagaacatatttaatgtgagattatgtcattatttcctcaaagtatgttatttgacatgttaaatttgctgattcatatacaagattccaattaagtattcaaatataaggcatcataaccaagtagcagttttatctttatgacatgactgtatttaagcacaggttgaggctatggaaggtgatcttacagtatctaaacactagagtaatttgaacttaaatactctttagaactcttcagtcatgggaagtgaaattgattattctcacttaattttttttctgctgtagagttcttcgtaagtacatcttaaagctgtcaagatggttctagcagaccttggaagaaaaataacatcagcattacgctcgttgagcaatgccaccattatcaatgaagaggtatgtaaaatattgtatgaaatatatatgattgtatattgtcactagcattgggaagatggcttattcataatccctgtatttatatgtattttgatgtagacttaatacttgtagataaaagcctaaaagtggatacagtaagtagtgttttattgagaaattaactacaacttcaaatttacttcaactttctataaagaattttccaaaaaaaaatcgaaaaaaacctgaccttaacttacatgtaaaaataacatattttatcttttgaaagtggcttaaatctggaactgtacttttgttttctttattgatatagacctaaaatttcattactctgcttctttcttcttggctaggcctgtgcttatctgtccttttctttgtgacttttatttagcatttttataaaaggctagcatttccatcttgtctgttttgattcattttctttgaaatcttcagttttttggagattttgtaagccactccttagatgatattaaaatacttttcttcccggctatattattttaagatatttctttgttccatttgtcccccacagattgtatcttagtggtttattaattgaaaaagttgactgtggttcacaagtatactttatattttgtatcaacaatggaaaagtactgaatttggtgttagaagacattggttagtcccactgtagctatttagcagctgtacgatgtaaattggggcaactaaaccttagattccttagtgtataaaataggaaaaatagcatttaccatagaaaatggttttaagtttcaaataaactttctaacttggaggttagaaaacttacgtagaattcttacatggaatttgatctcaatactaagctaacggaattaaataattttgagaccatcttagagatcatttagttcagcctcttatttaacagaaccaaagtcagtttcatgtgattatttatttggaagaaccaggattagaacctttttttcctagttcctcatacagggctttttctaatactgcttattaaaaaataaatcataacttaaatcattgtttggtcttgtaattccaaatatataaaacgactttccaaacagttttccctgttgtgtagcccttatgttctttgtgtttatagtagaaaggaaaggaaaccaggggaggagttcttggtgggaggtagagtaacagctgttgcttaaattggcagcttctctgttcttgatactgtgctgctagctaattaacaaggagaaagccctctagtgaaagatcagttcgaattttagcagacccgtttaatgagggatagagaaaactggtaagcctctctctgtagggcatatgaagtgagttgaaggagagagaacattcaagaaatatttgagggcctatgtttttgcagacatttttgctggcaccagagatacagcggtgaacaaaatagactaaaattcctaacctcatagagtttacattctagtgtgtgagcactttatatacatgagtggctaaagcctcatcttttcttaagacttttaattttatgaccttttaactacagtgccttgcaattcaacaaacatatgatgataataagttattaatggagagtagcctcctttccacctgtattctgctgctctaataaaaatgacaagactgggtaacttccttctgtcacatttacttccataattgtccagtttttaagaaaagcaatattaagccgggtgtggtagctcacacctgtaatcccagcactctgggaggctgaggcgggcggatcacctgaggtcaggagtttgagaccagcctggccaacatagtgaaactccatctctactaacaatacaaaaaattagctgggcgtggtggcaggcgcctgtaatcccagctactagggaggctgagacaggagaatctcttgaatctgggaggcggaggttgcagtgagccgagatcacgccattgcactccagcctgggcaacaagagcgaaactctgaaactctgttccaaaaaaaaaaaagaaaagcaaatattgtaactatataccactacataatagtgacaggagctcttcaataaagtagaaaacatcaaaggcaacatctatttgtagtaactttttttggcttgaatattgtctttattattactttgtgtgtatgtgtgtgtgtgtgtgtgtgtgtgtgtgtgtgtgtgtgtggtttttttttttttttttttgagacaaagtctcactctgtcacccaggctggagtgcagtggcactatcttggctcactgcagcctccgcctcccgagttcaagtgattctcctgcctcagcctcctgagtagctgggatcacaggcacgtgccaccatgcccagctcatttttgtatttttagtagagatgaggtttcgccatgttggccaggctgttcttgaactcctgacctcaagtggtctgcccacctcggcctcccaaagtgttgggattacaggcgtgagccaccatgccgggcctataattacttttatataggaataaaattgtggcaattaatacttgggtgtaaaactaaatggggtctcttattttgacaaaatgactaaacatttaataaaattatctctccaagaactaactgaaaaacccagtagtgtggtattactaagctgtggttatgtaagtgatcaacaattgtttttatggaactgaaatgaaacattgggtgctttaaatttcatttatttctttattttcaggtattgaatgctatgctaaaagaagtctgtaccgctttgttggaagcagatgttaatattaaactagtgaagcaactaagagaaaatgttaagtaagttaaatcaatcaggtaaaacacaggcacagtttagtttagtttactggaaagaggtgctaactggaagtgtttgctgtatcaggaatcatttctgctctgcaccactggaaaagtgctgtgttggagctcatatgttgggcgagagcatgtgtagtacgtttccataatgatggttcaaagaataaactacatgtgattttcatttaattacatatttttttctattttactagtcttttatttgaatggatttgattaaatactgtatagtattttaatatataaagccttttaacaattcaggctcttcatagaaaagtactgccattttattctttttaggcttaagatgatcttaatcaaccttcattattggaggactgtattctcttttgttctccttttggtttctctgtttcatatttgaatgaagaattaatgtgtttggtctcagttatcatattcattgggagaggcactgagttggtaggacacacagagcaatacaggtagctcagttaactgcttgagtcttatctcttaccatgctttagacatctctccttgtattgttagactgagattagttgtgggactaccagcatttaagcatttagacatagaggaagtagccgggcgcagtagctcacgcctgtaatcccagcactttgggaggctgaggtgggtggatcacgaggtcaggagatcgagaccagcctggccaacatggtgaaaccctgtttctactaaaaatacaaaaaattagccgggcatggtggcacacgcctgtaatcccagctactcaggaggctgaggcaggagaattgcttgagcctgggagacagaggttgcagtgagccgagatcatgccactgcactccatcctggctgatagtgagactgtctcaaaaaaaaaaaaagaaaaaagaaagaaaagaaatagagaaagtagtcctgatttctgttgtaaagatatataaaatatataagctgcaagaaaagtaaataaaactagttctttgtggtaatattaggacaaatttatatttatactttcaagtgtaatccttgaaaaccaaagtcttgcatctaatacttcatgggaaaactctttatgatatagacttacgagtctgtagtaattacatgcatgttaattggaagactattaatatgaatgactgaatgttgtacattctttggagcagaagcttctttttcttagagtttcttaactgattttctcctccccaccccaatcaccaaccaccatcataaaggtctgctattgatcttgaagagatggcatctggtcttaacaaaagaaaaatgattcagcatgctgtatttaaagaacttgtgaaggtaaaagtatatgaagattatgctgtgattctatactcagtggataaaaaagcgttagcactacaaatatttcagaatttttaaatatgttttttatggaatattcatctgtattaaaatattaatgaaaggattattgagttttcttagggacctttttttttttttttttgagaaggagtttcactcttgttgcccaggctggagtgcaacctccgcctcccgggttcaagcaattctcctgcctcagcctcccgagtagctgggattacagacgtgcgccaccacacccagctaattttgtatttttttttgagatggggtttcttcatgttggtcaggctggtctcaaactcctgacctcaggtgatctgcccaccttggcctcccaaagtgctgggattataggtgtgaaccactgcacctggccaggacctatttttattgtagactttactgaatatacataattctgagtgcagatatgaaagctagtactattcctgcaaaaaatgccaaagccaagatgcgatgagtgaaatttcactacagatttgttgatggaagggcctaagtttttcctcgttcactatcatgttttgcctagtgatggtcctgcttttgtatggcaaagtcacatatagcaagtattcttttctacactgttcgttgtgtaaggaattccctttgcaaagaccatgtatcccaattcttgcctagattatgagcaattttgaattagtgaaagttttattttcaaatagtaaatatagccagttgccctgcctcaccttattgctgatcatgcaaattatggtgaaaatcttagagcttaaaaaatatatatgggctcagttgtagaaaaaaaaagaaaggagctgttaaaaaaattattttagtccaggcatggtggctcatgcctgtaatcacagtgctttgggaggcggaggtgggaggattgcttgaggccaggagtttgagaccaaccagggcaacatagtgagaaccagtctctataaaaaaaaaaaaaattgataaaaatagctggtgcaggccgggcgcagtggctcacatctgtaatcccagcactgtgggaggctgagatgggtaaccacctgaggtcaggcgttcgagaccagcctggccaacatggtgtaaccccatctctgctaaaaatacaaaaattagccgggcatggtggtgcacatctgtagttccagctactccggagggtgaggcaggagtattgcttgagcccaggagttcgggggtgcagtgagccgtgattgtgccactgcactcccgactgggggagagggtgagaccctgtctttaaaaaaaaacaaacaaaaaaaattttttagagcattagatgcccactagttctacaatcatttttcccccacattgtttgaatattttctttttttttttttgactctccctctgtcactcaggctgaagtgcaatggcatgatctctgctcactgcaacctctgcctgccaggttcaagcaattctcctgcctcagcctcccaagtagctgggattacaggtgtgtgccaccacgcccagctaatttttttttgtatttttagttgagatggggtttcaccatgttggccaggatggtctctatctcttgacctagtgatctgcctgccttagcctcccaaagtgctgggactacaaccatgagtcactgtgcctggcctcctttttttttttttttttttttttaagagacagtctgactctgttacccaggctggagtgtagtggtgcaatcatggctcactgtagcctcaacctcctgggctcaaacaatcctcctgcctcagtgccccccaagtagctggggctacaggtacatgccaccacgcccagctagtttttgcattttttgtagagacaaggttttgccatgttgccctagctggtcttgaactcctgacctcaagtgatccacctgccttggcctcccaaagtgttaggattacacatgtcagccactttgcctggccagaaatttttattgttaggggctcgtaactgtaggcaattctggagcatcaagtgctttattaagaagcatttattgagtacctactttatttcaggaagtatgccaaatgctgctgatagcagaaataaatgagactggttcttatactcagatgcttatggtctagaggaatggtgtacaaagcaaggtcaaaattattttcataatactaagacattatttgacttttgtactatgttgacatttgcactgaaaacaatggtaggtaaaactccctggtatgaatcaaggcagtggcaccagatgatactagtagtttctggactctctatttatttatttatttttgaagacagagtccctgtcattcaaactagagtgcagtggcgtgatcagagctcactgcggcctcaaattcctgggctcgagcgatcttctctcctcagcctccagagaagctaggactacaggcatgcaccaccatgttttttgtttgtttgttttttgtttttttggtttttttggtttttttttttttgagacagggtcttactctgttgcccaggctggagtgcagtggtgtgatcatggcttgctgcagcctcatcctccctgggctcaggtgatccctacacctgagcctcctagtagctgggactactactctttgagcccaggagtttgagaccagcctgagcaacatggtgaaaccccatcactacaaaaaatacaaaaattagctgggaacgatggcttacacctgtaaaccgagttactcgggagggtaaggtgggagaatcgcttgaatccgggaggtggaggttgcagtgagccgagaccacgccactgcactccagcctgggtgacagagcgagacctgtctcaaaataaataaataaataaataaagcttccaggcatggtggcgcatgcctgtaatcccagtactttggcaggccaaggcaggtggatcacctgaggtcaggagtttgagaccagcctgaccaacatggtgaaactccgtctctactaaataaaaaaaaaaaaaattagccatgtctagtggcacatgcctgtaatcccagctacttgggaggctgaggcaggagaatggcttgaacctgggaggcagaggttgcagtgagctgagatgacaccattgcacccagcctaggccacgagagcgaaactccatctaaaataaaaataaaaaggacttgtatctatcatctgtctctatcatgagtttgacagtatcccagtacttagttttctgatgagggtcagtattgatattaatgaataaagttttttgattatgtatagtgaaatatgtcaatgacgagagatctgcctaactcagtgaaccaatgttttgtgaatagctagtgcgtgatgttacaagatcatttaccagtataagattcatttaaaatgcaagatggaatcacagattttaatgtaacgagtataaaagtttatatggtttcagattctacattgcagctaacctttacaaactaccatgattataaagaagccctgagaccaagaagttgaaaactgctgttcttgatggtgggaggaagagaagacaaatttataaaattatttactaaaacatatatgttccaaataatgggtccatagagagctgggagtttttgccatgacatgtagaaaatggagatgaatgtggagcagcatcagtgtactgaaaggatctatgaggaagggaagtggatttatgtttaagacagattttgcctatttcaaaagtttgcctaagggtaggttgatgcctaggaaaggtataagaaaatgtattttcctctcttctctacctcatggctttccttgaaattcaagtataatatagatgatgtaatttttatggatggcttggcagactttctctcaaaggtttagactttgtggaccacgtgatttctattgcaactactcagctctgctgttgtggcacaaaagcagtaaatgggtcaggcacagtggcttatacctgtaatctcagcacttcaggaggccaaggctggaggattacttgaggccaagagttcaaaaccagtctgggcaacatagcaatactccatctctacaaacaaatactaaagttagccagacatcatggcatatgcctgtagttccagctactcaggaggctgagatggtaggatcgcttgagtccaagagttcgagactgcagtaagccatgattgattgtaccagtgcattctagcctgggtaacagagtaagaccctgtctcaaaaaaacaaaaaaagtggtaaatgaatgggcatgactgtattagattgaaatttttttcaatgtaataactagaaatgtaataactttacagcctgttgcccaggccggagtacagtggcctgatgatagctcattgcagtctcaaactcctgggctcaagcaatcttactgcctcagcctccttgattagctgggaccacaggtgcgtgccaccacacctggccaattctttaaattagtagagacaagatcttgctatgctgcccaagctggtctcaaactcctggtctcaatgaatcctcctcctttgtccccccgctgaaagggccgggattataggcatgagccaccacacccagcctccattgaaactttatttgcacatagtttaccaacccctgatctaggacattaactattatagatttattattttatcatacatttcaagctccaaacaactgacccccaagtgaattattttttaaatgtcccatgcttttttttgtttttgtttttgagatggagtctcgctctgtcacccaggctggagtgcggtggcgcgatctcggctcactgcaagctccgccacccgggttcatgccattctcctgcctcagccttcagagtagctgggactacaggcgcctgccaccacgcccggctaattttttgtatttttagcagagatggggtttcaccgtgttagccaggatggtctcaatctcctgaccttgtgatccacctgcctctgcctcccaaagtgctgggattacaggcatgagccaccgcgcccggccctaaatgtcccatgcttttttaatttggagactgtccctatatgaacctcagttttccactgactgattttaaagttgattattattttttactagccctctaaatgtagtaactttacagtaaatatttggcattggagaatttacagtttgacctggaaaatctttcacatataatctgtaattttgttaagtaaatatttgtcaaattgaatatggacattagcactctcgagtatggcatccactagccacatgtggttattgagcatttgtaatgtggctagtccaaactgagatgtgttttacatgtaaaatacacaccaggttttcggacttggtatgggaaaagaaatgtaaaatatctcattaattttttatatagattacatatgaaaatgataattttttagatgtattggggtagatactaaaattagtatcacctgctttttaaatgtcagtactggaaattttaaaattcatgtgtagccttcatatacatttttgtattacatttctgtagtgctgatgtagattcctcctgtggcttaaatttggtttcacattttatactccagcttgttctaaaaaatgctgtgagatctttacctctgaattggtttggagtatagacttgattatgacttcttaaatttatgttcttaaattttactctgtctttacaaaggggaataattgtattataatagcttatggtagcttttacatgaaaatgtccttatttatataatttaaaagttgtggcagcacagtggctcacgcctgaaatcccagcactttgaggctgagacagaaggattgcttgaacccagaagttggaaaccagcctgggcaacatggcaagaccctgtctctacaaaaaaaaatttttttagttaactaggtgtggtggcgtgtgcctgtagtcccagttacttgggaggctgaagtgggagcatcatttgagcccaggaggttgaggctgcagtgagctctgattatgccactgcactccagcctgggtgacaagagtgtgaccctgtctcaaaaaaggaaaaaaaagttgtggggaaggggttttgaatttatatgtatgttaacctgattttatttttaatttatttttggtatttagcttgtagaccctggagttaaggcatggacacccactaaaggaaaacaaaatgtgattatgtttgttggattgcaagggagtggtaaaacaacaacatgttcaaaggtaaattgaacttaatttaaaaagaagtcatatggaagataggtttgtataaatcaagttttgtatttaatataaaaatgtaaagcctggctttataatgttgaaatatatattttattaattataattattagaatgcatttatatattataaataatgttattttatataaaatatatttacataaaatatatttatattataataaaatatatttacataaaatatattttattaaaatatatttatattataataaaatatatttacataaaatagattttattaaaatatatttacataaaatagattttattaaaatatatttacataaaatagattttattaaaatatatttacataaaatagattttattaaaatatatttacattaaaatatattaataacatattaagatataaagccaggctttataatattgttgctttataattttgtgttacttgatgtatgtttttaaatagttttttttaggataagaggagaggtcctcatagtttcttatgattttttttttgtaagaaggtagacatctgtaactatgctatttcttttattaaaaaaagaccattcctatcctttcaggaagtgagtgtgtgatttttggagaagagaacatggagtttactttatcctctatggctcaggactcctttttcaggttcccacccagcatactatagatcttcattttgtgtatccttatgccatatttttttagacagagtcttacttttattgcccaagcttgagtgcagtggcacgcaaacatagcttactgtagccttgaccgctttatgctaatttttaattcagtttaccactcctttctcccaaattgcatgtctcaacaatattacaagatttttccacaagcttcacgtatgttacagtttgagagggaaaaagagaaaaggatgatttttagatcgttttgttgttgtttgtttttaattaacattaatagtagttaacattttttgctatgatcatttgctacttgatcattttatatttgaatgctactgcatgacaattagaatataaaactttgtaggaaatttgccacattcaaaaatctttaataatattttcaggagaattataagcagttttattttactccttaggtaaataataaggaaaaacagaaaaaattatatgtataatttgttatattttatgatattatatttttaaatcttttctcacccagctagcatattattaccagaggaaaggttggaagacctgtttaatatgtgcagacacattcagagcaggtaatgtcttgaaatttgaaaattgttttatataatttttattttcaagtttgaggattcatgaactctttatcttccaggggcttttgaccaactaaaacagaatgctaccaaagcaagaattccattttatggaaggtaggttactgttttttattttaacacttatatccctcttcttgtctgtcagcttttttttttttttttttttgagacggagtctccctctgtcacccaggctggggtgcaatggtgcgatcttggctcactgcaaccaccacctcctgggttcaagtgattctcctgtctcagcttcctgagtaactgggattacaggtgcccaccaccatgcccatctaaatttttgtatttttagtagagacagggttttaccatgttggccaggctggtctcgaactcctgacctcaggtgatccacctgcctcagcctcccaaagtgctggaattacaggcatgagccaccatgcctgaccatgccctgctaatttttttaaaaactttttgtaaagaccctgtcttataaaatatcctttgttgcccaggctggtcccaagctcctgggctcaaatgatcctcccacctcagcctcccgaagggctgggattacaggcttgagccactgtatgcagccacacacatattcttattaagtgtatttctatctgagtttttggtggtggttcttaatttaggggaaaaactttttttgtaacattatgtgtctttatttgataatagtgatctgcatataaaaagttgccactaatcagaagagtgcaaattaaaatatctcatttcttgattttcaagttgacaaagattgtattggggattgtgaaaatgtagtgaaatagggatgagattaaacttttatggaagagatttgcctcataaaagcaaaaagccttaaatggtcataccatttgttccaaattcagcttataagaggtgtcataacatagtgtcaaagaagaaacatttatgtaccaattatattggcggtatttttaatatcaggaaattggaaacactgccatgcacagtggctcatatctgtaatcccagcacttcgggaggctgaggtgggaggattgcttgagcccagaagttggacaccagcctgggcaatatagcaagacctcatctctacaaaaaataaatttaaaaaattttcaggctgggcgcaccacgttgggaggctgaggcgggcggattatgaggtcaggagttcgagaccagcctggccaacacagtgaaaccctgtctctactaaaaatacagaaattagctgggcgtggtagtgggtgcctgtaatcctagctacttgggaggctgaggcagaagaatcgcttgaatctgggaggcgaaggttgcattgagccgagatcgtgccactacccttcagcctgggtgacagagctagacaccgtttaaaaaaaaaaatttttttaggccgggcacagtggctcacacctgtaatccccgtactttgggaggcttaggcgggtggatcacctgaggtcgggagttcaagaccagcctgaccaacatggagaaagcccgtttctactaaaaatacaaaataactggacgtggtggcgtgtgcctgtaatcccagctactcaggaggctgaggcaagagaattgcttgaacccgggaggcagaggttgcggtgagctgagatggcatcattgcactccaccatgggcaacaagagcaaaactgtgcctcaaaataaataaataaataaatttaaaaaagaaattggaggccaggcatgatggctcatgcatgtgatcccagcattttgggaggccaaggcgggcatatcatgaggtcagaagtttgagaccatcctgaccaacatggtgaaaccccgtctttactgaaaatacaaaaattagccaggcctggtggcagtcgcctgtaatcctagctacttgggaggctgaggcacgagaatcccttgaacccaggaggcagaagtggcagtgagccgagatcgcaccactgcactccagcctgggcaacagagtgaaactttgtctcaaaaataaataaataaatacataaaaattaaaaaaaaaattggaaaaacgtcaaatgtctaatagtagggcgttatttaataaatgatacagccatctgatagaatgctgtataacctcaaggttatgtgttacagaaatattttttcttttttcacccgtgttaatttttaaagagacatgccatggtcttgctctgttgcccaagttggagtgcagttgcatgatcataagctcactgcagtgtcgaactcatggactcaagtggtcctcctgcctcagtctcccaagtggctgggactataggcatattccactatgccagctagttttttttttttgtagagatggaatctcactatattgctcaggcttgttacaagaatatctactggttttataaaatgcttccaaatggatgttaaatggaaaaatgtgtgaaacactgtgagcatgagttcaattattaaagaagatataaaaaataaatttgaaggagacacaattcattcaaaaaagacatgcagtagaatcatactgggttttggaattggaaaattggataatgcttcatgcttttttagaagtagattctgtatttaatactttatagattttcctcttctaaattgaaattggggtcattttggctttttcaaaatagattataggtaaattaactttccgaattagtagtatttggaagttttgtcgttttgttaaatcatttgtccatgttatatagctatacagaaatggatcctgtcatcattgcttctgaaggagtagagaaatttaaaaatgaaaattttgaaattattattgttgatacaagtggccgccacaaacaagaagactctttgtttgaagaaatgcttcaagttgctaatgctatagtaagtagctttcaatgtaacactattattaggactttggttaatttaattataaaaccaggttgagtatatgaccaatataaattattctttgcctgtgaggcagatccccagtaatttatttttgttttgggcacctatatctatgtggtagggacttaatttcattatttttgttctccattaaatataaaattttcataagtatgaaaaagtaatttcctttctcagtcatcctattagtatgcataagaaaacatttaaaaattagtaattaggccgggtatggtggctcacatctataatcccagcactttgggaggccagggcggatggatcacaaggtcaggagttcaagatcagcctggccaacatggtgaaactccgtctctactaaaaatacaaaaattatctgggcatggtggtgggtgcctgtaatcccagctacctgggagctgaggcaggagaatagcttgaacccgggaggcagaggttgcagtgagccaagatcacgccattgcactccagcctgggcaacaagagcaaaactccatctccaaaaaaaaaaaaaaaaaaattagtaattagcctttagtttctgttgaatttcctttttaaaaattcagttggaaatacttagatttttaaatactttaaaaaatattaattatcattttgtgtctctttaaaagtgtgatggaaacaatttgggggaggagaagcagtttatagatatctgcagcatatattattaggaacccacgtcttgacattggagtgttagcagtaattctttggtttgtggttaatgctaataagtttcttttcagttatgttgttattttgaccaagttgagcagatctaagggaagtagcctcaagtatattttatccgttttcagtatacactcttctactttgatttgcctttgtactttttttgcctagattgccattctttcaaatctttgcatataaccttttcctctttattcaggcctcagctcaaacattaggtccagagaggccttccctgactaccttactagaaaatgcctcccatacttcaaaactgatactctgtatcccattttcgttgttatacatctgaaatgtttatctatttattatatatgtcctctgactagaatgcaagtttcttaggacaaatattttctcatttacctttttgttctcatgacctagatggtacctgataatacatagtacttcaacaaatatttatggattgaataattatttatagtgtaaatgttgtagtttttttttttttttttttgagatggagtttcactcttgtcgcccaggctggagtgcagtggcatgatctcagctgactgcaacctctgcctcccgggttcaagtgattctcctgcctgagcctctcaagtagctgggattacaggcactcgccaccatgcctggctaatttttgtatgctaatttttgtatttttagtagagacggggttttcaccatgttggccaggctggtcttgaactatctcaggtgatccacctggctcggcctcccaaagtgctgggattacaggcatgagccactgcacctggctctaaatattgttttatagcttctaatgatgacatttgcttaggatcaataaaaatcttttctaaagtatcttttctatttaaactttctagcaacctgataacattgtttatgtgatggatgcctccattgggcaggcttgtgaagcccaggctaaggcttttaaagataaagtagatgtagcctcagtaatagtgacaaaacttgatggccatgcaaaaggaggtggtgcactcagtgcgtaagtatcattgatactgttgtcctctgtcttgggattatatggggaaggatatgtgtttatagctttcatattgatcatttaaaatatgtttcaatagtgagcctaatatggtttataaagaaagtttaaatagaaacaattttggagcctgtctgatataggtctattataacttgtgaaatgaaacttgagttttgtacctttgtctaattagctttggaggcggattcacttcgaatttcagatctgctggaaatttgtggggttcttttgaggttattttatattttctttttttttccagagtcgctgccacaaaaagtccgattattttcattggtacaggggaacatatagatgactttgaacctttcaaaacacagccttttattagcaaacttcttggtatgtacagtggtggggatatagaaaaatctccaagaaatacgatgtatctttaggacaaaataggattttaattctgtcctcactaatttaagcacatcatttctttctgtgacttagtttccttacctgtaaaatagagataatggttatctgccctctgtggtgaaagtggtaaaatgaggtatctagtagaaagttctttggaaaagttttagagcacagtacaaaaacaagtggttttaataatagtggatgtaagggcagtaatactttggcaatgtctcaaggtggtatagttagagagcatggaatttggagttaaaccctgggctgcagtccttgctttgccacttgtttgttgccacttaactttttttttttttttttttgagacggagtttcgctcttgtcacccaggctggagtgcaatggcgggatctcagttcactgcaccttcagcctcccgggttcaagcgattttcctgccttagcctcccaggtagctgggattacaggcgtgcaccaccaggtccagctaatttttttttatttttagtagagacggggtttcaccatgttggccaggctagtctcaaactcctgacctcaggtgatccacccaccttggcctcccaaagtgctgggattacaggcatgagccaccgctcctggccatgccacttaactttcttagctttggttttctcatttgtgtagtgtagtaagaatacctaacctattataacctcacaaggttattatgtatgtgaatgtgttttgtataatgtgaagcagggtatagtattagttgttaatttttcttttttgtatcttataggtatgggcgacattgaaggactgatagataaagtcaacgagttgaagttggatgacaatgaagcacttatagagaagttgaaacatggtatatgagtgacaaaaaagcacttcatctcagatttcttccattgattttttttataaagttactattaagttatttgaaatgtaatatctgttagagtcagatcttccactgcttattattttagatgatttatatgcaaatcatttaaaatctcaggtacctgagcagttacagaattcagtgtttttattttctttattgtaataaaattaagattaaaataaggctttcactaggttccttgaagtttttctgttttttaagacagagtctcactctgttacccaggctggagtgcagtggtgcaatcttggctcaccgcaaactccacctcctgggttcaagtgattctcctgcctcagcctcctgagtagctgggattacgggcacgtaccaccaggcccggctaatttttgtatttttagtagagatgggttttgccatgttggccaggctggtcttgaactgctgacctcaggtgatccacccacctcagcctcccaaagtgctgagattacaggtgtgaaccactgtgcttggccggttccttgaagttaaacaggttaaaagtaagttagaacacaaggatgaaattaaatataccacattttctttaccccacatgaaagaccactcctgtagagaaggatattattctgattaggagctcaggttcttaaatataacatacctgtttttgtatctctgatctattttttagctttataactttttaaattacttagcctcaattttgtcatctataaaacgtacataatactaactacttcatatggttgtgaagattgcattcgctgatgcatgtacaatgtctggcacatcataaacactcaatgtatattattctcaaccattccagttgttctaaaaataatctttaattaccgtagcaactattctgcctctttgcttcttctcactcatcttaccagataattgtgcctttacttttctcttaaatgctggtgtttctcagggatcattcgaagttatctttctcaggagcttcagactcatgtatctgtgtttactagaccattcttggatgtttcatagacatctcaaattcagcatatccttattcccatcccaacctctcacctcgttgtcttatcaatgaatattaatatcatttatattgttgccagagtcagaaacttgggtgtcattattatttcttcctcactctgcccactcctttctccatcagttaactagtccaagtgtttccacctcctaaatatctccattccatccccttctctgtagctgcccttcaactatgctagttcatctctttcctagatcttcttattgtaagtctttcaacagatcttccatcttcctgtactcttcccctttgatgtattttttcatactacagcccagaataatctttcaaaactgcaaatctgatcccattactgcttttcttaaaattctttagtggctttctcttgcccttttaaagtttttaactgattttactgtctagctcacatcttccatgttgtgttttagcattgttgttcttagtattctgtgtgccagctatgctggacttcttttagtttctcaaatgtacattcctgtctctcacatctgggctgttgcctttgccagtccctctatctctcttcttacctctgccatcatctcctctggccaagatggctaactgctacttacacttcagatttctccttaaatgtccttcttcagggacatttcacctgaaccctagactgagttggaaccttctgacagatgtttctatcacttcctacaattaatttttatattattcagcacaattatttgatgtctgtttttcctgcttgaaggtgaaggtagaggtcatagctgggttactcattttttatgttcacagtacctagcacagtgtctggcacatagtaggccttcagcaactattgaatgaatgaatttatcctttgttgcctgtctctttgccccttttttttctttttttttttttttttttcttctttttttgagacagagtttcactcttgttgcccaggctggagtgcattggcacaatctcagctcagtgcaacctccgcctcccagtttgaagcagttctcctgcctcagcctccccattagctgggactacaggcatgcactgccacgcccggctaatttttgcatttttagtagaaatggggtttcaccatggtggccaggctgatctcgaactcctggcctcaggtgatctgcctgcctcggcctcccaaagtgctgggattacaggcgtgagccaccttgcctggccgctccttcctttttctatcttggataatcctaccactgtttctgctaccactatgaagctgggtgtatattcctactctgtttcctttctgactcctgactctccttaagtctctacatttttgtttctatttctaatattctactcattctgagatctccaagggtctcctaatttccacatgtagtgacctttcttgttttccttggttcctaatatttaagtgttttctgccttttctgttttcagactctaagttctatgtctgtggatttcttatattattctagctttaattatcacttctgtataaatggccaaatatgtatttcaaccttaatcctctcttccactgtttaattctgcgtttctagttgactgctataacatttcttttaagatactgtactgccacttcacattcagaatgcctgaaccaaataccttttctctttttatctttaggacataaatagaaaatactttctcttttggcttgttccatccctgtttttaaaccttaggttagtatacatacaatgaaatgctcaaatcctaaggatacctttctttttttgacaaatgcacagtaacccacacccaatcaagaaacagaacatttccattactctaaaaggtttgcttgtgccctttcccggtaatacttcatattatagaagtcctgggctgtgcatggtggctcacactgtaatcctagtgctttaggaggccaaggtgggaggatcatttgaggtcaggagtttgagaccagcctgggcaatgtagtgagacccatatctcttagaaaaatccagtggcatgcatccatagtcataactactctggagactgaggcaggcggtcacttgagctcaagagtttgaggctaccagtgtgtgatgactgtaccacttcaatccagtctcagtgatagagcacaaccctcttaaaaaaataaagaaattctgagtatatcgtttttcttccaatctgttttctttgactaagcatattttgatattaattcatgtagttgtacttatctatagtttgttctttttattgctgaataatattttttccacagtgtatccattttcctgttcatagatacctaagctatttaagaaactccaaacaatcttctaaagtgtcttgctattctatattctcaccaatatatgggagttctttgtggtccacatccactttaacttttgatattgtcaacctttaaaattttactcatcctagtaggtgtagtttatgtgccttgttttcaggtttcttgtgtgtttgtatatgtgtcttctcagatagaatgtaagcttctctatgataggacctgtctttgtctatgtattctccccagcattcatcctgtcatcttgcacatggtaactgcttggtgaatatttattgatgtatattttataaatatgcttcaagatgaattcatgattaaggaataaattagttttgttgaatggaaatgtacatactttaatatatccgaattatttacattgtatttcaggtcagtttacgttgcgagacatgtatgagcaatttcaaaatatcatgaaaatgggccccttcagtcagatcttggttagttatccttaaaactttataccttcttttgttttcattaaattttctaaaatagatacacttgctttaattatttttacattcgggtaaaaatatatctaagacttagtgtcaatattaaacctaatagttaaatgtggacattttgaaccattaatcttaagctactattgactttatgtttaaatctgttgtaggggatgatccctggttttgggacagattttatgagcaaaggaaatgaacaggagtcaatggcaaggctaaagaaattaatgacaataatggatagtatgaatgatcaaggtaagatggcagattattttcctcaggcaaaaatgttctgagtatcagtaagatgagagtttcactgtattcttgtggacaagatggggagaaatttagcctgaaagattatttttaggtagatttgtaatagcttgaaagctcttactcaaagggttatgattattggattgccttcatcgttgagagaaatgtctagtataatacttctccaaatgagttacaaggaaagaacactagttcttcatgatgttcatagagttaacttaaaaggagaactctgagtcaaatgtggtggaatgctagtttttaaagagttaaatttggctgggtgaggtggctcacacctgtaatcctagcactttggcaggccaaggtgggaagattacttgaggccaggagtttaagaccaacctggccaaacgtagcaagaccctgcctctatgaaaaaaaattatttactgaaagtctcttcacggagctttaatattgctaacatacattgggaaactaagaaatggatagcttaagcaatgcttagaaaattctttctgtctgaaacataagaattcagttttctcagtatactgctctgttcccctgaccctataaaggcatgcctcagagatactgtgggtttggttctagaccactgcagtaaaggaaatatcatgcaataaagtcagtcatacagattgttttggttttccagtgtatataaaagttacgtttacaaatacatatactgtagtctattaagtgtgcaagagcattatatctaaaaaacaatgtatataccttaatttaaaaatagttgattgttggccgggcgcagtggctcacgacgcctgtaatcccagcactttgggaggctgaggcgggcggatcacctgaggtcaggagtttgacaccagcctggctaacatggtaaaaccccgtttctactaaaaatacaaaaaaattagccgggcgtggtggcacacacctgtaatcccagctacttgggaggctgaggcaggagaatcgcttgaacccgggaggcggaggttgcagtgagccgagattgtgtcattgcactccagcctgggtgacagagtgagactctgtctcaaaagaaaaaaataaaaaaatatagtttattgctaaaaatgctaatgatcatctaagccttcagtgcattataatctttttgctggtggagggccttagcttgatgttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgctgctgctgctttatcaactaagtttatgtaatattctaacaatttgaacaatttttcatatctgtgctttatctactatctgatttattgttatttttttgtagtctctttttcctgagctccaggttttcatagtagcccaaataagactgtctttttcttttaaggttgttttttttcctcactgtctttaacactgcaaaaatgtttgcatgtagaattcataattgcagcatatctaaagtatccattctgtgccaggcactgtcctgagcactttaaatatattaattcattttatcatcataacaactcctatggcatattcagttattatctgcctttttcaaattaggaaactgggatacagggaagttgagtaatttgcccagtatagaacctttcctgacttccttccttctttgaattaacgccccttcctctatttgcttaactctgtcgtattacttgccacgatgtgctgctattagtttatcttctttcatttgatttgagctgttggaaggaatataatatatatgtttcataaatcttttataaggaagatgtggcttaaaagctgcatttatgaaatggatttggaggttttgatcgtgactttattttgagatattgtatctttgttagtattgcattgataattagacttcacctggatttcagttcacttctggacaatatacttagagggtatgtatagacaaattaaaagatgtaggaaatcaggatgataaatggggttctaaaccatgttagaagagtcagaggtggatatttgtcatccagcgaaaattcacaggagacatggtagctcttatgcatttgaaagctggccaggtgcggtggctctcaactgtaatcccagcattttgggaggctgaggtcggtggatcacttgaggtcaggagttcgagaccagcctgggcaacatggtgaaaccctgtctttactaaaagtacaaaaaaaattagctggctgtggtggcgtgtgcctatagttccagctactcaggagcctgaggtgggagaatcgcttgaaccctggaggtggtggttgcagtgagcgaagcttgcaccactgcactccagcctgagggacagagcaacactctgtctcaaaaaaaaaaaagattttgaaagccttattttttatgcgtagcaaggagacatatacatgaataggaatggaagtgccacgtaaatggatttcaatttaatatgtgtaaagaaaagatttttccctaagtataacagaatggcatagacagccttacattagatagcaggtcatctctcctggggatattaagaccaaggctagataaccatttatttgggggatattgcagagggaatgcagacataatggacattttgactaaagtccatcccattcctgagattgcatgcaactgaagctagaagaaatgcacctgatattctaagagtgatcaaacaactgcgggaattaattcactatatgctactgagagaattaaaatactagtagtagtaattacttgattataggaaataatttttctgttgattatggatagaacgtacctctttctgcttgcttatatagtctacattatgaatttatgattaatatttagggtagagctaaagtgagcatttgtgttcattttttaaatataccatatacctctgatgtttggagggcctggagagggtagacatatgaagtatggaaatgttggacatggggtctcgaaacattctattaatagtttacttaaactgtagggaaagtacatgtttgtttcattgtttttatagcttatgaatactataaatgttcttttgaatatattccgtattttctttttttttttgagatggagtctcgctctgtcgcccaggctggagtgcaatggcgcaatcttggctcactgcaacctctgcctcccaggttcaagcgattcttctgcctcagcctcccgagtagctgggactacaggcacatgccaccatgcccagctaatttttgtattattagtaaagacagggtttcaccatattggccaggctggtgtcgaactcctgacctcatgagctgcctgcctcggcctcacaaagtgttgtgattacaggcatgagccaccacgcctggcctccatgtttaatttttaaaactcaaaagcaaacatagcgaatgttaacatttgttaaatctgggtggtagtttgactatgtattatgtctgtttttctgtatgtaagatattttgtaatataaaaagaaaaatgagatagttatcactttaaaaacatctgctaagctctttgaagttatatattgcccatttgcacataactgctttgatggtgaatgataattgtgtgtgagagtaactgaccttgtctacagaactagacagtacggatggtgccaaagtttttagtaaacaaccaggaagaatccaaagagtagcaagaggatcgggtgtatcaacaagagatgttcaagaacttttgacacaatataccaagtttgcacagatggtaaaaaagatgggaggtatcaaaggacttttcaaaggtaagaaaaataagcttgttattagttaacagacggaaaagaaaggaagttgagaaaaaagagtgctgccagtattggaaaattcacagctgaatttcatgttattttcaagtacttccaggatttatgtgacctgtgatttatctgttttcatattcaaggtaatattaatatttaaaaaaaaactttacatctgtgtagtgtgggtaaatgaaaaaaaattaataaagcaatgattttctttttgtgaacacattatattaaatttagataatataaggaaaaaaaaaacacattacctttactccccagagaatccagtggatcctactgcaaataacagttgctataactaagttttcttctgatatatcataactgtttttccatgttgtcaaatattcttcaaaacataattcttggccaggcacgatggctcatgcctgtcatcctagcactttgggaggctgaggcgggcggatcacttgaggtcaggagttcaagaccagcctggccagcatggtgaaaccctgcctctacttaaaatacaaaaaatatccgggtgtcgtggggtgtacctgttatcccagctactcgggaggctgaggcaggagaatcacttgaacccaggaggcggagcttgcagtgagccgagattgtaccactgtactccagcctgggcaacagagtgagactccggtccccaaacacacacacacacacacacacacacacacacacacacttcttctgagtaatactgtttaagttatgcatgtatctttgtctaatgtagtgccacttttttggacagtaaggctgattcattcacttctatatcagatcagtttttgtgcagttccatgagaccagggatttttgcctgttttgatcagaaacatagtagaagctaaaaaaattttgtagtaatataatttccattatatttctttatttatattattttgagacagagtctctctctgtcacccagactggagtgcagtggcacaatctcggctcactgcagcctctgcttcccaggctcaaacaattctcctgcctcagcctcccgagtaactgggattaaaggcatgcaccactaccgcctggctaatttttgtatttttagtagagacggggtttcactatgttggccaggctggtcttgaactcctgacctcaaatgatgtgcccgcctcggactcccaaagtgctgggattacaggcttgagccaccacgtccggcctcacttccattttaatggttgaatattttctcaatatgtgtttttacattattaagtttaacatttctttgtacatttactggtttgaatttactttgtgaatcacctcttcatgttccctgtccagttcttccatttttcccccttatatctttgtaatagctccttaaaatctttggtttatgtcttcaaatattttcccccagtttttcatttaccttttatttttatttatattttataatgaacagtagttgccctttttaatgtagccagcctatctttttttatttcttttatgctcataaacagcttccccttgtttattttttccttttttttttttctttacagaggtaatcaagttaaccttctccatgttgataccacagttgtcaccattttcttctttttttgagacagagtcttgctctgtcgcccaggctggagtgcactggcatgatctcagctcactgcaacctccgcctcctgggttcaagctattctcctgcctcagtctcccgagtagctgggatttcaagcacgtgccaccatgcccaactaatttttgtatttttagtagagactgggtttcaccatctttactggccaggctggtctcaaactcccaacctcaagtgattcgcccgccttagcttcctaaaatgctctgggattacaggcatgagccacaacacctggcttctacttgtttttgtttttattttgtgtttgactttttaatctcaattgaatttattttgctgtgtattatgtatcgtaaaaagataaggttttccaaagacttccaactgttccagtcctctttttgatttttttctataatgtaaacaactaattcagagtctgtgaaaatttgccttgaaacccattaaaatgaatttattgtttccaaaaatattaattagacaagctctgaatatgaacaataccattgaatagcttctaaaagaatgagtattttcagatgttttaaattaccttttgtctttgaagctttccttattttccttgcgatatcctattttctcttttgtgacaaaaaaattagacaaacatgttgaaaattggttataattcctaccatcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagtgggtatacacacagctatgtcacaccaaacttgaaatactttttagaagttttaaatgctgataaacaaactcttaggacaaatcactaatgagcatggaattcccatcttcttcagatttattcatcataaatggttttcacagattttatcataaaaacataatcttctctttcattcatagtttataattcacatgatttattcacattaaccagctgtgattggagaatcaggaggagctttgagtcccatattttataaatgcttctgagaagtaccatagttaatgcccctttcaaataaataattttggatggttgtggtggctcatacttgtaatcccagcactttgagaggccaaggcaggaggatcccatgagcccaggagggcaaggctgcagtgagccatgatcagagcactgcattccagcctgggcgacagagcaagagcctgtctcaaaaaaaaaaaaaaaaaaattgttgaagcagttctattcattgttgtagtgatgatctcttgctttcttttatgagtacagctgttgtctaaagggtgtttttatctattctggctcagagtgcatttattttttgttgttttttgtttgtttgttttgttttgttttgagacagggtctcgctgtgtcacccaggctgggggctgaagtgcaatggcatgatcatggctcactgcagccttgacctcccaagctcaagcgatcctccaatctgaggcccccaagtagctgagactacagacgcatgctatcacactgagctaatgcttttttttgttttttttgtagagacagggtttccccatgttgcccaggctgatcttgaactcctgggctcaagtaatcagcctaccttcgccacccgaagtgctgggattacaaatgtgacccacctcacccaggctgcatctctttcattgactgccctttttactatggtgttttgacatagtgtagaaattccttgacaagtgaagttgcattatttgtctttgtattctctgaaggttttcattacttaaagaaaacttctggccaggcgctgtggcctacgcctgtaatcccagcactttgggaggccaaggcgggcagatcatgaggtcaagagatcgaaaccatcctggccaaaatggtgaaaccctgtctctactaaaaatacaaaaattagctgggtgtggtggctcatgcctgtaatcccagctactcgggaggctgagacaggagaatggtgtgaacccgggaggcgggggttgcagtgggctgagttcgtgccattgcactccagcctgggtgacagagctagactccatctcaaaaacaaaacaaaacaaaaaaaacttcttagatacatacacatcttcacgttctctcagactcatactttactttctactttcttttttttttttttttcttctgagacagagtcttgctctgtcgcccaggctggagtacagtggtgcgatcttgattcactgcaacctccgcctcccggattcaagcaattctgcctcagtctcctgagtagctgggactacaggcgtgtgccaccatgtctgactaatttattttgtattgttagtggagacggggtttcaccacgttggctaggctggtctcgaactcctgacctcaagtgatctgccagcctcggcctcccagagtgctaggattatagttgtgagccaccacagccagcccaacagactcatactttcatattcatctaccagccatccagtctctttgctaattaacccatgtctataaactcagctttttgtccagcattcccctgtatcactattaagccgttgttatagcttactattaaaaactgctggctgaccaggtacggtgtctcacacctgtaatcccagcactctgggaggctgaggtgagtgggtcacgaggtcaggtgtttgagaccagcctggccaagatggtgaaaccctgtctctactaaaaatacaaaaattagctgggtgtggtggcgggcacctgtaatcccagctacttgggaggctgaggcaggagaattacttgaacctgggaggtggaggttgcagtgagccgagatcacgccactgcactctagcctgggtgacagagcaagactccatctcaaaataaataaaaaataaaacactgggtacaattttgctaatagtggcttattcacagatataaataaagtattagcataaatcgtagccttaaaaaagccttttatatgtccttttatatagaattttacatggtcttcaaaaaatagtatgtaattgagaaaaagattagaagggaatatgtagaaatagaaagaattatgttagagtgataggattatgtaattttttcttagtattttctcagttcatcaaactttctattataccctgattatactgattatattacctcctacgctgactcaaaatctttttttttttcccctcaggtggcgacatgtctaagaatgtgagccagtcacagatggcaaaattgaaccaacaaatggccaaaatgatggatcctagggttcttcatcacatgggtaaataccaagttgttggcagttgctaatgcagtttaatttataagggttgagttttaatgataagccttttattgtaatattatgaaaatatgttcaaaaggtgtgtgatttcagggaaatggtcatctgaatcctaagttgaattcaattgtaatagggcttattagctgaggtcttattcactcctctgctgccatctgtgtgatgtttgagcaagctatttaatcatcttttgtttgttctggtgactttttcccttattttagaacctggatatttttacttatatgactgaggatttttaacctgagttctactttgactatataacctttacaaagttccttaaactttctgaacctcactttccccttcggtaaaatcacagatcatatctcatcaagaaattgtgacaattaaatgagataatatatatgaagacattcagtacaattctgggcatatagtagatgttcaataaatgaattattttctttttgtaagtcctatgaaataatcccctattgattattttttatgtaacttagagtaagacccttttggatttataagaaaaaaattttttgtttagatttattgactatgtgaccggtagtatcctaagatctttttatgtatcacctcatttattcctcgcaataactccgtaagataggctattcattctcttttattgatgaagataactggtgataatacaaatttttaggtggtacgttctttaaggctgatgactaaattgcaatcagaattcagtatttttagaagtacttattaggcaaaagtaataaatgtttccagttctgcttaataattctctgtttttaactctacttccctacttttgctctaggtggtatggcaggacttcagtcaatgatgaggcagtttcaacagggtgctgctggcaacatgaaaggcatgatgggattcaataatatgtaaagaaaatgccttaatataaactgactcagttgaatacctaatttgctgagacctcagcgtttcccttctttttgcgaattggggggaaagtgtatttttcttgcttatcatgcactctttccttttcttctcgcccgcttttcccctccttttctttttccttccttctttcctccctttaatataagggagaaatacatggtttttgtggaaatcattatatgtttgctttagattttcttctgttttcaccatcataacacttaagttaaatcatgatgtaaaattttagtacttaaaggtttttaattatctcgaaggccaagcattgcatttgtaaacagtcctggtcagtagttaaataatgtttcaattaaagtgctgtaaaataaacttcaaagtggttataagttaaggggttgttaactttctttatggttaaacattatcagtttatcacactaaaaactcaatggaaaagccagtagataaatgtcatttaaaactatgcctggggccgagcacggtggctcacgcctctaatcccagcactttgtgaggctgaagtgtggatctcttcagcctgggtgacagaaggaggatcacctgaggtcaggagttcaagaccagcctggccaacatggaaaccccgtctctactaaaactacaaaaattagctgggcgtagtgatgcatgcctgtagttccagctactcgggaggctgatgcatgagaatctcttgaacccgggaggcagagattgcagtgagccgagatcgcgcctctgcactccagcctgggtgacagagtgagactctgtctcaaaagaaaaaaaaaaaagaagaggccaagcatggtggctcatgcccaggctggtctggaactcctgagctcaagtgatcctcctgccttggtctcccaaagtgctgggattacaggcctgagccagtgcacccagccaatcattgattttttttttttcttttttgagacagggtcttgctttgttgcccaggctggagtgcagtggcacgatctcggctcactgcaacctctgcatcccaggttcaagtgattctcctgccttagcctcctgagtagctgggattacaggcatgtgacaagacacctggctaatttttttttttttttttttgagacagagtctccttctgtcacccaggctgaagtgcaatggcatgatctcggttcactgcaacctccacctcccaggtttgagcaattctcctgcctcagcctccctagtagctgggattacaggtacgcaccaccatgtctggctaatttttgtatttttagtagagatggggtttcgccatgttggccaggctggtctcaaactcctgacttcaggtgatccacctgtctcggcctctcaaagttctgggattacaggcatgagccactgcgcctggccaatttttgtatttttagtagagatgaggtttcaccatgttggccatgctggtcttgaactcatggccttgagtgatgtgcccactctgtcctcccaaagtgctgggattatgggcatgagccaccatgcttggcctaatctttcatttttttaaagccatttttgttatgttttctacataccaaaaatatacttgaagaacttgatatacttcgatgataatagctaatgtatacatcttctaaaggaaaaataattgcaagtattaggttgtcactattatatattaaaaataatgacctgacaggagttcgagaccagtctgaccaacatggtgaaaccctgcctctattgaaagtataaaaattagctgggcatggtggcagacacctgtaatctcagctgctcgagaggctgagacagaggagtcgcttgaacctgggaggcagaggttgcagtgagccaagatcgcgccactgcactccagcctgtgtgacaagagcaatactcttgtttcaacaacaacaaaaaaagaaaagccaggcatggtggttcatgcctgtaatcccagcactttgggaggcccaggcgggtggattatgaggtcaggagttcaagaccagcttggctaacatagtgaaaccctgtctctaccaaaaataaaaaagaattagccaggtatggtggcactcacctagtagtcccagctacttgggaggctgaggcaggagaatcacttgaactcgggaggtggaggttgtggtaagctgagagtgcgccactgcactccagcctgggcaatggagcgagactcccgtctcaaaaaaaaaaaaaaaaaatgacctgaatctaaaatgaaagttaaaaacataaatcatgagaccgtgacaaagttgatttggtttctggttatcttggattgctgcatggttcatttagaacaatggcttttaaataaattaaggaattgaaaatactgga

SEQ ID NO: 13257 - DNA, 6704 bp, Human
gtgctttgcatttgctgtgcatttgaatgtttccaccagcgtggatggcatcttagtttccacctgggttcttcttgaacttgcctctttttatctggcgtagccctggataccgtattcatttcaaaggcatagacttgttaatagccctaaaaaaggtgcagatggatttcccactggtcagatgattaagcagcccattggtgtgagagggaacctgattttcaggagagatctttttcttagagatgacaggacagaagagaggagacagcaatggtgtggctagcaaaccttagtgactgacagtgtcactctcccacctctggttttcaaggtcttcactttagagagatcgcaccctgaaaaggttgctacttctctggcccctgaagatgctggatcaatgaaccagtgttgctttaagaaaataattctgaaaaaaaagtacaaagtaccattcactgaaagaaataataataataataggaaggaaaactccctcctcctcgcaataacttcggagccactatatttattgaactgggttaccctagattgagttgagaacactcctgcttctttcaacggggccacaagacctagtccaaaaccccaagactaattgtgtagaccttaagtaattgcttttcctaaatataaacagcacctccccaacccaaataacctgaaagtggattaaggttggaggaggattggtaaaagctgattaatagattcattcccacttaaatgacaaccctcccctcttgccttctatccatcgaagttctaaagaccctgctgtgattgcttttctggaaggcttttgtcactgaagtgtgtgaagttactcctggtttgaggagttggaaattttacacgagtcaaggattgcagtggcggcagctgggacgcatctgtaacggtgttagtttgcctgaaagcagaaaattagcaaccccaaagcccagcttggctgtttagtctgtagaaatgacagggcggagcagaaagagagggagaaaggagactcacccctggaaagggagtttgccgtcgaaaactgggcttcttctgttggaaatcttagagacactttcagtgcaggtctttggcctgctcaggatctagggaaggcctggcacaaaggagaaggtgctcaacaaatacgtacagaaggggaaaatgaaggaagcaagaacgggaggaatgttcctggtcacctggccctcctgtgccccacctccttttagatgagcagacatacagggagaactcagagcaagcccagtcatgggaaaaggaacctccctccctactctcaataaggtagagcctagaataaatgacaatctgagcaaaactttactcatctgaagctatacaaaatagatttggaaaggcaaaccctgtattcactccaagattgaaaatgccacttcaagtttttagtaaccgttattcaatccaattgctggaaaaagttttcgagataattgaagttcatgaaaaagagaaacaaacacccccaaatcaggtgattcctcacgcccaggattgggagggcaggtcggctcttggtgccagctgaaagggatttctatttattaccactattttaaaatgtgtgtccaattgcaaaaagttggactgccttggtcacttttgtgtgaaacactccttaagtgatcccttgttttagcctatctagagagtgcaaatgagcaggttggggacccactgccgccccagcagaaatacagtaaaaccattagcgtcaaaaggggcagtacacagcagattgtctgtagaggaaaggcggaggtttgtccagacagcccccgcgggggttgcggtgggatatgctaatagtgcctggccactggggccggcctccctcccgaaagaatatataaagaaccccaaccccagcttgtctacccaggccaacaggcgtctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatggtaagcaatagatctggtacctgctaggctaccctaatcttttctaaagtccttacacctcatttaacctggtgtggtggggagagtggggtggaggcagatgctgagttgctttaaaagaagagaggggtccacatttagaaagactccccaaaccgctgctgaacaagattttagtttaactttctagcaggttctaggtgtacactgtaatcgagtgttgacatggaagatgggtggctgtgaatgatcactcagatgttttctccattcctgaatttattttcaaaatatgccatctgtggatcatgccctacgctaatatctaaaggcaccgtttctaacttaatgaggaaatggaaagaaatacccacacggccccagttcctgctccaatgaggcctggctgaaagatgttgatgcattctttttagagggcgtttgctccaaggctgccaggttttaatgtgtttttgccctgggaaagtgttctttccctgaattagtgtggctttcttctactccaatccattttgcatggttaacccaatgcacattgctgctgaattccaccccctcttccctttgctgctgctctcctcttcttcaagcacagagattgacctcagtgccctgggaatttggagagggctagcccttcctaaatcaaggcagtgaaggtgattgacagtgttcggttacagagctggtgggcaagcacagcctcacctttggtcagaacatcttttgccaagacctgaaaacaaactttgttgtgtgtcttgtattatagcccgaatgtaacagtcctgtctggtccagaaagagcagtacttttgacagcatctactgtcctgatgtatcaaatggtaagaattgataacttcacaggagtttaaagaccagttcaacctaacaattcagcctataagattctgttcttgctgatagtattggggaagggagaatggaagtgatggttcttatagggaggctttggtaaagcaaaataaacacatcttctgctccaaatccccctagcagacacgcacgcacacatgcatacacacatgcacacacaatgttgcttgaaatattatcagggggcttccccactccccacgtctacccctcaggaattgccagatatttgttgcaaatttctatgttaggctttctgtgaccacctgacctctgggtgtcagaggagctgacctacaatttaaggagcaacataagcaaatctgtctatcttgggctaattattttttaatgcttttctccttgtatccttagtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaagaaatattttggctcatgatcttttaaaataacaccccaatggaattactgttcattgacatgaaatctttacatgtgagctgaaaatacttaaacagttggcttttcagataagtctgaatatttaccattctcatgtacccagtttaggtcctgttgatgtcacaagtgaaaatgtcatattttcattttaaatatatttcaagtgaacctgctaaatgaaacttttcctttatcttagaactgtaccatatactatcaagtcgtttgtgtgtgaagggaagatagaggttattcaggacagtaacacatgcttttttaaaaaagactatacaacatcacatcattttaataactatagtacaacagaaggcatgagttaagtcatatttacttttactacctgcctgaaaatatcttgataatatatactaatattgtcaataaaatatttaaaggtattgggctgattttttttatattgctagagtgccaacataagaaaacttacacaaattatactgaagtgagacagacttgagttttcttccttctttttacagccttttaaactttattgtattaatcatatcatgtatgcgtgtgtgtgcatgtgtgtatgtaaaacagacttgtctcatattcatcaccctaaatctcctctagaaagaactgatatgaaaaaattgaacaattaagtggaaaattaggttgagacaatgattgggataattatcacaagtttaccattgagagagattttaaaaagagattcttaaagtatctaaagtagctattcacagagaacaaatattgataattgtttaatcctcttatatgtacattgatttaaaattcctaaggatttgtggttacatacattaatttaaaaaaagcatacagactctttactagagcttggcaatgctactgttctcaggaaggtttctctttctctctggtgtgatttgctcatgcttatgcagtcatgaagcttaaaggaatgggaatcattccataagggaggtataagggctgagttaaaaaatatgatggccactgtcactctgttagcatcatggcctgacagggaacgctgacttttagcacacagatataagtctttactcatgatttcagagtgtgaggattttacatgaaaagaattcaagagggcatgatagagatttgtgtatatgtccaacataagtctgggttatccacttttgttagaaactgtgctaggtacattttctccttttgatacttctatggagacattggagatttgtttttaataggatcagacaggaaaaaaattcaaatattggtttagttttttaaacttcaatttttaaacacattaccatattttgtttcatttaatataattaagcagaaaatatgaaatttttggttcaaatgaatgaaaattaaactttttcaaatcaaatctcaattgctttataactttgcaagcatacctaatattctcaatgaatatgataatgataatttgaagtagttagagccttttcagtggtctggatataatacaaggggtggttaatgtacaatttaaaacaatattctccatgccatgttgctcaattaatctcattttcaatgtactaacattgaaggctgatgtctgctcagcacaacacagcatttgcagtcatacatacttctttttagacaagggaactttggaaattggttttccagtggttcagatccagaaaggtcttattttcttttaaaaagcagggaaaaaaaagaaatggaactcacaaaaagatcgaagtaaggatgggattttgtcatctataaatctcctgcagtgaacacttgggtttctgagtttgtattagcccacttcacctcagctggtggaaaacatgcagcaaaccaacagtcagatttctaagagcaactaggacaatattcccttccccgtctgcaagcgtgatggggaagaggttttcaggaagtgagagtcaaaa

SEQ ID NO: 13258 - DNA, 6722 bp, Human
gttcaactggttttataaggctttcagaaggggtcctgctgctgctagtgcaggcagttaaaaatagtatggagaacaagggcttgggggaagtctgagtccaatcctagcattttgttgatttaatatttctgttttttagatgagacaatttaagcacatgaccgagaggccaagttggagaccaggtttagaagagaaaaactttcacttgactcctaatttgtactcagtgacacattaacgacaatgtaagtgaaagcagggaactaagggtgggtcaggttaggtgggagaccaggagttgttattctagtgttatggtaatttcatgaatttacttttgcttctcgatcttctttttgagtagtaaaagaggtttcatgcctccagtgaaattactatttttaagcagagttctatctgaaaagttctataagaaaaaaaaaaaccactctttaattttttcacatgtaactacttagttatgtgtactaatgaaaaaataatctagaagttattttttcaaatcgagttttacatattttttaaacaataaaacgttttctcctgttttataatgtcattatttttgcttcatttctatatcctttagctcagtattaaaaagaaaaaaaaaacactcaaagtggtgtgttttgcaatattgatgatcaactaaggtcgggatatttatttccatctggtagagttcaacttctgcctcctgtttgctttctccatctgcctgcctcccttcatctttctttttttcttttcccccttctccttaatggagttggggttaaccctgtcttaggcctaatcgttttagcaggctcccgccttcctgttacactggtttttaaggttgtttttttttttttttggtagggtttcaaataaacttgaatgtctacacttaatactttcacaagcttcaaattctttttattttatttttataaagagcaggactcaggctaggacggcatttggactaggtaaaaaagaaaatcttcagttttgtgcacacaagttttaaaatacattgtacagattttttttttttggatacacaccactctttacaggatccgcgttatatctgctttcagtaactggctctcctgtccgcatccagtaaggtttccactcttctctccgttgactgctgaagttactgaaacagcaaccacaaatggccttactaacctacttattttgcaattaaacttttaaaagatatccccctactcctcccctagggtggaacagaaatggctccgcggcgttggcagctcgtctgcgaggggaccctggctccccgaggctgcagtcctttttcttggacagaacgccccgcaggaccgttccctccactttcccccgcactaaggcagcgcaccgccagcacacacagcgctggcgcccgcatcgcgccgcaccacacgcgtctccggcttgaggagccagtcaccgagacccggagcgggaacgagatgtaaacacggagtggggacatgcagcccgatctgagaaggcggcgtgaagagtagacacagcctgcgccaggcggttcttatttacccagcacttacactccagggcaagcgggcccaggcagcgcactcttggagaaggatgcactggcgcagagcctggacctgctgaagcgggaaggaggagctagggctgggggcggagctttcacacgcgcaccctctgttccctccctccctccctcgacacaagcaactgggtctccagccgccactccgggtttatttgtttacaagcggattacgtcagctcctccctctcttccctatctctggacccgcctcctgaactcttttcccgcccctttcggctccgaaccggcttgcgtcacaatggtgcgatattcggattggctggagtcggccatcacgctccagctacgccacttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcaggtgagcagggcgagggcgtcggagggacgcgggccccacatccctgggtcagagtccggccgtcggggctgcgggaacctcggcagcgccccggggccggtcgcgcttgggccccgccgcgggaccggtgtggttgcgctgggtggccgctaacagcggttccccgcgaggctttaggggctggacggagggcgcccccttccccccagctggcaaaacggagaggagaagacaacacgcacaacaaagaaacttaagcccaccgaggcgggagctgcggtccgaggaccgtcggcggatttggggacaaaggagccgtggggctggggtgggttcgacgtcccctttcctcagccccctccaaccgttgcgtggtcggcggcccagccccggggtgggaagctgcgccgctgccccggagccagctcagaacggacgtgccgtctccccgcgcctcctgcccctgcccattaatcatcggatttgtcaccggcacaattaacagccctgcccagagcgtggtttagggttgcttgtttttcttcccttcggggttaacagtccggtggcgcttctcatctccaaagccatcaactccattgtgtgcatctggggtggggtggagaaagtaaacagtttctcgcctggccataggtgccagtggcttcccgactggccgaggctgcgcgcctgattcctgttttggcggctcaaccggttggttcctggagattgttttgtccggtactactgtgttatttctaaaaccctgcccgctttttccatccccgcacatgcacaacaacggatgcaatcctggacattttaaaaagttgatagttttcattttcgctcctcaaaggagcctggggtaggaggaatccgcagtgggagctaacgatcctaagcgttgtttctctgttcttcttttcttctatagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatatctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccg

SEQ ID NO: 13259 - DNA, 57605 bp, Human
gggagaactggaacagagcctgggctacttcagccagtccctccctatctcaggatgttgcatcccagctcgttatgcagttactcttgaaaactacaaaggaaaaggagggagaagtgggtaggcccaaggctatacagagaactgtcctgcacaatgaagcacctgcatctgtttagtcactgttcccagaggtcatcattgagggaataggggggccttcagatcccatttctgacaccagaactgttaaaagagaaactttacacaaaacaaattcgagtttattcgagcaagaaaacaattcatgaatcaggcagcatgcagaagcagaagaggttcagagagttccactcagcagcatgagcagcaagcttttatagacccaacacggaagcagaaaaattacttgattgggttttggtttgcttgcataggagctggtgttacagagttgatctcaagctaatggcctccttatttgctttagcaccccacacctgaacccaagggaaagcttgaagggagcccagcaccgaaacaaactagtaaatgcctgggggcaaacaacagtgtttttatcaagtaaccatgacacatacatcttcctcagcagtggcagagcagtcttgtagagttagataggaagatgatggcctggccacgcatgctcagctgctggcccggctcattctacaggtattaaccagtatttggcccacagtgtgctaagcaccattctaggtgctgaggatgctaaggtgaccccaacaatgtccctgatctcttaaagctaattctggtgggatgctgaacacaggatgtaacctaaggtggtgatgagaggtacacagacaaatcggaaggcacaagttagccaccagtgaggggaaactccagacaacgtagacacataaggccaggtggagaaatggatgactgagttaaacttgggtaaggagcctggcaaatgaagacagaagcatgacccagtcaggggaaaccacaacaaaagacgtttggtgggaactgcctgtttcttaatttccaaaaatcagttaaaggttcatatacattatctcatttcaacatcactggtagaaagattccatttttatggagaggggatctgaggcccagaaaggagacgatctgtcatcgttttccactcaagggcaaacatggggatatcccatcccatcccaaagcctaagattttgcactccaggccctttgtctgacctgaaattactgagctaaaagggaccgaaagatcctaatggaaccaccgatgggaaaactgcggcccaggaggaaacacaccaagcaaaattgcaccgtatccaggtggccagtctccagactggggtctccctgccccgccagaccatctcccggcgacaagggtctcaggtttccgaaatctcgccacccgcgagtgatttgcagcgcaggggcctctgctgcctcggaaaccttcaaaggtgggcgggtcggggaccaagtccccctagggatggagaaggaaacggggccaaggaaaaggacatcgccaccctgggcagagcacgcacggccccagcgactcggacatggtgaggggcgcggaggctcggggtggacccgaggcctccacacatgtggcaggctgcagcaacccgccacccacgaggactcgcccaaggcccagagcgcgccgggcccctccctccgactccgtcgccgcccgactggccgcagcggaagccggcgcgcgatcccacgctgcgctttcgccacgtcctgacggctgcccgataaaacggacattaaaattgcactttccactgaatacagcagcgcctattgtggcggcacacctgaatgcgaaaattaaagccaaaatatttcctagcggctaaaagagctccaagcctaggcgaatctgccggtccgctcgccggaaatgcgggctctcctgccggaagctgcccctccaccattttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacaggtcggttcctctccccacccgtcgatccttcccttccctcacccgcttgatctcgtctgatgttgacttgactgcaaggactgcagagagttttctggagccagcggggatctgggggacaccccctcccctgtccccacctcctcctggtgttctggtggggagggggacggtgaaacctgccctaaggcactggctggaattgcgtgccgcgtccgtctccggagggatcgtctctggtcccgcagcccctctcgacccctcaccctgtcgctgggctgcagttggcgattccgcgcggtgaaagcagccagtgcccagggtcttttcctgagtgcacctgggcctgccgcccggcgatgccatggggtcgtgcgctgcttttctacttgccgcgctctcactgctcggtgtactgggagggtaccctgggaggcgtgcctttattcttccgaaccgccgctcactgagacagtggctagaagtgtctcttggacctgtgagttagccttaacctgttatgcccccagagccctcagtggagcgcccgtactttgccggcatgacgtttgatttcccggtgataatccgacgagtttgacagattgaggtagtgagcaaagttgcccgtcagttggtggccacttgacttcgtgcggaccctggccttgctcttggaagagatagtgttcttagggctggtttcactgtctcttaagactgaagggtggagctgggatatagatgtgttgtttcttttcaaatcaaacctgctttaggtcgtcactcgagggtgtctagcgattatgggcagtgggggcctgggattagggatttctaaaggcgtttgatttgaaaaggataacattacatgatgtaggtggtttgctcccctctttcttcccattttttcaatcccccttcccctcgtctctgggttttggggttgttgtggggtggttttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggaattagagctcgaaaacgagaactggtgaagggagggccgcggaatcagatcatgtctggatctgatggctccgtgctgtgctcaagcgtgctgtgccttcacaccatggtttatattgaatgtgtcgcctgagttgtcaggcttgcttttccaaagtgtcacttgtgttatttatcattaaagtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggtttacatcaaaatccaattaattttgaaatttaatgaaatgcagtaacttgactaccttggaattttgggcctttttcctgtaaatgtcttttttggtctacattaatatttttggttcccattacaaaagtcagcattaaaaaaataagcagacttttgtttgtttctctacatttgtttttgaaaccctaaacctgagtgttttaagtaaagttcactaactcattcatttattatctgacagttacacgttgacagcatcctcattgaatcctttatgttaaaagcatagcagaaagtgctcccattacttatttggccaaactactgtttggtccatgcaagagaaacatggaagtgtcttcatgtatgttatttccttgagggtataaagttcagaaggaaatattgataccatatcttctaatagttttgctctgttcccagtgaacctccttaaactgcatgtatatgtcactgttccaatgtatgtgtgtctctctatcacgtaacccagcacttatttcctcagccaagtggctagggggcgagcctagccaagattttacctccaatggacgcaagtttctttggtgaagatctctcctgagagttcgggactagcagaaagaagcgaggaaatttcgaccgtttggttcttacggataggtatttatgtatttggtttgtgtgaatgtaagctatgatatttaacttttcagaaaaaaataataattttttgcaagtggcattgaatggttgaccaaaccataatggtaagaactgccagtgaagtgggtaccatttttgctattaatggattgtttgcctttagttataaatgttatcttactgtggaaaggaatttagagtttgttaagataacttgagtttaaaagtaggtgagatatgactatccaaattaaatataaatctgggaagagtttttatacttgttttaatatttttgtttattttaatcggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaaggtactgctcaagacaaacttacttcagcaacaaactttttaaaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagaggtgagtggggagctgcctggactgctggtgtagggctacacgtgtacgcacaggctgcatgcaccgtggtccagtctgcagaacacatctctggcactcatgatagcaccactatgaccacaggagaaaacgggagtgatattccttcttttggtaaaacgaagttaaaaactagaatgattaatggaggtggaaagtgaatgcgttggattatttatttctcattgattcgggtaacagaattactcattcaggattatttgtttctagattggtaacatgttcattaatatcctcagggattcattcttgaggcagtgaaagaataggtgttaactgggataagttaacatcaccgccctctcactgacctgcttccccatatccctccacaactgagacagtgacacatgcccagtggaaggacacagtgagggagtttctactccccagaaaacagcacagcttcctggtagccttgatgccacctagggcatatacttaccacagtattttaaattaaagatttggaatttatgcttttctggattaacatgggaaactttgaatataaaaaatagtgctgctgaaaaacctgggctcgtgtagtatagacacaaatatcctcaatcacttcactaagcgtcgagagctccactaccatagcgctgcatcatggtcagtcgttaattagcagtaatgctaacatgaacctgacaccttaaagacgggtcagtatattcaggatattctgtttaaaaagaagaagaacattaacttagaaacattcaaatgtttacattacatcaaatggagatttaattgtagagctaatttaatctgttattctgaacttcatcggtttctccttaagtaacactttttatctttttaaatttttttattaaaatacacaataatttaaaaaaagagatggggtctcactgtgttgcccaagctagtctcaaactcctgagctcaagtgatcctactgccttggcctcccaaagcactgggattacaggcatgagccaccacatccagccaagtgacacatcttttaacaagtatgaagcaattatagcactttagtagtaaagcaaaatgatgtttgcccttccatcctgtgactgcactatggttctacccatcggcactctccaagggctgcgatcctaacggaatgataggacgtggggcaaacgcacacaccggctttccttttgccctgtctttagtcctgctccttactttgtgggcacaagaattactgttgcacagctctattttatgagcttttagagaaactttcaagtgtaattgtaattatactgagttaaaggccagttaaggtatttaagactttttgcattgactttcaaacctacccatccctcagaagttacgatgcactagaaatgttctatcaggtctaaaacgtaaacacccatttatttatccagaataagctctccttcctcgggttctggatagttctgattttgttgtcttatctctaagccacacacatgagttcagctttctatctgtggtgtttttatcagaaggaaggaatagatactatagccacttcacaaataaagagttgaaatacagtcagcttattgggtccacatctgtggattcaaccaaccacagatctaaagtattggaaagaaaataacaaagttttattggaacacagcaatgctcatttgtttacatattgtctgttgccactttcgcacttcagcaacagagttgaagaaatgaaacaccatatggcccacaaaaccagaaatatttattaatactgtctggcattttatagagtttgtcagcccctattctagatgatggaccattgtctcggcgtaattattgggctaaatgatgttcagtttgttataattattgaatcttgagaacttcagcatgacttagcttatcatctgagtattagtttgctttccccttaagataaagttctctttagtattttacaatgttacttcttttctttctgtaatcgtgttctcagaacattgccttatatactgattaatttcgttaatggaaattgggcccacataaaacttagagcttgacatttcgtgtttaacttgcattaatataagtgaaacacctaacacacacacacacatacgtgcatattgtaatagaatccagtaccactaacagccccattgagcgtcacattctgttaaaataaaattttttttcctgagccatcaatatgtctacgtatgtcttgattttcaaaattactgtattgtattgtttgttagtattttaaagccttgtgatactagccaaaagcattttgatggtgcctccatctctgatctttactattttcagtcaagtttttatcctttagatgttcataatttttcatcattattctatatccatttttttccctcttttttaggggaataatggggcggggacaggccctcactgctatatatccattttttaaacaaaaggttatttgaatttatttaaatctgagtttgtagtgcaatggttggtttttattttgtgctactaaagctgtttttttgtaaataaaggtatatataagaatagaccaaatctgtttaacccatcaatcccaaaaagctatttcaattaaaatgccttgatttttatgaataacttaacattaaggagaagctatttgcctagacaatgttttaatcatttttttcattttaggaaaatatagtaaaagttgtatttttaaatttactttgttttacttttttgagacagagtctcgctctgtcacccaggctggaatgcagtggtgcggtgtcagctcactgcaacctccacctcccgggttcaagcaattcttgtgctttagcctcccaaatagctgggattacaggcgcccgccaccacaactggctaatttttctatttttaatggagacaggatttcaccatgttggccagactggtctcaaactcctgacctcaagtgatccgcctgcctcggcctcccaaagtgctgggattccaggcgtgagccaccacacccggttacaggtgtgagccactgagcccggcttcatctctgatttttgaaagaacaggggactcaaacaaatggatgggacggtgttaaataactgtaacttaatagggattgtaatcaacttatatctgatcagactggaatacccaagtttttgtataccaggaaacctgcttaaaattcttctttggtttcacggaatgaggtttgacaggagatctttgcaaattattgatcgcttcaagagcctttactgtatatgatagaaacacttattttgatgaagatttaaggtttgtttctttaatgtcatctgtttggaaataagaacctcaatagatcattgaaatccttaaaaatgttacctttttaaagtttgctatgatatttttgtacatttcagtgtgtctttttaaactggtaatcatctgagttactgagatgtacttaggtaccttagaatacagaaagataatgtgtagtacgttgtctaccacatagtagacaagtatttgttaagtgaatggttaatgaatacatagaaatggaaaaataattgattatttgtgaaagaggtagtttgcttgggtggaggaatcttgatagttatgcccaggtggtttacaattcaaagatgaaaatcagttatctaggaattgactaccttatgtagtgtcatgctgtcaggaatccacagaaatagttggagagaaatcttagcgataccaattaaatacatacatacctgaaagagcagcggaggggaaaaggaacatggattgagcacctgctaagtgtggaggattatggtagagatgttcacatgggctatctcacctaagccccacttggccctgggagtggatgtgatgacttcacaaccagtgaggaaacagagaacagcagaatcccggagctaacaagcggcagggcaggagtttaactacagttaacccttgaacaacacaggtttgaattgcgtaggtccgcttgtatgaggatttttttcagccaaacactgatcagattgagggatgtgagacccgcatatatggagggtcagcttctttatatatgtgggttcaaatggaccaaatgcagaattcgagcacgtgtggatattggtgtctgcaagggtcctagaaccagtcccctgcgtataccaagggaataccgtgcagtctgaccctatacacactccttctgctgcaccccacctccccccaccaccccacctcatttggaattttgtaaagtgagtttcacttgcgttgtgggtagaagagaaagctgaagatggcttctaggagtaacaacagaaggtaaagaagcagggacagccagtcacatgcttccatcttgctgcctgctgttagcaggtgccttcctccctgcattgttctgaattttttaattttctttttatgcagaaaaaaatgaggccgaaaatttagaggaaaatgaagagcccttcgttgcccccttaggattgagcgtcccgtctgacgtggagttggtatgtgtcctgcatgagcactagttgtcgtcattattatttatcataattcactcctgcttgtgggaaagctcaataatgattatagctgctttttaggcatataatgctttaaaatggtttgtgagttaatggagaaaaagatcacaccctatttattttccccaaaggaaaagggaagaattatagcaaaagagctagactggagcatcagggacttgaggagttgggtgtgattcagcggccatgtagttgaatccccagattttactagcttagaaaaactaaatcaggatcagtggcgagtgggctgctccccacacatagatgtaaaagcactcaagatcaagacagcgttgatttcagtaacgttgctttgttctggctttttaaagtgtgatttttgggggcacttcacgttacattttcttagcagttttctgtgttgtgataggtccctgtggcatctccaggcccaggccacccttccactgatgaaggggaattccaccctggttttcctcatctgagggctttgcaactggttactgtctgttcagcattgacctttcctgctatttcagttatatcacattaaattaagttataacaggtgttaaagcccaaaccaggatttttcctttttttctgaatattcattgagggatttccccattccagtcactgtgctaagctgttttttacatattatcttatttaatgctaacaaccctataagcgaactactgtttactatccctcttgtgccagtgaagaaactgagacttaggaaagtcaagaatttggctaataaatagcaactgggaacgttggtcttaactatgatgccatcttcagtcaccgtgctttatgggatttttatatgtttactgggaaggttgaaaatctttttgttgtgtgtgtatacttgggaaggactcttaagtgttcgtgcctagcaggaagttttttcttggacattttcgtaactggattgcaagtggcatcgatgcaggcattctcaattcttgtttgtgtcccacatcctgaatcactcactgcatggtagatgccgggaaagctccgcacagagagagcatctctcacctcccactgcgatcactcgctgccactctaattgagttcagcgtgaatttgatggttcttacccttcattaatctgatgaagggcaatataaaaatagcccttttaattcctgcctccaacgctttccttctcttcccttattcatttacatatcctctccctctcttttattctttcaaatatgggtaaaataactttttggattttgcctagtataattactacttgtattggtctgttctcacacagctataaaaaaatacctgagactgggtaatttataaagaagaggtttaattggctcacgattctgcaggctgtacaggaagccgggcagcatctgcttctggggaggcctcaggaaacttatagtcatggcggaaggtgaggagggagcaggcatgtctaagcatgtccagagcaggaggaaggcagggaggtgctacacactttcaaatgaccagatcttacgacagctcattcactgtctatcacgggagcagcaccgaggagatggtgcgaaactattcatgaaggatccaccccatgattcattcacctcccaccaggcactgcctccaacattgggaatgacaattctacaggagatttggctggggacacagatccaaactgatccaaactatattactacatatgtttgtttctccatttctagtattgatcattttgctgtagttaaagctgaaattacccaaagatttgatatcctgagacttgtattaatatattttccatgtattatatatattgtattcctatttgttctgaaatatgtttattatgcatgagagacacattaacatgaagctttaaaaaatcacagttgctccatttttattaaatgctaagtgctccatctctatttaatgctaaaaagtttatatgaagttgactatatggaattttacttgtttttagtgttaaaaattttttaattttttattcaaatttaaatatagaggtacaatggaattgtgttgccttaattcctattaaaatatttaatggctttgtgttctcagccaaaataagcatcactaagctcttgatagtctgccagatcaaacatacttgtcactcattggagagcaaagtaagtcttagtgtgtagcaacttgctgtcttatcattagagtttcttctaatgatattatagaaaggcctcttgaatgttgttttgactttgtggaaactgagtgcttgattgagtctctcatttgcgtctttcatttattttatggcagtgtcagtatttcattctcataattattatgtgttttttggcagtaattcattgtgtaaattatacaccgtggtgtccatgttagtggagaaaatgtagaagacagaagtgtctgcattataagttgttttagtgactaggcctcagaattgttgaattgtggttaagtagactattgctgcttaagggggcaggacatggtttgactcactgacaagagaagattggagtgattgggaaagacagcaggtacttcaggaggttcttggtttttaaactaactgttggtttagaacctaatgatgacaggatccttgaggcttttggatgaagagtaagaagtagttagaaattacagcaccccaggctgggtacagtggctcacacctgtaatcccagctctttgggagactaaggttggaggatcacttgaggccaggagttcaagactagcctgggcaacatagtgagatcctgtctctacaaacaagtaaaaataataggccagtgtggtggcacgtgcctgtagtcccagacctgttagggcgcagttccaagggaaatgtgcttgctcgaacacattttatggaaagtggggaaggattcgatagttgctgttgtgtgcaacgcttattctgttgatgaataataacatagaaccagcctttatgaagcacttactgtgtaccagacagtgtactaagtgcttctctaggcatatctctcagttaatactcaaaataattttacaggccaggtgcagcggctcatgtctgtgatcccagcactttgggaggccgaggtgggagaatcgcttgagcccaggagttcaagaccagcctgggcaacatggtgaaactccgcctctacaaaaaatgaaaaaaattagccaggcgtggtggtacatgcctgtagtctcagctactcaggaggccaaggcgggaggatggtttgagccctggaggtggaggttgtagtgagctaatacggtactgctgcactccagcctagacaacagagccagatcctgtctcaaaaaaataaaaatacaaaaataactctatgaagcaaatacagttgttgccagatgttaaagtttagaaagttaagagtaactgccctaagttacatgtgtgagggtcaggcctggggttctagccaagggaccgactccagagctctgaaccactaaagttaagctttatcgaatttgtgcagattagagcattatttcatcataatttaggtactgtattgtcacagaaggtgggtggggagggaaaaaatgttgatttattcttgaattactgtggagtgactggccttttgttcagattcgtaaggactcttgacgtctaatgagccttaactcttggtccccaatgtgtcttgcaggtattttctccccgcactttgttttctaagtgattgtacgactctctgtgcagaatttaagtatagagtgatatatgtccctctattccttatggcttcagaattttaaagcttattttggaaggcttcccacccacaagagtttgaaaatattttcctatatttactgctggtacttctgtatttgtatttttgcctttgaattttgactcaatctgatacttacttagggctctgggcaaagcaggtatttgattttttttctcccctaaccccgtgaggagagggctggccccactgcccctggggttccttgctaatttcccctcttcatgtcatgccacctccttcctggtcccccgatgggtctgagctcaagccttttccaaagctcttaggaaaccgtgcatttgtgtgggttttctgacctgtagatacctttctcctgtttcccatgcctcctctggagcttaaattcacattaatggaatttccagggaaggggaggaggtgttagcccccttccggggctctgtcggcttccttaaacaaaaggcttccccactggatttaaattagaaaaacagttttccttttcttaggccattgtaacatatgcatatttatatgttgactgtattttttaaatctcattgtgtagtaggagtgatcatgatattcttaaatggaaaatgatttacctaaagtctgcctaataaagtaaagaatggctttttccaaaccagatactttttaatcttattcagggttggtagccaaccttgaaatatgtccgtaagatgctttgtttttttgtaaaattacttacacattgctttttaaccatggtaatagaagtagtatataacaaataggcctacttttaagaaattttggatcaacaagttggtttggtcaataaagaaagcctaaactgggccagtatcatattttcctttaagggtcattactatgaagtgatcattaattattgatgtgtttatggaatattctgttttaacaatgaataaccagagcccctgaaaatccaagtcgtggacatgcatacagtgggcctttaacatggaatttaaattatttggggattaatgaataattgtagacatctatcctttttaagtgtgaaggatgttattagttcaaaaattaaattagagaattaagccatttatattttatgaaggatgaagccctgaattcttaaccatccatttttaatgagaataattgccagatttatttgcaaataatttcctagtgttaatctctttgttgatatgaaaggtattttagatgtgtggctttcagcctttggtctaacaagatccatttgtgggcaggaaatgctaagagcatgaggttcgttgaagtgactccttagcagcacatgaagggatgggggagggctttgatgctgggaagaaactcacctggagtgtcccatctgctctggccagaccacacctaggtggtcttcagcttgggatactgcttttaagtgggaatggcagtgagccaggaactgtgcaggggctggggagcagggctcaggtgcagaagaaaagacatggcgtactcttgtggcttttgttggatgtccagaagggctgttttgtaagagggagcctccaagctgtgaaacctagtccccgctaagaagaaggaaagagcagtgattctggttattgagaaccatggaatgtataccctctccctagaaaagtgcttgtttgtaaaattcacatgcacagaggattcacaaaccccctgaattccatcatagagctgaacttaaatatatagaaaaatgttgacttggtgcacaaagaagtcacctcccatgggtctgtaccatggtggagtggcctgcctcagctggcgagctttctcccctgcaaaatcctgtcaagatttggagatgaggagtccgaacagcctgggctcttccagcttaaagtctcgtatctcttaaaattgacagtaaaaccagagtcatttctatgttttaatgaaatcacgtggccggtggacaagaggacaaatgggtgacgtgaatatgtgtgttttcccgtagccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaagtaggtcccactgcgtctgttccgtccagactttgggcctgtgttgtgggggcggcaggctgggtggttctgggaaaagtgtgaagatacacattcttacagatgcatggttgaaagccagactcgaatttctagaatgtgtctgaaatcctgcagctaaggcgtgatcgttacccctgctggtgcacctttattaaatctttggttaatattttatagataaatgaaatataactaaatattgatgctgtcagaacataatcatctgggtgggaaatttttgccctcattttgcccacttaacatttcatagagaaaacagttatatatcctctcttggattattcaagtaccacagtgttcagggctgtatagctcaattatacatggccacaaaagtgaaaattttacttggattatctattttaagctattatttttataacagtgtctctattttggagttcttactgccaaagccagttagctgtattttgaataaagatggtattttgacaagtctattcatatatatgtatatatatacacacacacacacatcttccattgaatttttttttttttaattggcgacagagtctcgctcttgtcgcccaggctggagtgcaatggcgtgagcgcgatcttggcttactgcaacctccgcctcccgggttcaagcaattctcatgcctcagcctcccgagtagctgggatcgtgggcacgtgccaccacgcccggctaatttttgtatttttagtagagacaaggtttcaccatgttggccaggctggtctcaaactcctgacctcaggtgatccacccgcctcggcctcccagagtgctgggattacaggcgtgagccactgtgcccggcccttccactgaattctgttctcttcagccaaaataagtttcaaatcagttgtgtaaatcttaatgcagatctcatcttcagttttgttgtagttgtttatttctgttgctattattttgcttttcataaatcagtacaatttttgcccttttttaaaaaaaggaaaaaaaaggcagagagaaagaaagcatacagagccccagaccagctggtgctcgatgctggcaaggagtcaccaaatgggcaaaggtcgcaatcctttttatctggccttcttctggacaacttgggtgactctagggagaaatttctaaaagtgttttttcgacagataaccaagataacttggctgcttctaagtttttgcataattaatttgtactttttttctcaccaaacaccaaaatcttgaaatgtgattttgatttcagaatcaggagtcagctctgacaatgaagatgatgatgatgaagaagatgggaattaccttcatccctctctctttgcctccaagaagtgtaaccgccttgaagagctgatgaaggtttttatctcattgttgaactatatttttatgccaccacaaaacttctgctaatgtaattttggaaaatttgaagcatgtcattcttgtgtgttacagttgtatcttattttatcatcattgaggtgtatttgcatttttgtttttagctgggtgacaaagcatctgcttctttggtttcttacctgtctagcttataaaattcgtgagcatttgctcaggataattttaccattttattacaattttactcctttgagatatttagagttccaagtagagtgttggttaagacttgaaaattgttttgttgtgcgggtgtggtggcttacacatgtaatcctagcactttgggaggctgaggcaggtggatcacctgacatcaggagttcaagaccagctggccagcatggcgaaaccctatcactactaaaaatacaaaaattagccaggcgtggtgggtacacctgtagttccagctactcgggaggctgaggcacgagaattgcttgaacctagtaagtggaggttgcagtgagccaagatcacactactgcacgccagcctgggagacagagtgagactcaaaaagaaaaaaaaattgtttagttgtgatatcatcataggattggattttataggtgatcagaatatatgcatcttcgagtcctatgttaccatcatagattgtttttaaataaatattttcacttctaattctcccctcatctgtgtgaagaaaccactcagcattatcttgtggttaattcacaccactctgccattcgcgacataaaaaacaggagtctattagatttaagcatctggttttcagcagttgtgcattgtgggtgaccttttgtgggaatgattgctgattgattggactggaaaagctattggtgattaaaaatcagaaactcctataaggaaagacagtttcaaattttgcatggggttagacattcacactttaattggtgtcaaactagtcttagttgttcgtctgtccttttcttggtagttattttggaaattgaaaccctgtgttcactcagttcctctgagacagccagctggggcatttggccacaactcgttaggacctccatgggtgcgtgcatgtgtgtgttttttctaaggcatgtacactgagtcctaaaggtgagccttttgcagcagaagagttctgcatggttcagaatattgaatgctaaggctgtgtcttctctgtttccagcccttgaaggtagtggacccagatcatcccctcgcagcacttgttcgtaaggcacaggctgacagttccactcccaccccacacaacgcagacggtgcgcctgtgcagccctcccaggtggagtacacggcagactgtgagtactcactgtgtatgtcctgacctgtgttcagctgcctgtgacagagccagctacagggctctaaaccccaagtgttctgtcctccaagtgtaacaagtatggaagcaggcggcccagagcctgcacatggtcccaagggagagtgccacgaggctgccctttgcttggcccagtgttggcaagatggctgccctactccagcattagctgtgcattccaggaaggaggaggaccggcaaaggtagctggctgcctctgcccttctttcttttttttttttttttgaggcgaggtttcactctgtcacccaggccagagtgcagggatgcaagcatggttcacggcagcctgacctcccaaactcaaacgatcctcccacctcggtctctctagtaggtgggactacaagcacgataacactgggctaattttgattttttgatagggatggggtctcactatgttgcccaggctggtctcgagctcctgggcttaagcagtcctcccgccttggccttcaaaagtgctaggattgcaggtttgagccactgctcctggccctggctctgcccttctttaaatatccacccaagccatagctagtggcttcccttacctctcagtggctagtgtcctgtcacatggtctccccactcagcagaggcaatggggcctccgttaaacacgttgctgccctaaacaaagtcaaatgctggtaagaacagggagaatgggagacacatagtattgtctaacacagttgctttctttaaaaaggttcacagcaggccaggcgtggtggctaatgcctataatcccaacactttgggaggctgaggtgggaggatcacttacgcacaggagtttgagaccagcctggacaacatactaaaaccgcatctcgacaaaaaataaaaaaaaattagctgggcatggtggtgtgcctgtggtctgagctacttgggaggctgaggtgagaggatggcttagccccaggaggttaaggctgcagtgagctgagattgcactgccacactctagcctgggcgatagagcagtaccctgtctcaaaaagaagaaagaaaaagaggcttacagcataagttaacatatgcactgagaaattacatttctttttctcgctgattgcagttcttttatggtattcattaaaggtaagtcttgaaggtccatgcaggagatcatttgaaagtgtttgacgttggttccagcgtcaggtctttctgtaattgttttattcagaggttaaatatggaatgaggaagctttagcagagccgaggaaccacctgctgagtctgcttcccaggcagctctggtaccctgactccatttgtaaagcttatctccttcagttcagccggagatgaattgttaaaacatcagctcctctttatttgggacaagcttttgtaaacatcacagctgtgttctttgcacttcccttttagcactggcacatactaaacgtttttagactttaaaaaattagttactagagtgaactttctgcatgtgtccccccaaaaaccttttaaagctgagaatgtctttaaatgattaaatcaagtcatatcaaatttcactgaatgttcaaatcagaggtcagctctactgctacagaggtgcgtgttcaatagtgtaggcagccagctgtctgaggtgctctgtagatcactcctaacgcccagtcctcactgcatggatttttggatagacggccgcacacctttaagtcttgagccccactcggcagcctgtgaagctcccgccctggagtcatggggcgctgtgctctgcccaggatgcctgcccactgagggaccatccctctgcttcctcctttccttttccaagcctgtcgttgagtttgcttgaaccaaatgcattgtccgtgcacgtccaccagatccctgaagctgctgcaaagcagaggactagaaattcagggcgggctgaccttgattatttgctgtgctaatcactggtggaagaacagccatgtgcagaccccgcaggaccaggcaggatggtggagccggctggtagtggccgttctgtgacacacagcatcccctggtctggtgggaatgtgatctgaactgaggcatgcaggggtggcattgtgagctgtctgggtcagaaggcttggtacattcccaagggttcaccgcagggcggccagagcccacacactttggtttcttcccacctgctgatggctcccgagaccactgataagccgtgacagcctctgcaggaaccctaagcttactctgttcaggcccctgactaccaccaccctgggcactgacggcaccccaccctatcctcccaactgcaagggctctagtagggggtgccctctcctcccctcaatacggtgccgttgttttgaaactcatcgtctcccctcgacacagcaagagtagtggatacacacatgtgagagtaagggtgcctgggggctggtgaaagcatgcgtgtctgctgttagggtctgtgggttttagacatatgctcctgcatcagccataggggtcagagccctcctatgagcctcctcgctgagcacagcactcagggccaccaccacagtcccacccatcttggatctggagggtcagaaggtgggggaggtgtcctcatccagtttccaagaagagccaagagctagaactttggctctaaatcactgtaaaacctagcagaaatcagtataaacctgtactcaggcgctcagccttatgggatgagtggctgtggcgtggcgttacgtcgggtcctccagcaccacgcaagcccgggcagtgcggccattccagaatctgcagaggttccagggcgcctgactcacacgcgcctccctgcctgccgtcttcctctgctaccctttgagtaccttgttctgcctgcctcatgcttctgtgtgctgttgaagtttcgtgggtgaaagtccctcatgacctcgtcttcacttcctgggttttcagtgaagttgttgcagaatttggggtcctgtgtggcaggttgttggcagttgcaggtggagacagcagtcattgatctacccaggttggtcatgattagggaactgcctgtaattcatggactgactactatgtggttattggtttgtaatcagtcattgataacagcatttatttacaaatacagttcaaatagagggaacactggtcatagtttttgggttgagttccgtcatgctaaagttcaagataatattgttacgttcattatatgtagtttccaaaagtattaatgcagtgggatctcaactatgcttaaaataataaactggagagagctgtgcaaaaaatactatgaggctcagagctacctctcaaattggcatttggttgattttttttctctgcatacttttttcattttcatgatgtttttgagtatgcattactattttacttttttttttttttttttttttttttgagacggagtctctctgtgttacccaggctggagtgcagtggtgcaatctcggctcactgcagcctccacctcctgggttcaagcgagtctcctgcctcagcctcccaagtagctgggatcacaggcgctcgtcaccacgcctggctaatttttgtatttttagtagagacggggtttcaccatgttggccaggctggtctcaaactcctgacctcaggtgatccgcccacctcagcctcccaaagtgctgggattacaggctgagccaccgcacccagccgtgttgctattatacttaagaaacaaagtaaaatacaaagttcatagaataactgtaacgtttgcaatgccggacagtgagggcaagagcagcccatggcttggcctgagtttgtggcaagcccaagcctgtacagatctcccgaagttccttctcagactgttgtgaggacgtcgctgagttgcttcaagaaaagacctaaactcatgggctctgtctgatgagcctttgtgaatgtagtgtatgaggttggtgggctattttgaaattcctgcttcagccagcacagaggaaggtttgaggggcccctttctgtcttgggcacacccagccctgctcaggagagcttgagaagcaggtctgcggattctgctgcccttggctgctctcggcttgctcctcgtctccgcctaatgtacccagtgtgttcacggaagtgttgtcccatggggtttcatatacagcctgttattcctgtatctctaatgtgtgattttccatgctctgggcatgcatagctttgtttcttaaacagccagctttctacagagaaggcacaaccgtcagaggcattgaagtaattttcagaagagggcttaaattgtgggctttgcacttgggaagtactctagtaggatactagagagaaagctgtctggaaaattactaacattactgataacattttgggagactctcagttggggcaaacctggggccccgtggggtctggaaaagggcggggctagtgtccttggagcacgtcagcttccacagcacccagttacttttcctgaggacagaggagttgcatgtgagggaggaggcgtgatttaaagcatgaagagaatcatgccccacaatgaaaccagagccctgtggcccgcgtttcagaccactgccaaccatggacaccagagacaagacaaaggacattttggccatggacttgaaacgtcagctgtatgagagcgggcgggggatggcgcggtctccctggtacttactgggcaggtgcgtatcgtcaggagctcctcaccctgccctgtgagaactttcgtatgtgtgtctctgccatctcctcctcctcccattcctgacctgttgagccaggggtggattggcaggcctataaggcgcctttcacattgagggtcttaggatttgcagtccagctttgcagggagcggcagtttgtcatttgtaggaggaaatttcacgatcataaagcacggcatgcatcctgagagccaggcagcgacgctgcctgcactgccccaccgctcagcgggccacaggagcagggcttcctccttgcctctgagcagtggagccaaggctggaggtgggcgcagctccatgttctcgggggatttcttcactgtgtttcttgggggctcaccgactgcagccgtattcctggagagagaaggaggcctgtcacagcatctgtgacagcccggaaggaaacagcagtccatacagtcccctcaggacaggcacagaggactccaccctggagtcacaggcttggtgaggtgggggacaggcaggggtgggccccgaggtgtgcagagtgtgtgttcaggcttgtcttcctgccgcagcgcagcagccctcccatgcctgggtcctggcacctgcccctccactccccatgcagcttcatcctccagggcgtggtctccagatgacttacctcctagatacagacaagaccccaaacacacacatgggagccctgagcccaccctggggcagggtgacacatgggagcaggtcagtgccctgtgtgtggcttgccaccatcatttgggaactattcttctgtcctaggtgagtgcccaccctgtggcactgagacccaacagctcaggtgacagtgacacctgcagcggaggctggggaagcatcagagcctctgctgtggtggacgccaggtggcccctggcacagagagcgtgttcatcgctggctcctgccgccctcgaggacttgaaggctgacgttgggctgggtgtggctcgtacataggacagggcccacacactggattcacgtttttcctcacaacttagaatagcaaagttacagactttggattcttacgaagacaagaatgaatgtcttggctaaccatgatcttacccaagaggacttaaaatgaatgtgcaggagaaatgagaagaggacttaagatcaaaaagagagtgactaggaggtcagagaggcagccgcccaccccacgcactccctgcttgtaagccggggccgcattgttgtgttaccacacttctgttttagagcctgttacggttttgagttacacagacatgtgtgggcttgtgcatgtttgaatgccctgtggacccggagctctgtgaggcaaaggctgggactgtcttactagccagcgtgctccttgcacctcgatccaaggggccacggggctcccaggaacattcaccgagtaacttcagaaaagtgaagagcagaagttccaaaagcacctggtgcttcctgggagaagtcacctgcacaggtaccttggatccaactgacaggtgagatgaacgagctctccctgcgtgcgcacgtctacgtacgctcgtgtatgctgaggagcaggcattggaacatgacggagctgctgctgctgcagccgcagataccatctcagccggcatggcgcatgggggtggggtggggcagtgagggggggcccgctccgagagacagacaggtcaggccggaagcgactgtccgtgaaggtgacgctcataccgtaaccttagcagcaggctgttgccacacagtcacaaaagtgggaggcagcagcagagcaatgtggccacaggcactcggactccagagagctggcgagaggctttcctggctgaaagcagtgacaagtatctgggtctgggggacaagggaaacttggaaatgacagaaaagcccaaaaatcaagtccccacaacctcccccagcgatgagagccgtcgtagccatgggctgtgcatcatccctacacgcccgcgcctgaagatttatgcgcgctttctgacgaacagcctttgcagttgggctttgttgtggctggatgactctgagccctttgctttgcttctctaggcctcagttttcccatttgtaccattagggtattaatttaaataacagaagcactctatcgtattctgaatgggacaccagttaattctggaacattttggaggtttcccattgtttcctgtgaaccccagagagagtttgagaaacagatgataaagggaagacaagatcgtaaagtgtgatactgccatcgaaggtctcgagcctcatagttggcgctttaagcaaaataggcggttaaaaacaggtctacacatgctgtgtgtggacccaaaccatgaacacatgctgggccccagcccgtctgttgctgttcccttggtcttggcgtcctgtggtcctcacgtgagctgcacgcagcgagcagagccctgacttccagtctggatttctgtaaagtgatgccgggcttatattatttcaaggacttcatggttacttctccctcctggagttgctctatggctttttaaagcagctgactttttatccatcttctcaaagtattcagcttcattttcacagaaatgataattctcatctctcactcaaattttatgtttgcataaattttcatcaaacacataattacagtaagtttaactggaaaaaataagagagactctactgttaaaagcaaaaaggcccaggcttctgaagagacgcgccttctcccctggtgtttgtcatggcaccagccaacacagcaagatggagccaccagtccagccagggagcttctgcagtgtttcaaacaaggcggcaccagcacagaaatccacaggccctgcagtgggaagggatgaatgagtccccaaaaacagatccaaataaaaataaggacggagaaaaggaaacaccaagctaacaggaaggggtgttctaagacacaaagagctatttggaaaacatcacataagagcctcactttcacccagtatcagaatcacttccagatgtaaatgccagttgtggaaattcttaggaaagtaaggatgcttcagcagaatgaagaatcatctattttcagccagcagttatattcaattaattttttaaaaaatgaggggaaaaaaaaagcctgtatgtctaaacagcttttacaatcaaataggaaaaaattctgatagtctagtagaaaaaagatctgcagtgcgaataattcagaggcaaaaatgcccatacggtttttaaagactcaccctcactgcctgctcacaggcatcgtgtccgccgaccgtagaacctgaaatccgtagtaaacacccctccagcgctttggttcagctcagctccagcgaatgttaggatgtgaggcttcgtgttacagtagaaaggagcgcactcataggcatacagaacactgtgcaggtctaagacttaggagaagacggagatttctaggctgttggaatgttattttgtatatgcgagtttgggtagcttaataatagagattaaataaaagaaatgcagacgaaacctacaatggagtgccatttttcagctgtcactcaagcagagaaaaggtgacagacgtttattgtcggtgggggtgtagatttgtgccagcgatgtggtacttgtggagggccagcgggcagtctatcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgtatcggcacctaaaagggcaggtaagaaggaccagtggccagcacagagaggggaactggaaggacgaggtcgcagacaggagtggctgactcacctgcccgtttgcgctgcttgcattttttcagcgtgactcgtcaccctctcaaaacatgcagattgacgtggtacttattttgagactaaactggtatcctgagttaattccttacaactctgtattttaataatacgtgcttttatcattttgtttcatcagctcagtgtgtttttgtttaggcggaagtggcccccgtaacatctttcccccgtagagacttgcatacccagtactgctgtgtctcgtgggaggctgctgggtcactaagcttttctggctttcatacgctgggtatttaataatcaccttaggatatactcagtcgttctttcttatttacttcctactgatggagattttcctacattttggcagcctgggaagaaaagcatctatttttttccttaaagtccagcagaattttatatatatataaaatatgtgtataaaataatttttctagaagctcattaaatatagatgtgtaaaactaacaatttatttcatttattaattttcctgacaatgaactacttttcatgctctttatttttcattacttgtcttctgctatttagctataaatccttatagaagagtataaataaataaaagtaattatgcaggaggcagtcatagtgaaatgctgcccactgtgatagcctgtgggttttttttaataaaatgccaactcagtttttcttaatattctataaatatctgaagtgaaattaaaccattgcgcatggctactatagatattttcttgcttctatccctgttttttaaatgtgcctttgctgtttatggtatatttttcctgcacatcatgactttgaagttctttacttactttccaaacccatttttaaaaatggttttattgtatgtcaagagaagaaggaagaaagcaaaaatgttacccaggattccaccatccagaaatagccattagtgaacatcattagcaaagtggaaaacactgaggtcatcgtgctaaataaaaaggaaagaaagaagcttgttatctgtggaacacaaagatcatctttatgcacgaatatcaattaaaatgttggatgtgtctctagaaatacttacgttaaagtggaaataaacttaattttacttaaacagaagagcctgcaatctaaaaatgaagtaactgtcgaacttcggatgaaagtttcttttatgcctaaagaattcagttctgaaaaaaggttaggagaacattgagaggttgtcattgtagatattttttaaagctgtgtatttttcctgatttttgttagaattattcaactttttctttgcatttaatatatctcgaacatctttgtattaacagtgcatgtgtatctctctcttctagctgtagcaactacctagtatcctgttgtatagatttattgtgaaacagccctccattaattgataatttgattatttgtgacttccaattatttctacttttccagtgctgtaatgaacattattctttttttttttttttttttttttttttttttttttgagacagggtctctcgctctgtcacctaggctggagtccagtagcgtgatcttggctcactgcaacctcaacctcccaggctcaagctatcctcccacctcagcctcctgaccagctgggaccacaggcatgtgccaccacacctggctgactttttagataaatttttagagggtcttgctatgttgcccaggctgatgttaaactcctgggctcaagtgatccacccaccttggcctcccaaagtgctgggattacaggcatgagccactgtgccctgccaattatttattacttttaagcactaatgtggtataattctatatgcaagataaaaatcttagaaaataaacagctaggtcaaagagtatgtgcatttgtttaaagtattaccagtgactgagcagttgccttctgaaacattgtgtcaatatgcattgccaccgctaggatatgagtgcttcttagttttgtaaccatttaaaatgatttgaatatgctgatatagaaatatatttaagagtgagtaggacagtcaatatactatatttatgactttggttcctttaaagtatagaaatattatttttatattatgagagtttataaatagtatttgcattctattattccccagttgcttttttttttttttttttttttttttttggatggagtcttgctctgtctcccaggctggagtgcagtggcgcaatctcggctcactgcaagctctgcctcctgggttcacgccattcttctgcctcagcctcccgagcagctgggagtacaggcgcccgccaccatgcccgattaattttttgtatttttagtagacagggtttcactgtactagccaggatggtctcaatctcctgacctcgtgattcacctgccttggcctcccaaagtgctgggattacaggcatgagccactgcgcccagcccccagttgcttacttttagttttatggttgactggattcgttttttccctacagcttctccttttgagttatttattcgattcatcttttcttgatcatttgaatttcataaacaagtacgtttttacaagggctgtagttcatgaattctgcctgtcgaaaaatgcctgcctttgacctttatgtgaacaggacggcttgtctgggtataaaactcttgggtaatgctgtgggcctctcagatctctgggaactagaatctgacactgtcctttccactgcagggtggcccggggtagctggatgggtcatgactacctatttgggtttgttcattggttggtttgctttcattgctcctatgctgctctctgagttttttcacgcttgaaaatctttctcagctgccttttaacataaatagcaatttgcagggaacgatgcaccgagtcgcttgcctaggattcagaagtggaattgaacgttgctgtggaaagggcgaggccagccctgtcttccctacctgccctgggaggtggatgctctttctgacccaacacatctgaggaagtcttgctttacccttaacttttattaacttaattgcccatttttcatggactatattgtatacctttcagtcagagattcagttctcatttctgggaagttcttttctgttgtgcctcgagcacctttcctgtcccacgcattggtgcctctgcttgaaggacacagtctcttggttcgggtcacctttcttcgagcctgtgctccctgtgtttctctttggcactcagcaggactgtgtccatcttccctgtcagcgacttttttcagccatgtctatttattccttgtagtttaaattccattggttttgcagtggtattgtttggatccttggctggttttctaagctttacagcagggccccacagcctttctatataaaggtgcatgtcttcagccctgcagctgcccagcctctatgcagcccctgctctgtccctggggtgtggaggcagctgcagatggttgtagacccatgagtgtggcagggcttcactaaagcttaattgatggatacgaggcttttcatttctttttttttcttttttttcttttttttttttttttttttttttgagatagagtctcactctgttgcctaagctggagtgcagtggcacgatctcagcttactgcaacctccacctcctgggttcaagcaattctctgcctcagcctctcgagtagctgggattacaggcgtccgacaccacgcttggctaatttttgtatttttagtagagacagggtttcaccatcttggccaggctgggaactcctgacctcgtgatccacctgcctcggcccctcaaagtgctgggattacaggcgcaagccaccgtgcccagcctagggttttaatttcatacaattttgatgtcataaaatattattttgtttgtttgtattttttcaaccatttaaaaatgtaaaaaccaggccagccatggtggctcacacctgtagtcccagcactttgggaggccaaggtgggtggatctcttgagctcaggaggtcaagaccaggctgggcaacatagtgagactgtctctacaaaaaaaattaagaaaattaagtgaccataatggcgcacacctgtggtcccagctgctggggagagtgaggtgtgggggttggcagaggggagggcatcgaggagttccatgctgcagggagcaatggttgtgccactgtactccagcctgggcaacacagcgagactctgtccaaaaaaaaaaaaaaaacagtaaacaccattctgctgatggctgtacaagaacagggagagcgcctgctggaccctgcctcacagcctccccctctgttgcatttggttatgttaccttatttttgtgctttgttgaattcctgtcttcccagattcatctgtggctcagagagctcaaaggttcctcgggtcacatgctcctgtagcctgagatgccattcacatgccatgctacttccctccgctgcttttcctgggggcgtgtgcagggtctcatgccgtctggtgctccttcttccctggtgtgcaagcctgtgtgttcttggtgtgggtggattctccttgatgctctctcaccttctcttagctcctttttcttcccttccaacagccttcttgggaagacctatcctctgctgtcttttgtgagattctaaaaatgtcctagattggatttccttcccccagtgagggaactacagggagagacgttcttgagtatcacagcatatgtgtcaggcagggccccaggtccacaagccccgttctcctcactgtcaggatccccacggcaggtcattggcatttccacctgcttctttccatggtggggcccaggtctcacttcagccacttgctctctttacccacaactctctggaacctatttttatgtaagaagtcttcaaaacctcagtacagcattaaaaattgaaagctttttactttgagggtcactgatgaaaatggtaagttatgtttagagacaggcttttttttttctagaggaaagttttatttgccagaaagaggtgacttttaagcacagtgggctaaaattccaaatagctggttaaatgcccaaaacggattcattttggtagtttcccagtttgacaaatgagtaatcttgcatcactacagaaatcattcaggtttccctaatccaatttggtgatgtcaaaacaagtcttctcttgttgggggacttttttttttttttaagatactaggtcgtcgggaggttacaacaaaatacagtgtggttgtgatggactgcatgttaagtgattttattgtaagtcttggcatataagaacccattaacagatcattggaaaccattctgtgttgtgatatggatagcctcatggtttatattagtctgttttcacactgctgataaagacatacccgagactgaggaggagaagaagaggtttaatggacttacagttccacatggctggggaggcctcacaatcatgacagaaggcaaggaggagcaagtcatgtcttacatggatggcagctggcaaagagtttgtgcagagagactcctgtttttgagactatcagatctcataagactcattcactattataagaataatgcgggaaagacccgcccccataattcagtcacctcccaccaggttcctcccacaacatgtgggaatagtggtagttataattcaagatgagatttgggtggggacatggccaaaccatatcatcccctctcacccctcccaagtctcacatcctcacatttcaaaaccagtcatgctttcccagcagtcccccaaagtcttaactcatttcagcattaactcaaagtccacagtccaacatctcatctgagacaaggcaagttccttctgcctaccagcctataaaatcaaaagcaagttagttgttttctaaatataatgggggtacaggcattgggtaaatacaaccgtccatatgagagaaattggccaaaacagaggggctgcacaggccctgtacaagtccaaaatctagcaaggcagtcaaatcataaagctccaaaatgacctttgactccatgtctcgcatccaggtcacgctgatgcaagaggtgtgttcccatggtcttgggcagctccgcgcctgtggctctgcagggtacaacctccctcccggctgctttcacaggctggtgttgagtgtggcttttccaggagcacggtgcaagctgttggtggatctaccattctggggtctggaggatggtggccctcttctcacagctgcactaggcagtaccccagtagggactctctgtgggggctccgacctcacatttcccctccacactgccctagcaaaggttctcgatgagggccctgcccctgccacaaacttctgcctgggcatccaggcatttccatacatcctgtgaaatctagatggaggttcccaaacctcagttcttgacttctgggcacttgcaggctcaacaccacatggaagctgccaaggcttagggcttccaccctctgaagccacagcctaagctgtaccttggccccttttagtcatggctggagcagctgggacacagggtaccaagtccctaggctgcacacggcacagggaccctgggcccagaccacgaaaccgttttttcttcctaggcctccaggcctgtgatgggaggggctgccatgaagacctctgacatgttctagagacattttctgcattgtcttggggattcacattcggctcctggttacttatgcaaatttctgcagccagcctgaatttctcctcagaaaatgagatattcttttctattgtcagactgcaaattttccagacctttatgctgtgtttccttataaaactgaatgcctttaacagcacccaagtcacctctcaaatgcattgctgcttagaaatttctttcaccagataccctaaatcatctctctcaagtttaaagttccacagatctctagggcaggggcagaatgccaccagtgtttttgccaaaacataagaagtcacctttgcctcagttcccaacaagttcctcatctccatctaagaccacctcagcctggaccttattgttcctgtcactatcagcattttgggcaaagccattcagcaaatctctgggaagttccaaactttccctaattttcctgtcttcttttgagccctccaaactgttctaacctctgcctgttacccagttccaaagtcacttccacattctggggttatcttttcagcagtaccccaattctggtaccaaattactggattagtccattttcacactgctgataaagacatacctgagactggagagaaaaagaggtttaatggacttaacagttccacatggctggggaggcctcacaatcatggcagaaggcaaggaggagcaaagtcatgtcttacatggatggcagcaggcaaagagaggctgtacagagaagctcctgtttttgaaactatcagatcttgtgggactcattcattaacatgagaacagcgcaggaaagacccacccccataattctgtcacctcctaccaggctcctcccacaacacatgggaattgtgctagttactaatcaagatgagatgtgggtggggacacagccaaaccataccagttttatctcagttggaaaatacttggacacaatgtgtgatgagccaaataataaatgcttttaagtatttgggaggatgggaaggaagatcatattttcttaaaaactttgggcttacatcttaaggagtttttggtttgttttaccatttttattcttgcaatatgagatttatgttatagagagctagtagataaccaccctgcctaaaacgaacaattgccagaagggatcttttaggaattcttgaaaattatctgagttcaggagatgaagtcagaagtcatgagaatggagataattgagtggaaaagagaaacttgcagaaggagaaagagtttctccgccctgatttctctcattcacttctagaggaccttgaaggtttctaacatcccctgggtgtattaggcactttcctcattcttgagaatgcagaattcagtaataaaaacaattattcttgaatcgtgttgtcagtgcctgacatttacatgcatagaatgtggacctctcctggggtgcaggtcttcactgtgaataaggcagcactctaactataggcagagtaagattctcaaatcaggcaggctggcacagtctgaaggacctaaaaatacctgtttcagggatctgcatcttcagatggtaatgaaacttttagtaaggctttttttttttttggcaaaaaaaaaaaggtagtattgtagaattttacattaaatagtggaattgccatgaaaacaatttattctgacattgatccagcagccgaataagcctgcagggaatggcgactcttggcagcgggtcaggctgtgggcttcagagtgggccgcttcctggcttaccagccctgctagggtaaatctgctctcagcggcttcctcctagaatccagcttgaaaattaaatggaaataaacaaacatcggttatggtctgggaaatttgctacatattgcatgttctgtatgacacactaatacatgtacatgcgtagtattacagatgactgcatatattggtgaaccattagcctgaattggagaggagatctcaggtgagtattgggaacatgcacatcatctttgcagtgcagcccaccttgtatctctgagaagtcagtgtgcatgtggagaaagaatggaagggaatgcaggcaagttaagatcacccttgagaggtggttctcagatggagctgtgccgccttcctagctgaggacctacagcgttgttgcagtgtagactcatgtaatggtgccatcttttaagcaagtcttgacttttgatgcctcatttgctgctgctagacccaggcggagcaagcttctctggcatgtgggtcgtttgtttgcagtgtgcatttggtgaaattgacagctgggtttccctgtcccccgtccccgcctggaacatcactgttctgagcctgtagccagtgcttttctgtgacttctctttctttcctgtgttcattcctgttcttgttgcttgtatgtttacttctgtattttgctggagcacatcctccagtagtttcccaagaaagggtacataggaacacaaagttttttaaattcttggatatctgaaaatgccttaattttgccttcccatttgacaggtagtttggaagcacctagaattgcggggtgggtatgactttccctaagaatgtgggtgctggatgccgccatctgcaggagcctttgctgccatggagaagctcatgctggccgggcatgctggctcacgcctataatcccagcactttgggaggccaaggcgggcagatcatgaggtcaggagatcgagaccatcctggctaacacggtgaaacccggtctctactaaaaatacaaaaaattagccgggtgtggtggcgggtgcctgtagtcccagctactcgggaggctgaagcaggagaatggcatcaacccgggaggcagagcttgcagtgagccgagatcgcaccactgcactccagcctgggcaacagagcgagactctgtctcaaaaaaaaaaaaaaaagctcatgccatgctcgttaccattctctcctgtgtaacttgtacaggtgttgagcgatttgcatcatgctctgccatgccaggaacacagtggacaaacctccttctgccatggagcttatgttctggagggcagagccagacagtgacagtggacatgtgactaagagcgatggagaaagtggccatgacaaggggaccagggttctggggaggccagcagtgctggcatcatggggacagggaggcctcctgtgaccagagaccagaggaagtgcaggtgagcccagcaattaccatgtgcaggatgggggatgggacagcaatgggacatgaggtaggagaagcaggcaggtgggtttgcaggagggcttcccagacaagggacttagcttgaccctggttgagagaggtcgccatgggagggattcaggcagaaactgtggaggcaagggtggaaaacccggggcaggcagcagccaagaggctgtacacatggagggcaggaggtgctgcagctggagggcaggactcagagctgaatcatcgggcgtcagccttggggtctgccagatgaactggatggatgaggggtgtggccacctcctgcattgggggactacagaggagaggcatggggagaaatcaggggctctgttctggacacattcggcttgaaatatgtacgagacatcccagtgggaatgttgagtaggtggttaatgcacaagttcaagttcagctcagggctggagaagtgaattttgcagccatcaagtataaatagaattcaaagccactgaacttagaagagttcctgtcaacaggatttagatccaggaaaagagaccgagaggcatggccgctgccgaggaagagcctggggctgtgggagcagcgaggccaccatctgactctggatgcctggagagccgggagacaggaaggctggcttgttcctgcctctcagatgtgctcagctagttacatttgcctggctaaaacacaggggccatctctttaacatttcttattaaaataggtgtgtgttttcagaatatctatacttatctccatagaactcttaactattttaattcttttttttttttttttgagacagtctggctctgatctcagctcgctgcagcctccacctcccgggttcaagtgattctcctgccacagcctcccaagtagctaatatttttttgtattttttagtagagacggagtttcaccatgttggccaggctggtctggaactcctggcctcaagtgatcccccgaccttggcctcccaaagtgctgggatgacaggtgtaagccaccctggccagcctattttcattcttaatatacacattgttcatcctccctgacttagctcttccagaaaggtggttgctcaccaatctcctctctaagaaccttctcagcacaggagttctgttctgtgtgttaaattcacacgagattaagatcatgcagagatacgagagaactggctctgatttttgcaagaagccagttgaatagagggccttgggagataattaggcagatttctctgacctatgttaagtagctctgcacgtttcagaggaggcagtattggagaaggacttacaaatgtgcttcctgcttttaagcagcttggttctcgtcatacaactatacttgcctttagggactgtgtaggtacctattggaatttctttcttggatttatttggagtaggctttcgtagtactcatagcgtttattagagtaacattacgtcagcatttaacttagtttaaaacgtagtcccctttgggaaattcaatataaaatcctaagaacagcaacaaacctaacaagatatatgtggtcccagcttactgagggttcaactcgatgatggtgcacatgcaatttgcattcagtagaacatcagtaaaatgcttgagatactaaaaactttattataaaataggcttcgtgttagatgatgtcatccagccgtcagctactgtaggtgccctgagcacatttaaggcaggtgaggctgtgccatggtgttcggtgggttataggtggattctgtgcattttccacttcacggtgttgtcagtgtatggtggggttgtcgggaagtagcctcgctataagcccaggagaatcccggcatgtcgtggcagcctgaggacagcaggagccccttggcacactgtgccctcccccgttcatgactagtaatggcacagttattgtaaagctgatgtggcttttgccagcccagacttcagtttgtagactacagcccagcttgtagattttatttctgttgtcaccctgtactagtccagaaattcttaaaatttagtgttcacgagaattgctgtgtacaacatacaaggggctgtatacaaaatccctgtgtcctatagttggtagtcagtttaaagggcttcagtccagttaaagggttctgtgagctgtatggtgccaccattgtgtgcggcacgtgtcaagcagcttcatggtcactgcaggatattttagcactgaggcattttagaagcagtccaggccgtgccaccagctggcatgaactcactcattaaacacttactgagggcctgctcatgccaggagctgtgtgagcggctaaggttttgtggtcactatttggagatatggagtccttgggaacatagctgcacaccagtcctagtggcgcaggagttgccatagggcgttgtttacagggtccccacgcgagcccagagcaaaggcctcctgagtctgccaaggaggcagaggcttcccgaaagaggtggcactggagataagctgaataggggcctcatggcaggcagagaccctgtgaggccgtgcaaaggacagagacctggggaacagaagccagggcaaggggtgggctgggcaagcggcagaagcccttcgggaggctggccctgggctgctccagatgacttgtgcccgtcctgcctcccaccagggccacagtgtctggggaaggatggatctgacgtcctcccttagatcttcacatccctgacaccctatgaagtgagaatctgggagaagcaacccaggaacggtgtagcggaattcatgaaccactgtggtgttggttcccgggctgcctccgagcatggcagtgccataggacacgtcccacattctctgtcggcagacagagaagtgttttcatctcatcaagcaacacatactttatttctcttggagtccttttgagagacaggatgattttcaaatttgattaaaaccttggagagaatcacaggtgtgtgtggggaagaggtgacagcagcagtggctagcagcagaccgcctcacagaggctgcgcgtgtctcggcttcacagctctcctctgtgagaatctcctgggtctgggtcaagggtgtgcccagagcattgtcagcctgagtggtttttagcgtggagcctctgaagcaagttgtggacctaggctaggatgtccctggagtgttttcagatttgggcatttgtttcatttttacacctacaggcagcctttttttctttttgtgagctcagctcaggggctcactccatcacccaagctggagcacaatggtgccatcaacacctcactgcagccccaaactcctgggctcaagccatcctcctgccacagcctcccaagtagctgggactgtagatgtgtaccatgcccagctagtttattttattttattttttggagatggggtctgatggtattgcccaggcctgaagcatcctcccacctcagcctaccaaagtgctgggattataggtgtgacccatggcacccagcctaaatttttcaaattagctgacatttttgacatttgtagtggatgagtctctgagcagtctgccattttgccggcactgctattttttttaacacttcgtttttatttaacaagatggaaggctcaggaaggtcatatagactaacagtctgcgtgttctttaaaggaatggcgctcagctttgaaaacagtttcttcatctctgttgtgttccagtgtgattgcactttacacagttacataaagaatgcaggtatcaggttggagctgcataatatgtactactagttgaaataattataaaccgttttgttttgtttgtttttgtgaattcagatcccgtcctttgtggccccagtttaaaacatgtttggacactttttaggggtgagactgactgtccagagcaggacatggggtttccgtccttcctgctgaggtgggaggctggagacctgacagtagccagtcggtagtggggtcagttccgcctggccctccccagagctaagcacacactgggctgcactctctcccctggagtgctggcttcgccctggctgagaggaagcatccatacatagtagcctgatggctccagcagggagtgggtggaagcagcagctccccccttccagggatgacgttgtctcttacagaagcacatgcttatattcggattcctgattttgataggaagcctatgttggaccatcaggtcagttcgttggtccagcacatactctgctcaatgcagaggctgcagagacagtgaagacaggacctgccgctgcaggagcctcagagacggtgcctgccctgctgtcagcctcccattgacatccaagggtctcatcccctgctcccggccttttctcagaaatgttgctcagatatatctgtgttgacgataatgtggagcacatcgaacccacttatcttattttgaaaatttggagtattactgtttctgtgtcatggtggttggtgtgtaacatggagctagagaacaacggtttaggagttcatcatgtataattaatttaaataagtcattagcagctggggaatatgcctacagcacataggaattatgctgcctcgccaatctaagatggaaaggtcaagatagtctaagttgtacttctgaaatttttctctgcatagcatacattactggaaaccatagttaagcttttactgtttttcaatgttattgttttaaggtgaattgattgaaagtgaagataaaagttcttaattcgaaaaatatttttgccatctcctaataaagaggaaattaaatctctgtgtagtcagaactacttgcttatctacaacaggactggaaattaaatttcgtaattaatcattgaatcttctgtgattcgtggttctgaacatttaaccccaaaaaggataaatgtacaggatttttaattgttaagacagcgtgcctctaccctacagatacctgcttgtgtgcacagcataggtggcaagacggcatacatcactgtctgtgatggaaaggtccagacacagcctcagtgcccctgggaacttttatttactgaataaattcctgcacagcctgtgttgctggggccgggggctgacgccagggttgccaggagcagctgccttactgaggggatggtttccggattaacgtgtgaatggagggagcagcgtgcctggggaatgaaagcaggtgtcagcgcggggagctagccaaaggcatttcctcacatgtgcatttaggagcataggtggccttcgtgggccgtgtgagcaaagggatgactggttgccgctagagaggagactgttcccaacctgcacattttgaagttaaggaggacattaatttgtctagagagtattcatatctggtgcctttgaatgtcctcatgccattcgctttccatctgtctttggatgcgtgttgtggctttgcctggttcttttaaattgcatattgtgcagacaactttttgtatcagaaaaatctagaaaacagcatggttggaagtgagcagaggcaaggctgcatcttgccgggggaagggctcttgtggctgcattgtggactcatggaccagcctgtggccggccatgctcactccggggcaatgtgtctccacagcgaccgtggcagccatgtattacagctactacatgctaccggacggcacttactgcctggcgccgccccctcccggaatcgatgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaaggtaggtgcagcgtccaccgctgcctgctgtgtgagtcactcagcactgcagtcactggggccgtctgtgtctccatggggggcttgtaatctagatcatatacaggggtccccattgtctgagtagttattattccaaatccccaagttacaaagttgacaggaaaacagaaatggttgtagcacaaactttttagcattgaagttaaaccacttataaagttgaattcatttcacgtcgcacgctggccccagatctccagcatctgttcttgcgctttgtgtcagagtctcagttgagctgtgctaggcaaaatcagtatgcagtgaagctgcagttgtttgcaaaacatgcaggttcataaagttgacgcaggtgatgttggggtgcttcatgagtctctcccaagctgttggccaccaggggaccctggcagctactttagttaacctgtgaagccatcggcagagccctagcttctccagcagcgagggcccccagtgttcaggggacgagtatgagacaggcgctttaccagtgggcctggaatgccctgccttgaaaggagactcctgggaaatggaatgaaacacgcgagtttctgtgaaaacgactctttctggtcatgctgagcaagtcagacaggaaatgaaggaggttgaaccatgcttgccgacttgttttcaatataacaacaacaacaacaaactgcttattctttgttatttctaagaattagcttgtgattggggggaaatgttaattagtaggaaaaatgcaccttttatcactaaaatccccatttttcactcttgacaacaatcctgtctagttgactttagtttctgtcgtgtgcatcaccttcaacaagagcctcccctaacacactgtttataactcacatgtctctccgggcatctgaggcggtgaggacccccgagcagccaggactgagcttggcgagcccctgaagcccaggggtctcacagactcttctcctgcagtgcacttgcccccgtggccgccatcatccccccgccccccgacgtccagcccgtgattgacaagctggccgagtatgtcgccaggaacggcctgaagttcgagaccagtgttcgtgccaagaatgatcaaaggtcagaagaagaattttatatgttaggtatatggcatttgggggtttcgtttagcctttttttaaaaaaatgtaggtacagaattaatttttttatatatttttaagccttttcttggctcaaatgtcttttttttttttttttttttttttttgagatggagtcttgctctgtcacccaggctggagtgcagtggcgcgatcttgattgactgtaacctctacctcctgggctcaagcaattctcctgtctcagcctcctgagtagctgggactacaggcgcgcaccaccacgcctggttaatttttgtattttggtagagacagggtttcactgtgttggccaggctggtctcaaactcctgacctcaagtgatccacttgcctcagcctcccaaagtgctaggattacagatgtgagccaccacgcccaaccaatgtctttagataaatacattttttaattggcttgttaaattgcttagacttgggtggtgtttttaaattatgttacctgttttttgtttcattttttaagtaggaattttgaagctacctaaaataaaagcctataattcatggttttcaagaatctgccttaaaaatctagacacaaacccttctttttaaaaaccaagcaatgtcccacgcctcagtactaataaaacgtaaagatatgttgtcacatttgcagcgtgacctgtgtaaccccgggcaagcgatttcgaccccctgtgtgcagtctccctcgtctataagatgagtagctaaaacagtaaccaccttgtgggattgttgagatcagtaaagagctaggagaacagggcctgttgttacttcagtgagcttgtcttggtaaatgacccattttctttctttttctgctcagatttgagttcctgcagccgtggcaccagtataatgcttattatgagtttaagaagcagttcttcctccagaaagaagggggcgatagcatgcaggtacgtgtctgaatgcagggaggctgtgaagctcttagaggtggctccgccttccagatcagaagtcgctttctgtttcttctcctacaggtgaaagggctgggtgattcttcacctttttttaatgtgtgtctggcatactccatctttcacgtcccccttagctctggaacctgatctgttgaaagcatctgcccacgttcacagcattgatgattgtttgtccagcacgttctaaacaaacaaaaaaaatcctgttccttcaactgttcgatgttttggccgtctacagttactagctacctttcatgacagctgggtaccttgcttctgttgtgttaacatgtatgaaatatataaaatataagtgggcgcctcatgcctggccagctggtgctgggggtgtcctgcagcacggcctctgcctgtgcctgcacgcccttccccctcaccagatccccagcgtggtgctggcgcacttggaagtgctttttgtcctacagccccctcttctgcctttgctctgctcttctcagttatatagacaccctgacatttttgtaaagccagttttggtgaggagatgacatgggccttacttctcaggagatttcttcagacccttatctccaatggcccacactgaaagaaactgactcctctgtaggtgatggggataatttggtatttttaaagaattctgagtaatcagtgtccaaagaaaagatactgaaaattggttcccaaggcagtattagggcttcaaagagtatagtgttttttcagacaggagaaaatcttccattcctctttgatacattccattgtaagaaaaaacagcagatctggatttggaagtctgttcccagtgctgcttgggcagtaatgtacaattgccgttgtccagtgaaacatataccgtatacatctctctttttttaaaatttctgtataatttcctgctgacagtttatagtgacatttaatctctaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaaggtatgctgccacttgcatgttggccttgcacattccaccgtaagttggcaagcgtaggatcctcggtgacctcagactcagcgccctcacctgcaggctggggtggggttggcggccccctggaggttgctgtggtgaaacctctgccttccatgctgtgtcatgcttgcctcgcgtggcattggaggtaacgtgagtgtgagcagcccttaggtatgtgtctgtttaacagtctgttcagtgtactggacatttgtacagaaagtttcaaataatcctttgtactccctgggacttctgaaactatttatatgcaaactgttgtaccagtgaaattcatttattaatttgtcaaagcagattccttgagaatctctaccaggcaatacttcactcactcgatttcagttactttgttatgttcttggagcaagactttgatgtcacaggacagacaggcacgtaaaaatacaaagtcagtgtaattaaaaagcagacagaagcaaaggccagagcaggcccttagccaggaacctcgtggagcagcagtgggctccccccgcgggagggaggttctgtggagtagaggcgttcagctggtgttgcgagaggaacgggaagctctgaggcaggggtgcagccctaggcaggagccccgtggtgcgagctgcccggccccgtgttgagatgcggtaggtggtcagcagtgacttcgggggtggctggtgaaggagccttggccagcttgccccggtgcaccctgtcggggaggggccagcacatctgacaggctttaggtcagcggaataactttatccagtctggtgactttgtgatgcggttaagccactggagcgacttcagagatttctggtggcattggtggcctggaatggagtgtgacaggtgtggcagtggggtgaggtgtggcagtggggcgaggcgacagctcttgggtcagaaggaaaggcagagtggagacaagagattgaggaagtgggctggggtgataagaggaccgtcctttgcataaagatgccttgttgtatgagaatggtgatcattcagcaaaaccaaatccatgtggatgaaccgctaactaggcaattcactatatgtgtctttgggcctctcattcgagtaggttacctgagcacaagtgatccagctctcacccttcccggccacccgcatactctcactgggataatcaaaggaatgtaataagtagaggaggaaaatggttactgctctagaaacccggggagaggtactgtctataggtcagggtaaggcagcatacctggagcttgcagagaagtacccttgagactcagggcagtgactccaggggagtcgactgtcagccacagaggggcaggcaggaggctggaacaagctgggagcttcccagaggcagcagtacctcatcccttctcacaccccagaacacaaccacagcccgagcctgcctgctgccccagggtttgtgagcccagggaaggcgcctgacccagccagctatggggtgtgcagaggggttgtgagcccagggaaggcacctgacccctgccagctgtggggcccgcagaggagcagccctgcccacaaggctgctgccaaccagcgtgaccttctccacacttccctgattgtcctagaacctggcagatgaaacaacacaccgagaagtttaccgtctacatccacccaagcctgagacacttgaacagagatctactcaatatctgacaaaacccatgctaactctcagttctcaaaagcacaggccagcctctctttgaaaagatgcggagacagaaatgtcattgcgcccacagagattccaaagttcgggagacacagctgagcctccaggcatatgggcatctctgaaacagactcttgcgtaacaggagaaaaatcttttaagtctctaatttgtattctacaaaatggaaaatattataaaactagtgctactggtaatcagacatggaaaagattgcttagaaattgctgtggagtgtggtggctcacgcccataatgccagcacatagggaggccagggcaggcagatcacttgagtccaggaattcgagaccagcctgggcaaatgacaaaaccccgtctctgctaaaaatacaaaaatgtagccgggcatggtggcacatgcctgtagcaccagctcctcacagaggctgtgaagtgggaggatcacttaagccggggagatagaaaccagcctggacaacatcgtgagaccatgtctctacaaaaaattaaattaaattagccaggcatggtggcacccatctgtgctcccagctacttgggaggctaaggtgggaggatcttttgagcccaggagacggaggttgcagtgagccaagaccacgccactgtgttccagcctgcgtgacagaggaagaaaattataggtatctttttaagtacacaagctacaactagaagttaacactagaaaataaagtatatgagaacatatattattttaaatttgaatgaatttgaaaatcagtgaaaaatatcgctttctaagaaaacataagtgctgaaattatttcatgaagaaatcaggaaccaacatagacctatagacctgaaagaattttgaaaataattggttagtgaaatacctctcaacccaggcagtcagccaagacaaattaaaggtcaagttaattcaccctcaagaaatagaatgcctacatcattaaagccactccagagcattaagaaggatggaaaagtatgaagctctcaaagcttggcaatctgtagaccacgatcacttacaagtatagatgttaaaatattaaactgaattcagctatgtatgaaaatagtaggccgggcgcggtggctcacgcttgtaatcccagcactttgggaggccgaggcgggtggatcacgaggtcaggagatcgagaccatcctggctaacacggtgaaaccccgtctctactaaaaataaaaaaaaaattagccgggcgtggtggcgggcgcctgtagtcccagctactcggagaggctgaggcaggagaatggcgtgaacccgggaggcggagcttgcagtgaaccgagactgcgccactgtactccagcctgggtgacagagcgagactccgtctcaaaaaaaaaaaaaagaaaaaagaaaatagtaatagatgatgagcaagtaggattgttccaggaatcccagcatgtcacaaaatgagaagaccttctagtatagtttacatattaacagatgagtggctttctcagatgccgagaaagcagcaacattctctcagatgttgatgatgaaacttctttagtataacactaattaatgttggaaaaacaggctctccattttgaaaaataataagatatcacatatttgacaaccataattccatataaatccagtatttaaatgtaaaacataaaactagaaaagtagaaaaatataaaggtaattttccttttaaaataatcttggagctggaaagaagtgtcttaagaactgaagctgtaaatcatagggaaagattggtaggtctaatgggggcatggcctgaataaagttaaaagacaaatacagaaatggcagtaactgctaatacataaaaataaaggttaacatcctcactatagaaagagcttttataaatcaatacaaaaagacagtcactgacctagagaaatagacaaaggacatgaaaatatggttccaaaaagaaaaatcgatggctagtaaatatattttttcaatgtagcctcattaacaagtttttattttttgcctctcaaattgataaagtttaaaaaaagtaacaatgagacagaggctgtgggcagtaggaatactgtttttgagtgtaagtcgatagaacccagtaatatggactgagttttaaatgaaaatgaccttctactcctagaaacgtgttttaccaagatgtctatacatggatgttcgttgtagggcatgtttgttttttaaaattaaaaaaaaacttggaaacagttatgggaaattgtgaattgacatgtccatactacttattgctgtctgtttaagtggtctgtgttgacacagaaacctgtctacacagtaaagaaaggagttgctggggccagacatggtggctcacgcttgtaatcccagcactttgggaggccgaggggggcagatcacgaagtcgggatttcgagaccagcctggtcaacatggtgaaaccctgtctctactaaaaatccaaaaatcagctaggtgtgatggcgggcacctgtaatcccagctaatcaggaggctgaggcaggagaatcgcttgaaactggaaggtggaagttgcagtgagcctagatcgcgccactgcactccagcctgggcgaaagagcgaaactccgtctcaaagtgaaaatagcaggttatgaaacgagctgtgcccccattttacacacgtgtgccattgtacacttctgcctgggaatccactgattatgttcagatgattttttttccatattggaattgcaattgatctatttgctcatatgttttcaaaatctcccacagaaaatgtatattacttttgaagttagaagttagcaataagagttgttagctaaaaaacagaaacctatttgctatggaagatggcgggttcactcaggggtgcccgatgccatgttagccatgcatctgtccccgcatggtcccgtcctccaccgcctaggagatagtggaccatcagtgcctgaatgcaaatcatagtgagtggtgtgcaggaaagaggttgggcagggcctgtctgaggaggcatcgtgggggccgatccttgaagaatgtgaaagggacaggagaagagcaggcagctctcaggcagaggtgaggggcagtgcaaacgtggagcagtggccccgatcactcagggacgtggcagccttgggaaggaactgggtttattctgaatgcagcgtgagacctactcactgaagctgtaggacatgctttccatgtgctgtgacgtgatctgcaaggaagattctaggcagaagcaacaattttgtgattgaaaaattccacataaagaagtaattcctgattccctgtactgacctgaggtacctggagaaacttagttaatcttttcagcctcggttttcccatctgtaaaatgggaagcctctcagtgtccatcctgtggagctgtaaaggctgagtaagggaggcctgtgggctgtgtgccataggccactcttagagtgagtagctgtggttttggctttgtgtttggtttgcatagatactagctttaaaatgtctacttgacaggccggacaaggtggatcacctgaggtcaggagttcgagaccagcctggccaacatggtgaaacccatctctactaaaaatacaaaaaattagctgggcatggtggcgagcacctgtaatcccagctactcaagaggctgaggcaggagaatcgcttgaacctgggaggcagaagttgcagtgagctgagatcgcgcctttgcacttcagcctgggcgacagagcgagactccgtctccaaaaaaaaaacaaaaaaaaagtctacttgaggctgggcacggtggctcatgcttgtcatcccagcacttcaggaggctcaggcaggaggattgcttgaggccaggaagtcaaggctgcaataagctatgattgcaccgctgcactgcagcctgggcaacacagtgaaaccctttctcaaaaaaaataaaataaaatgtaaaatgaaataagcattgctagaaggtgttctggaagctttcatcttaatactcttatttgttgattgcgtatttttctaatttggggagatggtttggaaataattgttattaaatcattttgtgatatattttagtccagccccttgtttgttttgttttgttttttgttttttttgagatagaatctcactctgtcacccaggctggagtagtgcagtggcgtgatctcagcccactgtaacctctgcctctgcctcccgggttcaagtgattcccctgtctcagcctcccaagtagctgcgattacaggcgcccgccaccacacccagctaatttgtgtatttttagtagagacagggtttcaccgtgttggccctgctggtcttgaactcctgatcttgtgatctacctgccttggcctcccaaagtgctgggattacaggcgtaagccactgcacccggccaattttttttttcttatggaaaatctcaaacatgtacgaaaacagaatatcacataatgaccactcacgccccacacacgtgctcatcatctggcttcagctgccggccctgctgctttttattttgatgttataaaatactgctgtcccggtatcagtatctttgtgtgtgccctgtcccctgaggcagttgttgatgaaaagtggttatatttcagagggtctgggctatcacatgcttaactgtctacttcacatcacacgcgggtttggagccataaaatgctaaagcggaaggacctccgccaggggccagccaggtagcccaccctgtgctacagaggtggcatcacaaacataagttgcagcccttccagaagcggccttgtttacccagaacccacttccctctcagtcacctggtttgcggtgcacttagcatccccttcattgtgggtgccttgaatattcttcataaataacaactgatggttttttaaaatactgtatcttattgcaaccagttagctcttgtcaagagccatttatcacagcatctgaaagagaaagggactctgtgttcattgagtggtggggcgggaaagatgattttttctttagggcctccatatttcccttaaatttaagccttctggatattctaagaggagggattgcttctaaacttttgtcacgctgggtttgacattttcttacaggtgtggaaaatggtctaacataatgcctgtcacaaagtaggtaaaaatgtttgctgaataaaggcatggattctgtaatttttgctttgtaagaaaaggctattttttatcatggggaattttttaaagagacctgtttatagtggagtcacatcatatgcctcctgaagcaaatttagatatatgctgagccatgaatttttttttttttttttaaagaaaaatgaggccgggcacagtggctcacgtctataatcccagcactttgggaggccgaggcaggcggatcacgaggtcaggagatcaagaccatcctggctaacatggtgaaaccccatctctactaaaaatagaaaaatttagccaggcatggcagcgggcgcctgtactcccagctactcaggaggctgaggcaggagaatcgcttgaacctaggaggcagaggttgcagtgagccgagatcgtgccactgcactccagcctgggcgacagagcgagactccatctcaaaaagaaaagaaaagaaaaatgacaagaattggccatttaaaattgcaggtgactgccctggcatcagcgagtgtgcccttgccatgaagtccccagtcagtgcggttctcacagcatggttcaggggctcaccccagccccacgccatgcagtgcacatctgcacaggtctgctctgacggcacggcgtcccccaccgtagaccctgcatatgatgtggctccatgctagtcatccccttcccagcagccgatgctcaggtgggtagcagggcctgcaaagatttccactctgtaacatgtatcataattctcacctttcctcaatagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaaggtttgttgatagcttttaaacttcttgaaagaaaggaaatacacaaatataagatttatctgctaagccaaaaaatctcgaggctgccaactagaatctgaagcctttggaaatcgacctatttgggagttgtgtaacatgtctgaggttttgaaacgttctcttttagaggaatgagctctgctcttcactgagcctcaaatgcagtgccgctggcagtttgttttcgaagaaactgagttggccgtcttagctctaatgcgccacagtggaatgcattaatggcagctcactttgcacttggctggcagccccagggtaaaaggctcagcctgtcttcccagctcaggaaccaaactaggagatgccctcttgtgaggctgcctacccacagaaccattgggcccttgaaggtggtgtgtccccagctggttttccggctgcggctcatcttcatgggccgcagtgtggccaccacacccaccccaacactgctggcagcatggggacagcatgtagtcttcccatcccgactccagaataaattctgctctgcattaaagcagtcaaataatggttgctgcattgtggttgttatctattctaactgattttcttaaattgcttttcctgtatacacacattcagatcaagcaacatttgaaagaggccaattttcaggccaggcgcggtagctcatgcctgtaatcccagcactttgggaggctaaggtgggtggatcacctgaggtcagaagttagaaaccagcctggccaacatggtgagaccccatctctactgaaaaaacaaaattagccgggcgtggtggcacacgcctgtaatcccagctacttgggaggctgaggcaggagaatcgcttgaacccgggaggcagaggttgcagtgagctgagatcacgccattgcactacagcctgggcaacaagagcaaaaactccgtctcaaagaaaaaaaaaaaaagccatttttcaaccacaatccaccatcaagaacttccattgtgctgtggtgttctccctaagcaaacttgtactcatgcctgtacatctgaatctgtccttcctgtgtgtaaactaaccaactgtcggatcatttggaataaaacacttctcatagagtattcattgcctggtgtgaatattttggatatatgctgagagccactctgaggttttcattattccagctttcgttagtgtagagtctcaccaaccttctaactctgaaagtaaaatgtccaaaaaagggcacgttataaactaattctctcaaaatttgatttgtccaatgtatgtacctattcagaaactttaactaactgcattgtatgacacttttgcaacctgtgaaaattaagatcagataaaatactgtttgctctaaacttctcttttttctttgtttattccttaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggtatagtaaaatcccacattggtatctgcggggctgtgtgatacatagaggcagggaggatgtgtctccctccagctgccctagtctctggcctgagtgagggatatgagctcccagctcttcctcccgacatggttgagtggcttttactctatagcagtgaatctaagagtttgccagcagtctcccccgtcagtgcacagtcacgccagcagcaaacactgcccgcgatttcaggggagcctctgcttcacggctgcccttatggggctggcaggagggcttggggagtgcctcccatgggtcctgctggggaaatgtggtggacacacttcactgaagccccgcctccgcagcagcaccagtattgcgctc

SEQ ID NO: 13260 - DNA, 18120 bp, Human
tctcaaaaaaaaagaccaggtaacaagtttgggtgaacaggattaaagagttaaataacaggaggaacctagaggacttaaagaaatgtgtggtgttgcatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtacaaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttcgactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgcggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagagatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatactcacgcattagagatttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagcgattctcatgcctcagcctcccaagtagctgggactacaggtgtgcaccaccacaccgggctaattttttgtatttttagtagagacagggttttgccatgttggccaggctcttgaactcccaggctcaagcgatccacccacctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtatgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttcttaccattcttgcttttttatactgttggaaattgtgcttcaaagtgtccttaaggtatttcttcttcccacataaatttttcctggctactctatttctgtatcctgctgtcagattttctccacagtttagcagagttatatggaagtaggcattgttgcattaaaggataaaaaagtagtcatactataacatcaagcattgaagatgaaaactgcaattttaaagtagagaacattttaatgtataaaaaggttggtattgccttttgtcttttatgccatagagattaagaggcggtatcaatagtggattgtaaaggtaactcagacttatggttatactatactattgtatgtaaactttctgatgaaggaaaatttggtgacattttgttgtttgatgaattagacaaaccttttgtgaaaaagaacataaattttttatatgtgaaaatccttgtggccgggcgcagtggctcacgcctgtaatcccagcactttgggaggccgaggcgggtggatcacttgaggttaggagttcgagaccagcctggccaccatggtgaaaccccgtctctaccaaaaatacaaaagttagctgggcgtggtggtgtgcgcctgtaatcccagctacttgggaggctgaggcaggggaattgcttgaacctgggaggcagaggttgcagtgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttaacattcaagaatgtatttataagtttgattcaaacactcatttgaaccacaaattacatttgtgtgtgtgtttgaattttagcactttaaaattattgcaagagctactgcctaacctagacctgagcacatgttttaggctcaaagatagtcaggaacatgggaagaaactagcttaatataaaccaaaaggtgaaacgtacattgtttctctattatttatatcagtaggacaaaaacatcttgaatttggacatttaaagagaatagtactaagtgtgctcaaggtagctacagcctatacctgttaccccttttagtttgttttattgtgttttgttttgttttgagaaagagtctcactatcacccaggctggagtgcagtggtgcaatcacagcctcaacctcccaggctcaaatgattctcccacctcagcctcccaagtagctgggactacaggcctgcatcaccatgcctggctaattttttaacctttttttgtgtgtgtgtgtggagttggggttctcactatgttgctcaggctggttttaaactcctgggctcaagcgatcctcctgccttggcctcccaaagtactaggattacaggcgtgagctaccatgcctggcccattacccctttgagttggagaactgtctggtagcaatagacttacgagggtttaaatgggaaaggaccttataaattctttgcccaatttagtctaatttccatcactattttgaaattttgggtaagtataatatgaaaataacaagtgttacataaaataaatacttagtaactggtcttttttattctggatctgtcttgatattaattgtcctatgaacacaaaaataatctttaaaggctaggctggccaagacttagagatatcacacagggctctatttctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacccagaaaaaaaaatgtttgattcatcttggtttttatctaacaaaagtaaatctaacaaaaacgttagaatgaggaaagcaaaatttcttgtttagaatacacagctatagttttttgttaaacttcttgcccagaactcttaaaatagtaataatgtacattcgttcaggtatatgcaggtaaaataacttaggtttctactcccacccccgacagtaacagtgagatttttaggtagctcagtcaccaaaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaatttttttttttttttttttttttttttgagatggagtctcactctgtcgccaggctggagtgcagtggcacgatcttggctcactgcaacctctgcctcccaggttcaagtgattctcctgcctcagcctcctgaggagctgggattacaggcgtatgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgacatatatgccctaacgcaaattcttgagaactcaaaaaactttctaaattaacctcatatattttttctttttctttctttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctgagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacatttccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatgactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaaaaaaaaaaaagttgttggactgacagatgcatgaatacagtagtaaaaatgacaatcacttataagttacagtttactatcagctacagaggatgggatatccagttttctgaacaactgttctcttgtacttgtcaaagccaaagtgtaacaacacatcaagtcactttagcaatttatttttgagacggagttttgctcttgttgcccaggctggagtgcaatggcgtgatctcggatcttggctcaccgcaactgccgcctcgctggttcaagcaaatctcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaaaaccaaagaaaactgcaaaataagatcacttacctatttggcattctcaactgtctggaacagcaaggagccattatgattatgcatttggtttgtggggtgtcttgaaaagtcaaaataatgtaacaaagctgatgtactttactcattagaacaattcttcacaatttaatattaattttagatacacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactccaccctgaatatcaccaccaatctcattctcttccctttaagttactttgccttattaaaagaactgctattggccaggcacagtgcctcacgcctgtaatcccagcactttgggaggccaagatgaggatcacttgaggtcaggagttcgagaccagcctggccaacttggtgaaaccctgtctctactaaaaatacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggttcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttcaaggtggagcttttcatttttagtaattttctttgatttctctatgtccatgtgctgtcaatattgatagaagctgaaatttgtgaacttttatgactacttttcttttttttttttttttttgagacagggtctcgctctgttgcccaggcctggagtgcagtggcatgatcatagctcactgcagtctcaaactcctgtgctcaagctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaagtttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatcccattgaaaagagtatgttgttagaaaagaaacatcatttttaagtttctgagcctattaaaatgctcaaacacaaaatattagtatttttaaaatatgaatgggatgagtgaagcagttctcagcattatagtcacaatgttacaaaggctagagcttctctgaagatttctaatctgttcccattaacagattaataaacttagacttcaaatgaataatttgcccaagctttaaaagtaatagatggcagaccaaaaatgtaagcttaagtttcctgactctaaagtcaaacttagaacaaatttggtttgtttttgttttaatgatactgcgttttaaaacaaagtagctttatcctttttctcctgtatttttcttttacaaaatagctgtatttcttttatactgataatctcatttttaaaaatcagacagtgtagaaagatattttttaaaacagaaaaatcactatgaatccctgcacctacaggtacagaaaattatttttatgaacaaattatgtaggaagtgccagagccttaggtcctgtaccctgaggtatatatactgaacaaaaggaactgagccacagatctcttaggtagctctttttatcttacaatggaggacagtgattacaattatatgaaaattttggaacaaaagttaatactaagattcagtgcaaaatttggggggggggggggcacaggtatacttaagcacaaacactgtgacccaaagtgcttcaacatttagttacagatagtagtatactagaagtggtattttagaataaagtggttgcttagtattcacaggtcacaaaacaaaaaattattcttgtatagcaaattagcttcagttgaaaactatttgtaaaagcagattatgtaatgaccaggagttcaggaaaatgacttctgaaagcattgagaagggaaagccacgttaaaggacagtacagctggaaggaagcaagtacttacccactgctcagtcactaagacaacaagctccttggagtgctttaagctacggaatagcagaactggcccttcccaattttatgcaccgtcacaaatttcttcataatggttttgtccaaggcttataacccaaccctggcaactataatccttactttatgaaacagctgtatttcttttatactcataacccagaaaaatgagaatgtatgttctgagtataaaagaaatgtagctattccataaaaatacaggagaaaaagaataaagctattttaatttttttaatgcagtatcattaaaaaacaaaccaagtttgttctaagtttgactttagagtcaggagacttaagcttacatttctggtctgccatctattacttttagagcttgggtaaatcttcatttgagatctaaatgctatatatagttcattcatagcagtaccagataagggaggagtatatctatacagtatatagtcttgaagaagtgatctaaggctcggagcttttgaggtggccatgagtgactccaaagtccatggagctaaccaccctgcagtgctagccaatccagttgaacatacccttttctccattgttaactgtttgtttaaatagcaaacagaaggcggcaatggaggtgtggaaaactgaggatccgatgtcacttgaaagtaatgagatcacataacattgagggaatgtcctaagaggagtggcagggcataaatagaaatgaataaaagtgttttcaagtgccatttagtgggttctgaatttgaactagagattgagatatcc

SEQ ID NO: 13261 - DNA, 36156 bp, Human; identical to SEQ ID NO: 12128
  misc_feature (1)...(36156): n = A,T,C or G

SEQ ID NO: 13262 - DNA, 49164 bp, Human; identical to SEQ ID NO: 12985

SEQ ID NO: 13263 - DNA, 49164 bp, Human; identical to SEQ ID NO: 12985

SEQ ID NO: 13264 - DNA, 37195 bp, Human
  misc_feature (1)...(37195): n = A,T,C or G
acgctgagcctatttttaggcctttggggccgggttgcgggaagccgggagtcggactagcgtccccgggcgcgagccccgtctggtgggagggcgccggctttggcttcacttgttgcgaggcgtccgggccactccacgagttagccccagcactgggaagctccgagttagctggtccttccgtgtcattgaggctaatagccagggttattacagcagttgaactgccacaaagattgcaggtgtaacccagagttcagccgtctttaggaagattaaactcctacccagctgtcattggtctttcttggtcatttgtaatgttggctagtctggtgttctaacctgtgttctatcccttatttaatcttggaaatcatccatatccttgcttccagaaatccttgaatcctgctcaccttattacatttttctccatgatcgcctggaacctggacttcatttgagttagatgatcattcattttgcctagcttaagtatttttggtacagattgacagcgatgttacccatgttataatgggctgaagataatagaagcaagtacaggcggatgttgatgggcctgtcaagggacaggtgccactgttcagagctttcctagagtgtgagtgactgggaagctggtggcccttcgggggtggggaactggtcttcctacaacttagtagttggcctgccgtgggagagggcctaataaaatgtgtgaagatggctctcaggtcagcagccgagggatgcgctggcccactaggcaacccacaacttcctctcatgtctcggtggaatttctactgcttccagcctccaccttggaaaacgggcaagggagaatgagggaaagccaggtcagaaagagaaggacttcatgacaaaatgtcccaactcgctggttaagcaactgactcctaccagaacttgatccgaagtgtcctatgcatttggatgcccaccaacttgctaatgtttcttggagatggaacatggcccagaattgtcccagggaatgactggagaaatcttgaagcctgtgctaggggtcttgggagggtggggactgttcagcaggaggaaaaatccatgtatttaccttctcttctggcaactaagtgattattggagattggggtgcgtgtctgttggtttgggcggggggagggggagggtgcaggatggacctgcaccttcttctccaaagaaaagcaggcagttgtttagggcttcttgggtgatctccaaatctatttatcagtgattgataactatttagatagaagcatcaaggagggaaagcctctttgaggagctgatacttgaggagagactcaatgttatttttcagggatattggggcaggggagcttttgctccacgttgaggaaacagttatgtataagatgcctggagttcgaggctgcagtgagctatgatcacaccactccactccagcctgggtggccgagtgagaccctgtcttaaaaaatacatacatacatacattcctgaggcatggcataaacgtaagcaccagaatgaagaatatggactctgctttcagactgactgaattgagtttgacggttggttttgtgcttgtctgaaaacactgtctacagtaccttgtagaagaaacagcaaatgtactacttgatctcttcattaccatctgttagttgcctggagttcaaactcttggtattaagctattgttttgtctgagaatttagcgtgtcggatttaatttctatagcttaatcaacctgttgaaggttgccatatgtgcctgctatgatcttgaaccattcttgaagtgggcacttggggttttctccccaaagggctacagcttgattcatagagaaagttgatgttagaggaactggttttgctgaattactgtttgaatgggttcctggggaaaaggctttctccagataagatactgtaatgagtgttttttttttctttgtattaagatcaggcctttgtgacactaaccacaaacgatgcctacgccaaaggtgccctggtcctgggatcatctctgaaacagcacaggaccaccaggaggctggtcgtgctcgccacccctcaggtctcagactccatgaggtgaggacctcgctgccaccccagcatccaaggggctctgacatccttctccctgttgctgacatcattggacattgaggccatgctcttttcaggaattgagcaccgggtagagaaaaatgagagatgctgagtgcaggattgctgtatttgaaacctcctcctagcttttgggagatattccaactcaattcttttctggaaggtgttatgctggcccacactttctggttccaactaggaggggaaagaaggagtcgtcttccttcactccatcccctctgggtgatctgaaggagtgtgtcaggcattccctgcttacatacacctttacacagtcacaattcatggacattcctttcccaggatgcagcaggggctacattgtttcatgttgcaaactagggaaactctcaggtgacttagaaaagtagttattttatccattgccagttgatatttgtaagctaaatatctttatttacaatataatacactagaatctttaccaaagggctttccaaactaggttttactaggggaaacacactaaagggtataaactgcttcatgattggttagttcactttgatccgatggaattaagttttgaagtatttgggccaggtgtgatggctcatgcctgtaatctcagcactgtgggaggccaaggcagttggatcacctgaggtcaagagttccagaccagcctggccaacatggcgaaacccgtctctactaaaaatacaaaacctcatctctactaaaaatacaaaaattagctaggcatggtggcgcgtgcctgtgatcccagctacttggggttgggggctgaggcaggagaatcgcttgaacccgggaggcagaggttgcagtaagccgagattgtgccactgcactccagccagggcaacagagtgagactctgtcttaaaaaacaacaacaacagaaaatcgaagtatctgaatgagctacctagtctctagtagtaacttaaaaaatatccgggcacactagtaactttgtgatgtgtttatttttctggtctcctggccctctaagaaattgaaaatgccctttttgtgactttttatttttttcccaaaaagtataagcacaggccaagggtctctaaaaagtagacgttctgtatacatacgtatatctttcacactaatacctttgttcctaaatggtaatttaggaagatgccaaaaaggctgtctcctaatgtgtgtgccctaatttgtagtctattaggatatgtctaagaaaccagatctagtcttgcatttcctgtaaccaccatcagttgactttggtcagtgattctcctaaccatttctcttcaaaaacgtcaagtttactgtgtgaactgtaccatatttttgtacagctttggagacagaatacaataccagttttgttctgcatctctgatgttataaactttcagtatgatacgtttttacccgtgctcagtttagtgtcttacccaagtctaccctaccgatccaccataaagagctttctaaaataaagccttagttaatctggggcatagagaagtgttgtacctcacaaaccaacgtgaatctcattatacttaaacagcgtgctcagcatgtaataaatgctggttatattggattctacaaaatggcaacctgatgaacagagcccttacacatttttgcaagctatttccacaacctgcctgctattcagtgatacaataaaatacaaaaacccagaaaatgtcttctataataacgttttaagatgagcatttcatcctcaccataagcagttcttactactttagtgacgttaactggacatgcaaataaacacagtttgtcctggagtaaaattagaacagatttaagggtacatattctaccaaagcaatacattgttctagtaattgatggagaaggtaataaagcatcagtcttacagcagatgggtcacttgttctgaaaagatgctaagtgtggtattctggattttattttgacagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtgagtgtggctttgagggtagaaaagaaagacatatatatatatggtgatggagacctgtaggcatttgaggaatgctgtcaagacttgacggtaaagttcagatagaaccactgtcatgaaatatgtcaggggatgaaggagaggaggcccaggctgccttacagctgtcaccatcttttgtgttggatgacataggaagaactcaagaagggtattctgcagcaaaaacatttctgtaatgctctttctcccctttgatcaggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtatgtatttgctatcttcatgtctgataagctgttaatagtaatttctaggggctgctcttctcaggaatataattgctgtggtttattctgcctggaagatataagagatggagcaagcattttaagttgtgctcttctgggaaatattgtgtgtgtgtgtgtgtgtgtgtgtgtgtaaatgcatctttttctatagatgtgaaagattaacctaaactatgataggcaattttataggattgtctttaagttgtcttcctgtatctagagtatgataaatgtactgtgattattcaaaaattcaaaagactgaaaaactttaacatctgtctttaaacctaagtaaacgtaagctcaagagagtttgacagccattccaggaggatcaagcattgtcactatggaaacttgaggaataagcctgataatttgggtctcattctctcaggcggcataaaaaagaagaaagtttgtgtgaataatctttgcttccaaactctcattctctataaggctgtcagagtagtatctgcagggccaaaaagtagaacattggcaaagtcagcatccattttctataacatataaatgtatttatagttatatttatataatggttctgtctgtgatatagggcctcacatcttttggagaagttgatcaaatgaattagtaagtgtgctttcgtttcaggccaatttctgaaataacaagccatgtttttaaaaacaaaaacacacaggacaaaaccaatagttaatatgcagaaggagttctttgaaaaattatttttgatggttcttttgaataaagacccagaatagagaagaaggaggacattctcttagaagccctcccagcagtgcctcactatcagatatgtgacattgtagcagggcacagtgctgtgtgctattcacatggggttgggccagaggcccaagctctgctggagacacagcggggacttctttcctcctctcccctttccaagagtagatctgagatttgcagtaagtagatcttttggaaatagcagaaacagcctttctcatttgacaaaagattcagtcctgggtgcagatatgagaattcatttttattaattggttagaaagttaaaaaaatattaaactttaaaaatgaaaacattagacctataagtttgttagattgctgaggtgaagatactggaagttaaaacatttcaaattatacataaagctgagattgggttttcattgttgctattcacagaaattgaattatttttagttatttggctgaggatttgggaattgtggctatatatgaaatgtaattgaaaataatagggaagtttaagtctcagttttatttcactatttagcttgtttatgctgtaagctaatagttctcaaaacaagggtgattatgtcccccaaaggacatttggcaatgtctggagacatttttggttgttacaactgaagggggagggtgcaaagggcatctgatgagtggaggtccaggatgctaaacatcctacaatgcacaagacgatttcttccaacaaagaattacctagcccagcatgtcagtagtgctgaggttgcgaaactctgctctctacatgctctaaaacagagcaggagtatctgaaccataatgtatggcagcatctaacaagaagtgaagtcttgttttaagcaaccttaaaataagaaaataataatgtgttaaatgttcaccgtggtcaaggccgaatgaaacttcttcgctttactgacatgtttttagctcctgctattttcctttcatagaaggaatgaaagctgtattagcctttaagttcaaaagatgtattccttatttctactgcttatactgaaagttacctttgcataaaagaggagagtgtttttagcagaagtccactgtttgtcttaaccttctcgtcagagtgtagctttcttcacctcctctcctaatttgaaggaagtaagtgtaatcctgccagaaattcggtgtaactcttttcagctttagtaagtgaatcacattctaaagtatatcttgtggcctgccaactgcctgaaatccacatgattttaatcatgtaaagagaatccaatttctaacctagaaaacgattagatgttattgagaggtaagactttgattaccaaacagtagtgtgccgtggtaaattatctaggttataatttgagaatatgaaactaactaacctattctttgttaagaagcttggatgcgtgcagagtgctcgactaggaagcacttcctgctttttcagccagaatctgaaaccaccgtgagattctgtctgtgcctctagcacatttcattattcagcagcaggtttccaggtgctggccatcctctgaggtattccatttactggctcattggtggtgaaggactgaatcttctctgttaatagaaattgaaagaggtaaaaagtcatctatgcagctgagaacttatggttctcaatatgttgtttaaattcagcagaagaatgaattagcagttctcgaatcaaaggttgtgttcacttgaaatatgtgttaagctttacttagcaaagaaagctcactctataccttgggaggctgcttctctctggaggggtttactatccacttgaatcaatgtgtgaactgtgtgacataaagatgtgttggacttatgcttgatagcaataaaatatttctttatggacaatgactttgtctaatggcagtaacctttgcctctggttttcaatatgttattatataaaaattataaatatagtaaaagtaaatagtcttaaatataaaaattaagaattatataaaaataattttggttaggtgttgtgctgtaggcactgatgaacattttcaggtgttcctttcacagttacccacattttctcacaaccatagtttctccctccaccacccccatagtcagttttaagtcccggaattttcagctcagaccagttttacagatgactgtatctcagtgtgaatatctcgcaggtcatgtttttaacctctttcctgtgttcatcagaaactggtggggcctgatgtccactgacaagccacacaggctgttgatggctgagcatttgcagctgcttttgcaacccttctcatgcaaaagaatgtggctgtcattcttctaatcaccagccctctattcacagcctctccacctctctattctgtgactctggccaagagaataatcctaatatggcaaaccatacgaggtacctggacttctctttcttcctaaaattctataatgttagattttagaactggtgactacataaccgaattcatggctggtgtctaattttccataatgaagagtcaaacttctatactgttgtattttcaaactgtcttggcacttacttcatcactgtaattacatatttcccgaaaagttgaacaatagctgttgtgaaatagttctacactagtattgtataggatgtgacaagataaggttagcttctgggcatgttagcactaagaggggaagagagagctcattatattgtaggttctaatcagcagttttgcttctgccacatcggtgaaatgaggctgatgaacttgactctgaagaaatcaacctgaatgcaagttgaggtttattttcttttcccctgtgactaatatatcttaagagtgcttgtatagttgaagagttaagtgcttaaaaattgtctattttgtctgtatgtgttagtttcaaaaacctaagtcagaggaattcatattttgtaatttggaatatccttaaaaaacatcttatactcattttgattactgcagtgtaaatatcctaagcttttgattggtgtactggaattttggtctgtagttgaatttctagaaagaagaaaacataggagagaataaattagtagcagaatattaggtatgatttatttaagtagagtccaggatccgctttgaggtcactatatttgtgtgttccaaattctaagtggtcattgagtcccataagcagagtacagtaatgttttaaaataatgtttaacagaaatgatttggtgctacattgtattaaagtgtaaaattgaccccagagctagattttaaaatctttgtagttaattaggcttcatgttggacctgcccaaaaaaagaatgaaggactgagatatttcaagatggtacttgtccaaaccaaatgagctgagagattttggtgtgcttcacttggttccctgacttgataggtcagcccggacagttatcttcccatggtgacttcccccagccacccaagcactaggctgcctgttctagtaatttatcagttgttttggaaatgactgtgttctcttgcatttgtgtcattttattgatagtttggataataagtatcttgaggaaaagcaaaagccatatcatgtaatggcaaaattaatgagcacacgtaagtttttttaagagctattgttatgtcactgtacccgtgaatatacttttttaacttagccacctgtctccagctttgtaactgtcagagatcatgaaccctgtgagaaatagaggaggaggaagggactaatgtgttatatgtatgcaggcttgtatgctggtcattttacctactttttcacttatttctcaacagtcctgtgaggtaggcattcatacatccattcatataacaaatattaattgagagcctgctatctagctagcactggggacctgccattggtacagttcagggcagcagcttgcctgatgtctctgagctaggcaaagtcaggtctgaaccagggtccttctcaactctggttgggttatgtgttgtggtggggtgggtggtggtggtgggtggtttttccattcccaattctctcatatggcagcattcttgagtatgtatcctgagaataatacgggatggaggaagatccctattaccttggctttatgacagatgaattaagtaatttctctgagtagacagagcagctggtatattcctcattttacaaatgaaggaatggaggctcaagtcttctatctctattgctactgttcctcccctctgatccaaaatacctaaaaatactttgtcgtttaaaatcagcagcacagttcatcgtcttgcagtgttttatggagtctagatgtattcttggaagggttcctctcacctatatttctgtagtaggtccattcattatttcaaacataattttaatttctaatctgggcaaaatcctaaattgaaggggcaaaaatagactggtaaataatacagattttattcctgcctctataaagtttatattctgagaccttacagacatctaacaactaatacacagttatgtaatcatgattctagtaagttcagagtactaagagtccagactaggaggacctgccttagactgagaaactgacatttaagccaagaataaatgtttccttgcaagtatgtaataattaatagcttgatacttaataatcttttaacaaagtagtgaaaaacaaaagctataacatgaagtagtaaaataaatcagttattcttggcttaaatgggttgaggccagtgagatgccgtgatgctggggcccaagctccaagtgcctggatttccataagccaccttgggttaatctaatgatcctcagtaaatctcataaaaatatccccaagagctgggctttcataagctgtaatttattaatccttagcatgctcactataggcagtaatgattatatccaccaagcattttgtaggaagttagttttaaaaagaagtgtccaggcgcagtggctcacacctgtaattccaacacttcggaaggccaaggcaggtggatcacttgaggtcaggagttccagaccagcctggccaaaatggttaaaccccatctctactaaaaatgcaaaaattagccgggtgtggtggcacatgcctgtagtcccagcttcttgggaggctgaggtgggagaatcacttgaaccctggaagcagaggcaatgcagctgaggtacatgtgatcacatcactgcactccagcctgggcaaaaagagtgagatcctgtctccaaaagaaagaaaaaattcaaaatggtaatcattattctttcccaagctaccctctggaaaattgttcagaatacgctttttggctttgggggaaatggtcctgaaagggcttacttgctgcatttcattcagtttagaccatcataatccccatctctgtccacaaaatgccaaacaaacttnnnnnnnnnnnnnnnnnnnnnnnnnnnnnnnnnnnnnnnnnnnnnnnnnnnnnttttgtgtttttagtagaaatggggtttcaccatgttggccaggctggtcttgaactcctgagctcaggtgatccacccacctcggcctcccaaagtgctgggattacaggtgtgagtcaccgtgcctggacttttactttatttactttgtccatctgtccctttttggattttgaagtatctgagagttggaacctatctgaatcttcctattatgtgaataccaaatttataaaatgttagacattttttatagaaatgatatttttaaaagttattatcctttgttataataaagaagtcgttcttcaaaagactctagtacttctcaaatttaatatgcagacaaattccctagggattaagatgtggcttctgattctgtaggtctggggtggggctcaacagtttgcatttctgtcaagctcccaggtgatgcccatgctgctggaacccgggccacagtttgaggagcactattatagggggaacattcctttggctgagatgctggggctcatgtctaaaccagaattaactcactgccctgttatccacagtagacaagccagctgccagcaaactgtggaagagcacgcaaagtacacaagcattgaacaaatgcacagatttaaaaagacaccacttaactcttgtttctgtcttaggaaacaaataggcccagtttctgataaatgcatccatggttaccaggtatgtgaccctgctcagaagacctagaaagtaccaagtctgtagttgcaaggtgattacacagcatttgcatttgggcagccgggtggaaggatgattcagaatgagatacttgcttttgttcgcaaaacagatgcgatgtgccccttgttccatttcctttctccctgtctctcacctgtgttaccacaccctggtgtaccggatcacagctgctagtgatgcctgctaatcatgtttgttggctctgagatgagtgagattaaaattatcttaacctgtcagattagataaagctgcctctagaagtctgactaaaatgtatcggacaaaagttgtagggtttttgttatggaaaatcagcagtctttagggcatccttgtatgttttctaatacagatgtgcctagatttgcattctgctttgaactgtcctatcatttaaagatttttctaaagagaggatattggtaacaccatacatagatttttctgatgacgttaaaacatttgcctgaccttaaaatgttgaactgtgcatttgggaaaaggtggttaagatttctagaccgctgaatttaaaaattcagctacggacttctacatggcatttaatttatttttaatccacaattttggactaaatgataaacctttgtagtcacataatgaggtcagtggccctggaagttttatgacctgtgttgtcccctctggagccaaggttcttgttgagtgtttcaggatttgccaatttaacaggcactgttgattcaccagttctgcttcagtgccttttctcttccttgcttgttttctgtacaccccgtgcttcccagccttcctgtggcacacagctgatgggctgatgatgtttgtagggtacctgagggtaaacagaaacggccttttgtggccaaaggcagccagccagggactttgagggatcagcagctctgactcctgtttcccaggctcatgcaggtcggatttggaagttctactttacaactacgatttaggcctctgtggaattagatttctttactgcattatgggtagctgttagtcattttaagtggaattgcttcagttaaagaaggtgttataatgtccaggttctcaaattggataaatgtgtagagttttattattaatatcctttataacctacacatatattttttttttggtagtatacttcataataaaaattaaaagtaaagagtatttagaaagaaaagatctaagcacagttctcattcttgcccccagttgtattactaatattttagcattaaaagaataataggaaaaagaggggggaaggaacatctattacaccaatcccctaatgcaattactattattttatttactttcttgtaatataaatgttaattaatgtttatgttcttagttataatcacaatgtatgtagctgtatatattacacagtgtactgatgttgtctttatagacattagttttaattgctgaatcatattccatgagtagttagtattaatatactaaccattcctgtatggtagaatataagtcgtttaaatttttctgctgttacagaatatcttcaagattcttgcattcattccataaataatttgcctatgtgtaaggcattctgctacatgttagcatcataatggtgagcaaaaggccataatctctgttcttgtggaatttagcatctaattcctgattgtattttgcacattaattgtaagagttttttaaaaacctgttcattttgagagaatttccatgcagttgtaagaaataatacagacagatcccacatatgcttcatctgttttcccctaatggtagtaccttacataactaaaatgtattgccccaaccaggagattgacattggaccaatccaccaaccttactcagatttcaccagttttatatgtattcccttttctgtgtgtatgtgtatatgtatatgcacttttggtttttatgcaactttatcacatgggtagattggtgtgactaccaccatagtcaagatgcagagtagttccatcacaaggacccttcatcatattcttttttttttttttttttttgagaccgagtctcactctgtcaccctgccttgagtgcggtggcgtgatctcagctcactgcaacctctgcctcccgggttccagctgttcttctgcctcagcctcccaagtagctggaactataggcgcgtgccaccatgcccggctaatttttgtatttttagtagagacggggtttcaccatattggtcaggctggtcttgaactcctgaccttgtgatccacccacctcggcctcccaaagtgctgggattacaggcgtgagccactgcgcctggcccatcatattcttttacagccacaactacatctgtcattctttccctctcccctggcaaccattaatttgcttcctatctctatacttttattatttgatgttatataaatgaaattacatagtatataactttgtgagattggagtttttcactgagtgtaattaatttaagattcatccaggttattgtatctctagtttgttccgtcttatagctgagaaatatcccacatggatgtaccatatccatatacctgctgagtgacatttgagctgttttcagtttgtaccattatgaacaaagctgctgtgaacatttccttagcctttttttctgttcccatggaaccgattggcagtattttgatgattatgtgtaaaaggaaattagttaagacttcaggcctctgtacctcagccattagtgtctagtcccacatttgggtatctttgtagaatccaaaataagcctttaatgaatggcatgatgttttggctttgatagtttgtgcctcagaatacattaatttgcctattagctaaaattgtctttggttctcatatctgtcctttgtcttagcctattcaggctgctataatgaaatatcatagattaaatggcttataaacaacagaaatatatttctcacagttctagaggctgggaattccaagattaaggtgccagcagattcagtggctggagagggcccacttcctgggtcatagacagcttttttatttttgtttttttgttataactgctgcatgtggcagaagaggtgagggacctcacttgggcctcttttataagagcacaaatcctatgcatgagggcagagccctcatgacctaatcaccttccaaagaccccactccagataccatcaactttggggttaggatttcaatgtaggaattttggggtatctaaacattgagtccattgcatttttataacagtgaagcatattctgttgccatctttattgtcctttagaacttataagagtgaaactgattttctgttgttcgtcctttgaggaacagagacctgtcaggggtgctgtttaaggaggggtttcctcaagacaataagtgaacgcctttgattcttagagttgattgaaggtatttggaaaggatagaatacgcagagggtggataaggtacacttggactttaaacctaaagtcctgatcttactacttaactccaaaaattaaatagatctctagatttttaaagtctccttgaaaagtaaggaaaattgaatagtaacgacagccgactggacttgctgtatgttgagaaacgacctggattttttggcaaaggagactgaggagaggagtgactatgcagtattcctgcctgatgcttagagcaggtgtctgcctgcctgccatccccatacacactcgcacatatgcactcatgcacatgcacacacatcgtgaactcctgttctgctgcttgggagactctggttctgagtgtgttttctgaaatctcatgagtctaaaatagaaagcacatgaaatatatggaagaatgtgtcttgtattgtttttatttcttttgaatgaatggccatgatccccgctttctgaggaagatatgaagtccaggagccccaagggctgagcagacactttgctgtatcattgtagctgacgctggccacagtggtgactgagcaggatctgcccagagacttttggtcagtggtgggagagtgcaccataggggtaatgtggccttctgggccctctgttgataagccaacagttgtgggccctggaaaacaattccattgttccagtttgctctcttttactttttgattctttttgtcctgttatactcaggggaaagtctgaaatctttaactggaaataaagtgtacaacctgatccctatgtggtctggtccctgccgccttctctgagactcacctggtgccatgcaactcattcccgccgagtccacttactcaggccaccttccaggccttctatccatagcctcatgctcctgcccgccacaggtctatggtgtgcactatttttgttctgcctgggacacggtcccccgtctttcccccatcggcatttttcaggtatgcctgtgcacccctcagatattggtttaaacacaacttccttgtggaagccttccttcgcccatcagatgtagctcaagccacttccacgtgtgcctgtagtgccacgtacattccttcactgcattcatctccatctgtgtgatgtttgttgatttgatttgctgctgttggtgtctcccacctgacccttgtgaagacagtgaccatatctctttgtgcactgttgactctgcaatgcctagtacagtatctggtacatagtagctgctcaatagatatttgtcgaattaatgagttaaatcagggaaatggccactccttaaaatgtttttaattggtgtgtcaaggaacttaactcaaaaatgagggccgggcgtgatggctcacgttggtagtccttgcactttgggaggccaaggcaggtgtatcacttgagatcaggggttcgagtccagcctggccaacacggtgaaaccccatctctactaaaaataacaaaaaattgcctgacgtggtggcatgcacctgtagtcccagctactcgggaggcttagacaggagaattgcttgaacccaggaggcagaggttgcagtgagctgagatcgtgccactgcactccagcttgggtgacagagcgagactccgtctcaaaaaaaaaaaaaaaatggaattagtgtctatttttaaaggtccagttatgtgctcctataaaattattaaactgtctagagatctgttaactaatttatatatttttttcttttaggtggggaccaaggcatactgaacacattttttagcagctgggcaacaacagatatcagaaaacacctgccgtttatttataacctaagcagcatctctatatactcctacctcccggcatttaaagtgtaagtgcagatggtttaactattgttggagatgttgagggcagagaattggggtgtacaattttggggctgcttcattgtcattccgagggaaataacagatagacactttgaggaaagtttctcttgtaagaaccgtggctgcaatggggagaggccttgatgttatcggttgcctcatgcttgaccctagggtccttagttgcctttgggacaaggttcccatcagtttctggggttcatggccctctggtaagttattaatatgtcatggtcaaaaacacagactcttaagctctgcagacttacaacttggaggagctgagtttgtgccctaactcaatgtcttccccatactggctgctgagctttggtttccttcacctgcaaaaaggtgttaaaagctccctcataattgttgtggggattaagccagatgcaggcagcagtgtgctgctgtggctaagaataagggctctggagctggatgacctcacttcacatcctgcagtgaccacttcctggcctacttactgaacttctttctgcctccatgtcttcatagggttattgtgggtagtaagggaggtaatcatgtagcatggttagaagagggcctggtctacccaactgctcagtacacgttagattgttagtcatttttatttgagagaagcaatatagtgttcagagtaattcgtaaaccagaaaggcagggcatatgtcctcactctgtcatttatctgctacatgacttaagacttggtgcctcagctcctccatatgtaaaacgaggaggaaaatagtacctacctcatagggttgtcaggaggatgaaacaaattaatacatataaagtgctcagtggacatttgttgtttttggtaacgtgcttgtttagcacgcacagtccctggtgcagttcttttttttttttttttttgagacgaagtctcactttgttgcccaggctggagtgcagtggcatgatcttggctcactgcaacctccacctcctggttcaagtgattctcctgcctcagcctccctagtagctgggattacaggcacgtgccactacacacggctaatttttgtatttttagtggagatggggtttcaccgcattgtccaggctggccttgaactcctgacctcaggtgatctgcccaccttgccttcccaaagtgctaggattacaggcatgagccactgctcccggcccctggtgcagttctgatacaccttacaactaatacagccttgctgcactgtttatctcactgttagggacaggatcctattatttagcctctgactcatttgtgtttaactaagaagatgatttagatttcttgaacaggggactagctgtcaggtcgatcctgagacagttgtgagcagcacagcccttcactgagttgggccaatctctgtcccatatggacattcctgagttagcggaaaacaaagggcctttcactcctcatatttcattatccaaagtcctctccgtaagtcttacaccacggtaataagcatgtctggctttttgtagcagcaatgtttccttttctgttcttttctgggaagactctatcaacatcctccagataaggattagaagcatctcatgttctttcctccctaactgttcccttggtatatgtctccaacatattacattctcttccctttgtacaatgggaacaagcagactcttaaacacaccaactgtgttctgagtaaagcagacaacaggattcactgtcaagggaggaataggagaagcattattttcacctctcagtccttggccttgtaaaatacaaacgtgtctcacatggaaatgtgaacctgatccattttaatccttacttataaccctgctagtctgaatagtgttcttgcaaaccatgacagtgtgacccctagagccgaatttgtctataataggacatttgcttatagtttaattgactgaattcagtttagcaagcaaaaagttgacagtgcagaggagaaagacttttgaatagtatgaccattccactcagtcctgcacagtgagcatgtggttctgtttgactccatctgatttccaccttagcaccattgagcacgttgtacctttcggggatagcctggtttatgcagacactgcttgcagtacttttattttaacacacaagaagcaggtggagcagagttaagttttgaggggtaagacagacttaatttgctagaaccttggccctttctctcaagaacccagttgattttatatcctccaaatgaattgcccccaaaaaaccagttagagatctaaattactgaaacaggatggttttcttcttcctggctcaatgaatgagtgctaattttggaaatcccccgggtttattgtaaccatagagaatatgacacactgggaaagttgggaacaactccgtccattagccggatttcagctggcccagggccggctggagatgctgctgcttcagtgcagcttgtgggggtcagctctacgtttctgtgataaggctgctcagagccatgctttgtcttgcccattgctgcctattgaggaatattgaaaccagatcacagaactcattttcccttccctctgccagaaaatatatttgcttttcttgtggagacccatccagagacatttttccttatattcttttatatttgggaaaggctgaaaaggtacaggtagttacatttcttttttattataaggtaatataaaattgtagtccaaatgttttttaaatgaaagtaacccattacaagcatttcggtcatcattgctactctccaaagatccctgtgaatttgaaggcccactcttgggttcagaataaccttggtggtctccaggactaagtagccctatagtatgctggccttccctaggacagcatgggtggtggcaggtggaattagagaccatggagtggtctggagcaacttcggcttcatggaaggaagaatggagtgtttgtcttgccaactccaaataaccatgcactaggatgtccccaaagcagtatttagacaccccagaatcttagagttttggatatctagaactttgtggcctttggtcttacatgaagcttcagctaaaggatgccctggtataaagcaaacttagtatgaatttaagccacaaaatagcacatctagtgcctttctctctgtatcatttggttagaacaaaagataaaggaaacaaactaatagttttatcacttcgaatgactactcaaatataaaaaaacagaattagtattttttttttgtaagggaagatcctctttaacacggcataatttgaaaattaaaatgcttggtttagtaatttttaagttagtttgtagtattgcatcagaaaacaagtcataaatgcattttatttttttgagacggaatcttgctctgttgcctaggctagagtgcagtggtagaatcacgactcactatagcctcgacctcctgaggctcaagtgatcctcctgcctcagcctcctgatgagtagctgggactacaggcatgtgccactatgctcagttaatttgtgtgtgtgtgtgtgtgtgtgtgtgtgtgtgtgtgtttatagagacacggttttgccatgttgcccagactggtcttactcctaggttcaagtgatcctcccacttcagcctcccaaagtgctgggattacaggcgtgagccactgtgcccagcccataaatgcatttattaataatatttttgaaagtgcttagcataatgtttgggatatatagttaggtttcttaggcttttaataaatacgtttttttaagttttctctaactgaaggttttgtttcatccagatagcatatagtatggtttgtgcatagcactgcaaaaaaaatcttattagtcttttaaaaatcgtttagtttcatttttgctttctattatatccactgactaaacgctctctaggaatctcatgctatataaaacacaccttaaagcagagagacagaattctctggtatttcttcaaaccactacataaattaattggtcaaattgagtacaaagcctcattcacccaatactttccatataaatattttgttttaccctttacttgagtttagatatgactagagacctggcctagtaaaattaaatattttttcatttattctactcttttaaacagttctgaggatattaatatttctttcttttttaagaatcagactcattcactaagaccttatcaaacctatttatcagtattttccccaaagaaattaaaccttcagtgttgtgaattctatcgtccctgtgtagttctgatttggttatttttcttcgctccctgagacacctccttggctccaactctccacgtaactattgttattggaagccgtagtctattttcatttcttttcacactcatacatattcactcaaccctgaggctgactcagaaagagtttgggtcactctttttttccagccatttgttggcctgctgatcgttcattcagttggcaaacctggagcgtgtaccttgtgccacactttctgctcactcaaggcctcagagatgaataagggagcttggagtctaatccacttagccactgcttaggtgtacagtttcttgtatggcacatggcacagtctgtcatggtttgagtgttaagaagaagaatcaagcagtggttgcacagatgtcttgttccctctttctcggtgatagtgatgcctcttggggccccatttcacagagtggctatctggtcattctgacctcatccgaagtgtttatctctatcagatgatctgtcctcagatctcactgctgcatattctggtgccttacctaagtctttatcaccaagagaaaagcttccatatcggacccaacccagcctttagatgctgctctgacaatagcaaaaagggcacaaggagtgagatcgcatgggcagaagtctgggggaggaatgccatctcggtcgaagagggagctcatgggaggttaaaggcatgaggattgagtggaagaagacataacttctttgggaggccaaggagggtggatctcttgagcccaagaagacataacttctttgggaggccaaggagggtggatctcttgagcccaagaagacataacttctttgggaggccaaggagggaggatctcttgagcccaggagtttgagaccagcctggccaacatgctgaaaccctgacactactaaaaaaaaaaatacatatatataaatacataaaaattagctgggcgtagtggtgcatgcctgtaatcccagctactcagaaggctgaggcagaagaatggcttgaaccagggaggcagaggttggagtgagctgagattgcaccactgcactccagcctgggtgacagagcaagactctgtctcaaaaaaaaaaaaaaaaaggcataacttcctcagaagtctcaaatctgtgggccccagactgtatttatcacacaagtatgttttgtttgtgctacacagaattttttttaacttaattgtcaatgctttaaaaattagggaatttcacataaaacccaggtttccaatttctttggaaaaatcaggtatttggtaggatatgtcaaatgtgactgttacaggtttgtggtctaagtgactggaatgatagagttgccatttcctgaaataggaaagaacatgggggaagcaagttcgtaggggtagggattggtcagaaatgaacggaatgtattaggttttagatgtatgaagtctgaggtgcatattagcatcctagtgaaagtatgaaatagctaagtagagataaaagtcaggagctccagagagaagtctggaacatatgagagttgtcagcatataaatgatacttatagtcacgagacaagatgatgtagccaagggagtgattatcagtagaagagtcctgaggattgacccaatggcaggaagataatagggacaagagaatagaagaataggaacaagagacagcaaggcaagtgggaactcagggaagtgtggtattgcagaagccgagcaaggaaaatgtttcaaggaggaaggagtgatctgtgtctgtgtcagatgctcacagatatgaggtcagatacaagacaactgagaattggcactggatgtggaatgtggaggttcctggtgactttggcaagaggacgtctggtggagtggtgggggagaaagcctgacaagtgggtccaggagactgaaggaggagaattggaggcagtgaatgtagacagctcttctgaggcatctgctctaatggggtggcagctggatgggaatgtaggttcgagagagggcggtggtgattgttgtgtaaagatagatgtcaccacagcatgtttttgtattgataggaatgatgttgggggtggggacaatgcagaaaactgtggggagatgctggagtgatgtccttggataggtgaaaggggatggcacctagaacacaagtggagagactggcttcagataagagccaggacaggccgggcgcagtggctcacgcctgtaatcccagcactttgagaggccgcggcaggcagatcacgaggtcaggagatcgagaccgtcctggctaacagtgaaaccccgtctctactaaaaatacaaaaaaattagctgggtgtggtggcgggcgcctgttgtcccagctactcaggaggctgaggcaggagaatggcgtgaacccaggaggtggagcttgcagtgagccgagatcgtgccactgctctccagcctgggtgacagagcaagactccgtctcaaaaaaaaaaaaaaaacaaaaaagaaaaaaaaaaaagagccaggacagtttatccttggtaacatgaaggaaggcaaagtgtatgggcacagatgcttgtaggcaggtgttatgttttggctgaatgaatgaatgagcaatcagccaatagaggctaagaatgacatgctgcctccaggagagtctccctagtggcctggtgttgtaagtccttccctgacctggtctgtgaagagaggccagcctagaagataatgttgttgactaggtcctagtgtaggttattaaagtctgggttcgagtgctgacattgttctgatttccagggtattattgggaggattagtttgcaaggcaaagaaattgggtgggtgtctggtcagttgtttgctgggggtagcagctatcttctagtgatgggatatgcaccctttgtgttcctcaggccccacctcagcaagtccattcctcctctccatgatcaggcccactccttggttacttgggtttgtgactcctaacttagattgtgagtgcgtgagagaggagaggtgtgcagttggttgtgggagaagggcttgtgtgtggctctgcccatgtgggcaagtgagtctgagaaggtgcatgagtgagtcgcaatataatagagaacatgagccacagaagtgggcaagaggatgcttgacattgctgccacgattcccagagaagtgtcgcacaagcagtgccgtctttctcggtatctgactgaacaatgcacgtaaagagcttagtgaggactaaaattgctcctgtgtgtgctgtcataaaccagttccttttctgttctaaacagttctgtagtctcatccacatgttactggctgtttctcaactactaaactagtcatgaaaattctatctgatcttttggtaacatcaggtcacagggataattttaacggctcacataagcagtattattgctggcttgtgttcaaactatgtcttgtgatctggacgacccttttgagattctatcaagttaaaattagaacatttattttaagagatgtatgcaagctgagacaaatccccattactgggtcagaatgaatggctctcagtaatgtagagacaattgtgacatgtacccaaccttttttttttttttaattcctggctagtagtttagtggtaagtcagggagtgagtcagtgaatcttatggttatccttactctgggttgaggtcagttcaacgctatcttctgacatcaacatttccccttcttattcattggtgaagtattttgcttttatttatttatttcttttatttagggtttttttttttttttttttttttttttttggagacacagtctcgctctgtcacccatgctggagtgcagtggtgtgatcttggctcactgcaacctccgcctcctcccaggttcggttcaagtaattctcctgcatcagcctcccaagtagctgggactacaggcacacaccgccatgcccagctagtttttttttttttttgtattttagtagagacagggtttcactgtgttgcccacgctggtctcgcactcctgaactcaggcaattctcccgcctcggcctcccaaagtgctaggattacaggtgtgagccaccacgcccagcctctattttgtttttagccatgcaatgtaaattctgactaataactgctggttgcatttggtgggagagagaaaacactagaaaaatattctgggttagccttttaagtgttcccctaaatttgcatttaggttaacttaagaagtagtttctccttttacttatgacgtttgcccttacttcattttggtatggtaattctcgattttcataaatgactaaagggtaaattgattatgatagaaaatgatcttttaaagacatttctcagagaacgtaattgagacataaaaataattacttgaaattaatatctagattgaaactctagatatgaaaacagactagtgttcaagacctgttgctcattctttttgtgtatgatgtgtcttatgaaagcttatagagcaagcccttcaggttcctttgctgtgtaaataactgtttagttgtacagttagagcataatgggagttaaaaggactcctgaaccttcatataaggtggccattgttcggtccaggcagagatccctcatatcaagccaagtgctgccctagatgagttctaggaacattcttgtgatatgactgccttacacaaagttgcaaaatctggcttcacttctctctcaccctcctatccaagccccatttttcccccacttaacagctgccttatttctcacttttctgccctcttcccacccccaaagggctcttgggctggtctaaaccttccgtgttcagtgacttatccaggcctgctcttctcataaaaagctggtcctctaaaacctctgaccattcactaccactatccatttccatagatagtaggtgtgtaacagtttgattaaagtagtgtcaggccgggcacgtaatgtcaggcccacacctgtaatcccagcactttgggaggcagaggcaggtggatcgcttgaatagcctgggcaacatggtgaaacctcgtctctacaaaaaataaaaataaaataaaaatacgaaaactagccagtcatagtggcctgtgcctgtagtcccagctacttgggaggctgaggtgggagaattgcttgcacttcagaggttgaagtgcagtgagctgagattgtaccactagactccagcctgagtgagagagtgagacactgtcttaaaaaaaaaaaaaaaaaaagagaaagtaatgtcaatacctaatgcatctaaaagcatttccattccttactggacagaaacagggctgagcatacctatgatatctgaatcctttgcgtgatttctgtatgccccagaatctttcttacctcctcgctcatgcttctctgtgccttcacacttctgagtctgtttcaagtttgccactcagtaaactggccccaactaatttgtaaagaaacctacttacatcctaacactttgtgatttgtttcattgcaatgtgggtagctgttgggaggctacatcactgtgcagtactgccctccacagtcctgctcacctctcccatctctccccactcaccccctgtcttgctggcacccaagggatttcttgccttagggcagaaaaagcagtctcacccacatttaggaccccttaagatcccagtttctactttaaacagccttaccaagggatttcttaaaatgaaaactgccctgtctatgaaaggactatccagtggatacagttttttcactttgttagggtagaataggtaaagaaggtaatttgaggaaggaggatccttcccctgactacagggagtaacagatttagaattaaagagatactcagggattcatgaaggtagagatcagtgcctgagtcacagtgaaatgcagggtgtggattgtttccaaatggtgttcttgttgacattcaagaggaaggccacaggccatatggagaggtatttaaccggcatggagctggtatccaggagggctgcagaatcctcttgaaccagtcgtgtggcggtccagagccatgctgggatacggacagagccagaggctcaggtgtatattcttgcctgcagcagagggcagtctgtgtgcaggtggattggaccattgtgcccttcctctgcatgagctctgacacccaaatccagagacaggagctggggaggcccttagacaatgtccagcacagtctacttgtgggtcacctgctgatcttaagcaccacccatttcttgttgttattccattttttccttaacctctgttgcaaactgcatccttctgaaaagtctttcttcagtcttcttgaatgctaagttgcttacttcataatatgctttcctattggttactttctgttgctgggaccttaactatacttgggggattgccaggattcttaggcatacctttttcactttcaaattaattgtccataggcaggagttaatccataaattaacaaacgtcactctcagacaatacccttataattctgggaatgtcttacaatagcagcctagtcatggctaagagccttggctctgcagccagactgcctggatggaatcccagccttgtcactcaccagccatgggatcctggagaagttatttaacttcttcatgccttggtttcctcacattgtcattttggagattaactgagtaaaccaagcaaacactaaccaatgcctgcgacatatgaatactttatattcttattatgagctcttattattactactgcttagtcattagtaaactgtcaagagagcaggttagaaaagaatagtttacactatattcatgttttaacttattttaattagtattactatcatgttatgactatgtatgacatttatattaagtctaggcaaatcatgggcggaagcttagcagttaaaacaagaggatcaaacagtttaatacaagaggatctaagtaggtgctgtggctccaggccgggaagttgagtcaggaggggtgggcgtccgaggaggtggaaggaatatctcattcttatgtactctgtttcggttttaggcttatgggtttgtattgctaggatggggcagtgccttccctccactctgcaacacaggtgtcagatctctgtggtgggttcccccatcctcattagaacatttgttgaaggcagtcatctgactctttcccatgcattgtccctgcccccacttcctgcacaaaaccacctctgaaaatcccacctgcattcattactttggaatttcagtagcccttaatgtcagtactgccctgatagccccaacttgtcaccttgcttatttttatgcagatgacccatcttactgtttgaacaaaagccttttggggccacacactgagcatagtgccatatgcataatagttgttatttaatcgatagctttatctgtgcacaaatttgggcattatgatttttatccttttaaggattaaatagagcaagagtgttgtgtgtgttacatatacttacgtgtataaaataaagagtaagcttggggatatcaaatatcctcttcatttatcagaagaaacaaaccgtggaatgatcaattaaccttaagaggaaagagctttacaaataggctgtatttttcttgcatgctttttggagcagcagcagcatggtaggatggtaagtgctcatgccttagaggtaaaaccatgtcaaaccccatctctgccacttagttgtgtgaccttgggcatctcacttcagtctctcacagcctcaattatcacattagtaaaatttaccttgtagaaatattattattccccatcatgtccttaaagaatttggtctccaaatatagtaaactctgatgatagctttttaaccagttcctaactttttttttttttaataaactttaggggataggaaaggttacacgagtttgtattattttgaacggtatatcatgctcaaatatcttggttgcctgtaatataaatctactgaaatctaacacttgagcccagtacctgaggttctgtcccattttacttttctttccctactcaaagcctcctctctggctctaacagaggatacctggtctagcacacaggtgctcacctgatacctgccattgcctgtctggaattccctacattatcatcagctacccagatcacatctgctgtataagcttgaagtcacatcccactatcttagcacctctgctcccattgaagctggatagtgcccttcctgctgtgaattcctgagcacccactgttcctatttttgctttgacacttgttacattcacgtttggtttttgtttttatatacatagatttcctgccagctagaacaggactacgctttactcctacttttttaaagatattctttattgtgaaatggagcatatgtacaaaagaatacatattttaaaatgtgcattgtttaaaaataccacccaagttaagacatagaacacaaccagtgccttagaacctctttttgtcccttcccaatcatagcttcgcctttcccccagaggtaaccagcatcatgaaatttatattgattatagttttctgatctttaaacagtaccttttttcttgttttgccttttttttttttttttttgagatggagtctcactgtcaccaggctggagtgcagtggcgcaatctcggctcactgcaacctccgactcccgggttcaagggattctcctgcctcagcctcctgagtagctgtgattacaggcacgtgccaccatacccagctaatttttgtattattagtagagacagggtttcaccatgttggccaggatggtctccatctcctgacctcgtgatttgcctgcctcagcctcgcaaagtgctgggatgacaggtgtaagccaccgtacccggcctgttttgactttatgtaagtggaatcatatatatgtaattgtttgacccgttgcctttttcaacagaaatgttttaaaaattcatctttttgctgcatgatgtgtatagctatagttcattcattttagattgtattccatgctgtgaatatagcagaacttttcctttaaaaaagatggctatataactataaaatctcagtcatattcaacaataagcaaatatttcttacatatatgttggtgggttggctaggacagctctgatgatctcagcagggtttggagctaggctacaggtttggtccagatctgttccatgtttcttttttctggaaacagcaagcacccagggcatattctgctggcagaagttgtaacttctcagagggtgaacagaaataagcaatgcttctgtaaggcacaatgtcacttctgctcatattgcattagtcaagtcaagccaagccataggacatgtccaacatcaggtgggaaagtgtcctccccctgaggaggctgggagtaatgtatacttgctgagcagaaatctaatacagacatttgggttgtttccagtttttgactatttcaaatagtgctggtgctgctgtgaacattttgattatatctcttgttgcacatacacaagcatttctttagggtatatgcttaggagctgagctgctggattgtacagcatgagcatttttaactttactaggtaataccaaatactttccaagtggtgtgcctgttctgtccacaatggattggtgcttcagtgttgcactgaaccgatgctacatttacattttttgtatgtatttaacacacaactgaataagtacttttaaaagtatctgtctcacaatgtcacagtgaactcagtttgattttgaacccttactgcaggatggaaagtacactgttaaagccacagaatagggaggccaaggcaggagaaatcacttcagggccgggagttcaagaccaggctggacaacatagcaagaccctggctctacaaaaaaatattaaacattagctaggcatggtggcctgtgctactcaggaggctaagggtgggaagttagaggctgtagtgaactgtcatgctactgcactccagcctgggtgacagagtgagacactgtctcttaagaaagaaagctatagaaaagtgctactaagtgctgcttatctttttgtcagtactcagaatccactaactgtttcaacttgcgttcacttggcaggtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggtaggttctgtttcttttcttcagatcatttaatgctgctttttaaaaaaattgttgtatcaatagagatgtggaatatttagcagcattttaaacaaagagataaataaaattttgtggaaagaaaacaataaccatcttaggagaaacattaccagcaagaagtagcagaaataaactgtgtggcagatttctttggatctgagaacacagttatttagaattttctgtatatacccatatattttaactttagaattcttagcccattctcctctgaaaagattttgagattattcctaaagtagtggtctataaaaacaacaccccattgaatgttttaggaactgcaaacatttagatgtatctactttatatttgccatctgcttagaagaatgtgttttcagtgaaaatgacaatatgaacatacagtaaatacttctataggattgtttttatttcctatgtttgtactcctatgattactataggatcttgaaaaagaaatatctttgtaggaggcagatgacatgttaacatttataacaaccctctttagcatcttttctgactttaaaggtcttctctgaggtttgttcttatgaaagaattggaagaggatgaggaacgaaactgttacatattcagatataaataagagaacagaatggtggtgaattataatcagataatcagctaatcacctggctgtgagattgtaatattataagagattattctctttcctgtggtatagattttagcctgaaatttcacttactagcatttactaagatatagaaaggagaaagggagaaaaactaacacttgcattcttactctgagttctttatatggatcatgacataatatttgtacagcagtggtccccaacctttttggcactagacactggttttgtggaagacagtttttccatggaccagtatgggggatggtttcaggataaaactgttccacctcagatcatcaggcattagattttcataaggagcacacaacctagatccgttgcatgcacagtttacaatagagttcacgcttctatgagaatctaaccacctctgatctgacaagaggcagagctcaggtggtaattcttactcgcctgccactcaccttgtgctgtgcggcctggttcctaacaggccatggactactgctggtccgtggcctgggggttggggacccctgtcatacagtacttgaaaccacctggcacatagtaaatgcttaatgaaagttagctattcttatttaacccttaaaaccactatattaagtactattagtaagtattgttaagtatattaagtattatatctccttttataggtaaattaactgaggcttaaagaagttatataacttgtcttagttatgtaatagactagtcaagcagcagaatgggcctcaaacgcaggtctgaagagacttatccttatgaaaatttgagatggactatgcttaaaagtagccatctacagcccagaattaagaaagtaccttttatggcaggtgaagggagagttacactttaaatgctaaactattttaagttatgtccagtatacttggcttgacctcaggggcctctcttttagggtgtaaattcacagcccccatattgtgaacagagaggactctggaaatgcctctgtatcattactgttgccaagtgcaaggcaaaggcaggactaatccaatggaaggacttccttatgttgcctcagctataatgcagtcctatacccaaacatcttaaagttccactgtatttaaatacatacctatatgcttacgtatatacgtaattatgaaccaaggaaaggtgaagatgggaattgaaagttgttcaaaactaagcaaattaacagaagctacaagaacagatgctacttggtaatccaaatgaaagcttgaacaagcagagaagtttggtacctagtctcaaaccagtttaactttccttcttataatgtgataactgagtatgtgttgcggctctctagttagattctttctgaaatgtagcctgttgggtatcattttgtttaagttctcaacctttcagagcccacacagattgagaatttatcttgagacttgtgttcccttgcccatccatcttacactttctaatgaactgtttgcagctttcagacttggtctatacactggctttctcttgtggcttctgtagaaaggtatgcagaacttaaagattaaccctaattactttgttctcccaatgttttcactgagtcaagaagtcttcattttgttaggaaaaaatcatataatctatatttttgtgtcttttttgtttgtttcatgtaatacttttcagtttttgctactttgcatgatgattcatcctggcttttctgtcttcaatttattgcattctttaaaacagtttgattttcagctctcatagagtcaattatgctttcctttctaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgtatcttggttgtttaattaaattaaggaatttcaccatacacccttgaacaaatctattagggaatttttcacaatttttggaatttgtcatagttttaaaaaagtgtaaagcttgacattgggatatatgctttaaaaactggtatctatgatttcaatctaattgtttttctgtgatggtgatggatctgacagatcagaacaaaccgagatcaaacttacatagtgtcatccacactgcacctctctattaagtgggtatttagctatttagaatattttaaccttaaagtcattcctaactgtcagaatcaatactgggtccagtccctactagtattttatctatgatttaaaatgatagaatggaaaagcgtatttattaaatttatagatcattctaggttgtaagagatggcaagctaaagaagggtaggatccaagatgaccttttaaaactaaaatgagtggtcagaaatgattctatggaagaaaacaggacagttaaccatgacaggaagaaactttagaggtttgattgggcaaaagctgcaaagcttttgtgacttagccttcaaagtcaccctccttattcatattgatgtgaattaatatacaagcatatagacagcttaagtcaagaatggttggggccaccttgaaggctgttaccataggagctcaataagaacctgaggatttacctagaattataaaatattaaatgataaatgacttctgaaactagctatttggactggtgaagaatgagtcgctattgatcttcaagtacaatgaagcatttaccaaagatttatttaagtgcctccatgtgtcagatgctgtggtacaaagaaggacttctcaaaattttagctagtcagaggtctttctggcttccgagtccctggttaagatgaacagaaacacagtcttcagatataaaatgtcttatttttgtggccattcagttgcattcaacgttaattttttctatttactaccgttcattctctattttttacacagtagcataacaaagctctaaggtggaaaagctgacatagttttaaatttttttttttttttttttttttcttgaggcagagtcttgctctgtcagtcagtcaccaggctggagtgcagtggtgcagtctcggctcactgcaacctctgcctcctggattcaagagattctcctacctcagcctcctgagtagctgggactacaggcacgcaccaccacgcccagctaaattttgtatttttagtagagacaggtttcaccatgttgccaggatggtctcaatctcttgacctcgtgatccaccggccttggcctcccaaagtgctgggattacaggcgtgagccactgcacccagcaaatttttaaatttcaaataagtagtgaaggctattattaacttttggaatcagaaagaatgacaagcttaccataagacatagcatataatgctgtcaagttatttggctagaaaatcactgaactaaacattcttttccttctatgatctatgtcttaaggtgaagtattaactaacttttccatgtaaagctatacaaatattggaaaatcttttctagggagtccagaatactaagggttacttagtaaaatgtataaaaaggcaacagtaattcaaattacaagatttatatttgcagaggtgatccatatatacttatccccttgcagtggc

SEQ ID NO: 13265 - DNA, 35282 bp, Human
  misc_feature (1)...(35282): n = A,T,C or G
ttcaatgggcatttataatttttagaatcagaaaataaaactctaaaaagcaaagctataacattaaaaaaaattattgaagtagtccacatgaaaacaaatacagagacatattttatccctaaaggtcacggccaccactttaatctaccacatgatctattttgataccggttctgcaggctggcagtggcccactggaagtctctgttgacagcacatgaacattttatcaactgtctagagagcatggacgtgttttttagcacctaccacgaagtccctaacatatcctgtctcactaagcctcacagccacttgttagagtcacattagcattcccattttacaaatgaggaaaccaaggcccagaataactaggcagcctgctcaaggggatgtagctagcgtgtgggagccacattgaagtgatgtctgtcgaaacccaaagtcaaggtctttctttttcactgttccctggtcaaaagtatctttagtcaaaagcaatggagcaagcatttgctttgggagttctcagtgctggtgagcttgcccagtgtcaagaacatgaaggcatttgtaaaaccctcctcttccttacctgcaaggctggagccggaaaatccatttggggaaataaaaaaaagtcccgagttctaccacacacccatcagatagagaagaatggaattactgctgctgtatatataacaggggcgtgtctccaaccacactattttgatagtacataagcgtgactctgagaagttttatctacagtcagctatacgtttgtcaatgtgaagaggtggttttcaaaaaggaaattctaataagttaactgattagataaattcacttactcttttaggttacctatgattctaggtaaaggtgttattctcccataattaaccaagttgtgttcaagactaaacatccctccagagatggttgtgaatggtctataggtggctttcattaattcaactctcaaaaggcattatttggcaattacagcatccaggctctgaagacagtgtccaattaataaacattacagcattgatattttcttgctgtcaggtagttctcaagttgccttagaaataggggtcacctctgaggacagagagaagagaagggcaaagagttagggcagtgctttaggtctttagtgtttatttctttacccagagaagtacaggaaaaatataacaaaaatgttatcattgtaaaatctaaatggtgaacatttcaatgttcgccatagtacttacagcatttttagtacatttatattttgtaatttaaatttttggggttttttttgcctcccaagtagctgggattaaggcacctgccgccacgcccggctaatttttgtattttttagtagagacagggtttcaccacgttggccaggctggtcttgaactcctgacctcagatgatccacccgccgcggcctcccaaactgctgggattacaggcgtgagccaccgtgcccagtcaatttaaatgtttttaatttcacaacttacattctagcttcaaaaatatattttacattattacgaaccactcaccaagattttatggccagatacccaaattcatctcagtctccaagtgcaaattttaaaactaatttcttccatcattcaattcaagcagaatggtagagtagtattttagaacagatagaactagtaaatcccagctctgtgaacatactttctctgttaccttggccaagttatttgctaaaggcatttgcttcccatcctgtatctgtaaaatgggtatttcctattgcaaaaggtagataagtagcatgtgcttggtgggttagtgtttttccctctccagctggaaaaaaaaaacctggtgtgggggaagaaggggaacagtttgtgcaacagaaccctaagaggaaatcagctgctcatcaagataagggctgaggcataaaactgccagagggtctcaaggcaggcaaagaagaaccatgaggctcatcctgcctgtgggtttgattgctaccactcttgcaattgctcctgtccgctttgacaggtaaatcttacttcctgtgttccagtctctgtgtagaagagaattaaaggttgtttccttacagttcactttttttttttcatttgcctccacaaagggagaaggtgttccgcgtgaagccccaggatgaaaaacaagcagacatcataaaggacttggccaaaaccaatgaggtaagcatttagagggatattttatcttttcttactgttctctaaaagatgcttcttcttattttactgtcaatgcccatgggactacaaaagactattgaacataaggggaaagcaggagctatctggataattcagccaatggccaatacttcacctgttctggttttggtcttggtttccaagactaccacttctgtttttcctcccaaaagcttttcaaacaccagctttttcaaggtaaaactatgaaatcaggagctgttcttggcctccttatcagggcatctttctcttgcctacgggtgccattccctctccattctccccactccgaccctcatctcctctggtgccataatttctcttgagtactaactgaaaacgttgaggcactggctaatatcaagatgtgaccctttccaagagcaggtacattttcaaataagacttttaaagttagatcaatcctttaaaatccaacagcctaatataattttatcatgtattcagctgctcctatttatgttgcaccagccaccttatatatgccatttcaaattctccagcagattctcaatgtcagggttataatgtaactcatttgaaacagaagagctaaagtgcaaagacaataaattaaatgaccaagattacacatcaaatttaaacccagaactgggtctgggatttattccagtcaaacatacagttacctctacatcaaatcaatcaaaggccctgcctattctaactcccaaatgtttctcaaatccacacattgccctccattccactgccactgccaagttcatgttcactctacctcttgcaaggagaatttccatagtcccttaactagcaatcagggctctagtcttgactcccacaaagccaactctgcattgcaacctgattgctcactctaaaacttgacaattgcattcctccgtttgagggtcattactaagaagcagcctagtacggaaaaagcattttcttcaaagtcaaacgcttacattcaaatccaagctctacgctagctctgtagccttaggcaacttactcaacatctctgggtctcaatttcttctgctataaaatggggataatagtcatagctacttcctagggttgctacaaagactaagtaagcgtttgatagcacttagaagcaggcctgccatattaagcaccatagaagcgttttttgtttgttattgtttttgttttgagacagagtctcactctgtcacccaggctggagtgcagtggcacaatctctgcagcctccgactcccaggttcaagcgattcacctgcctcagcctccctattagctgggattacaggtgcccaccaccatccccggctaatttttgtgtttttagtgaagacggggttttgccatgttgcccagctggtctcaaactcctgacctcaagtgatccacccgcctcagcctcccaaaatgctgggattacaggcatgagccaccatgcccagtcagaagcattttcttttggtattggtatagcattcaaagcgttttatgatctgccaaactaccagcctcttcaatatcctgctcctccaccttcttccacacccttcaagccccataaacaccaaaatctcacccaccttggccctgtacatcttttctcatgaaaatgtgtttctctcccttttgacctgggtaagtcctacttatttctcaagatccaactcaggcagtgtctcctgcaggacgtctcttctgttcatcaactctcgtgactcagttttggctgctccttgtgctcctggaatacccggttccttcctctggcattggttaacatgtgggaaacatgcatgtatgactctgtgttccacaccaaacctttcacatctcataagtcccttattagtctctacaactgtggcacccagctctttgcctcctgcttaatacatgaaagttcactaagctctaagctcctgctgcacattaccctgctagaacacagaaatgtctattgtgataagatggctctgcctaacttgcctttgcatcacactacatctctcatatgtccaactcatgatgtagctttttgatcaaaataaacattggttggttcatagcagcctcatattgtcacttgattgacctcgaggtagagggggactcaaccaagaaacagccaggcagacctgaacacatacacaagcaggggtggaaattgagcttttccttcacatttcccaggctggggacttgtacttcatttagtttcacaattgagtatgattttgaagaaccacaagaactggaatcttttcaatgtttgcttttgtttttgttttttgtgttttttctgagacagagttttgctcttgttgcccaggctggagtgcaatagcgagatctcggctcactgcaacctccacctcccaggttcaagcaattctcctgcatcagcctcccgagtagctgagattacaggcatgtgccaccatgcctggctaattctctatttttaatagaagtggggtttctccatgttggtcaggctggtctcgaactcccgacctcaggtgatccgcacctcagccttccaaagtgctgggattacagtcgtgagccacaacacccagcctcgaaattattttgatctgaatgctatacttctgagctcatataccaaatttttgaaattgtcagctagaggaagagaaaggaaaaaaaaaatctgcacctgttaactgtcttcatgccccagacctcagacctatttcacaatcttcacaacacttcccagtggaccctcatttgccccattatttcaggagagaggagtaaaatttaaagagtcctagtaacttgcccaaggacatattgctagaaaaatgactttgctgggggtctatgccaactgtttgatacaatatcttgtatcaggatttccagagtttatagggacatcaggttttgaggactaactaaccagatatttaacttaaatttccaattagaggcagattctgtggctagatgaattgtgatcccattcaatcccaaaattgtggaagaaaaaaattaaccaaaagatctgcccatcctttttaacttgatagacctgaagtccttaaaaaaaaaaaaagtgatcaggcactaggaaggtttctttcctcctccctaatattcaacagttcttaaatatatttgcaaaaatcccataaacttattaaaagaagggtctgtatcttagttatgctgagccccaaattcctttcatggtgtatgagacatgatcatttcttaatcaataagtgttgggtaagcaaataaactctgactaacattgagcttatctctgcagcttgacttctggtatccaggtgccacccaccacgtagctgctaatatgatggtggatttccgagttagtgagaaggaatcccaagccatccagtctgccttggatcaaaataaaatgcactatgagtaagtccttggcaaatattgaaatttgttggatattcaaagttttgggagccttgaagtagaggaaagtattacaatggacctatttttaattgggccccccagaacgaaagctctttctgtaagatacagatcacagttacttccaaacacattatcgaagcctgtttacagaggtgatagaatcaaacttggcagttcaacatctaccttacatttgctcttagctataagaataacaattacctatatctaccatctccaaaaccagcccctcataagcacagagcccacatgagcaggcatgaatggtttagccacatgtcatcactactgacaggtaatcggcccagatctcatgagctactggcgctggcctccttttatatatttgaattttcctgatacataaaaggagaccaaaaaaaaaagtcattggtatgtcagaaatacagcaattggtatgtcattggtatgtcagaagtacagcaattaaaaatatacaataaataattctttatgaaaaaaattcttcctcagagaaagcacaagcagagcagtagaatacagtttaaatcaaagagaaaagaatctcaaatagccaaagatgcagaaatgagtcattctggccccacagagaagtaagagaaaatctgaatatactgagcagcaaccatgggccatgcccagtctgggccctgggcagtgaatgagaaggaagcccagcaatgaatatcataaatcaatgtgtaatttagaaaataaaatgtgttggccatgcgcagtggctcacgcctgtaatcccagcactttgggaggccaaggcaggtggctcatgaggtcaggagttagagaccagcctggccaatatggtgacaacccatctctactaaaaatacaaaaattacctgggcgtggtggcgtgtgcctgtagtcccagctactcgggaggctgaggcagaagactcacttgaacctgggaggcagaggttgcagtgagccgagatcgcgccactgcactccagcatgggtgacagagcaagactccatctcaaaaaaaaaaaaaaaaaaaaaaagaaaatgtgtttttatactttcaaacatttcatagtttgatgtacagagggatcccattttaacttccccaggccatgttatgccaggattcccctttgttgagaccctcattgtcaaaacactgctaaacactagttcattttttttttttgaacttgccattttatacctccattacctgacttggtactttaactcaaaaggtctgcttctggctgagataaagaaagagcctgttgatgtcagtgatgttatattgcagagcaggatttactactgctcaccataaacttgattttatttatgatattgccacaatatctcaaataaactccattgaaatttaaaaatcacgtacataagtgagcaaaaaacattcttattcacggctttaaagataacattctattatttgtgatggttattgatgactttttcggttttgttactgtttcaagaaggttgtgacagaaatgtaaaagttaacaaattgaaaatatataattcacgctgtgcacatgtaccctagaacttaaagtataaaaatatatatttataaaaaaaactaattgataccagcttttaacccttttaacttaatacactaagtttttctgtttttataaatcacatcattaaaattagacacttcaaaaatgtaactacaagactgcagaaatttgtattacattatctgtttacattaaggttcagataatgtattgactctttcatctaaaagaaatcaaccctctatcttaaataacccctggttactgtgtctcttgttttgttttttgagatgaagtctcgctctgtcacccagactggagtgcagtggcgcaatctgggttcactgcaagctccgcctcccgggttcacgccattctcctgcttcagcctcccgagtagcttatactacaggcacctgccaccatgcctggctttttttttgtattttttagtaaagacggggtttcaccatgttagccaggatagtccttgatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcacacagaaacagggaataactagaggctatcaccagatgttccattttcctcccagtgaataaatgagtagtattcctcaaactttgagaaatccatgtcagtaagtgtagaatttgatgtgtggtaaccaaattagggagttaccagggggatattgaatcttagggaaacctgaaaccacgctttttgaatagcaccatatcctgatgtaatgtgggcatcaggagaatccagtcccatttataagtcaccctgacagtgactctgccttcctgaaacatctttccccagtgcatgcaggggggcacacgcgcacacacacacacacacacacaccccagagcctacgatagtcacatatattggcccatagttctccagtcctttgttgctttctaaaagcagcaaaggatgggagccttgaaactgtcaaagtagaatttatctcatctcttctctgaacctcttacttgctccctgaccttgggacacagacttccatgagagttggttgattgggccaactgtgcaccaacctccgaagactaaggagagtgcagatctgacggcaatacccaaggatttcactctcatgatgaaggcactattgtacaatggctcacagctacggtgctgatgtcagaccctccaggttcaaattccaacttctgtattttaacagttgtgtccattttggaaactggccaaaccttcataaaaacaagagctgataatggtacccagttaatcatgttgagtgataaaatgtaaatacagtgctgagaaaagtgcctggcacataagaaaggttcagtaaacattaaacatttgtattattcaatactcagtgataattatttatcctttcacctatatttaggaattttcttaaacaaattaagcaaattttggagctcaaaataatatttgagaaaaagtaatttggtttcatttgtttatgcctggctgctggttagtagaagggcttgtgaaaataacatctggccccagttcttaatttccagccttaggcttaatttctagtccctatcagcaacaatctggcaccgttctgatgttctcatgcagctacatcatttgtggaaaggttgtacttcaactcacactgttttttttgctttgttttgtttggttttgttttgctgctgttatcataagagctaaattgatatgtgtaagtctaaaaatattcttagatacaagcttcctgtgactaattaatactgccttatgttacaaatcaacctctgggaccataaaatttctcttctgcctggtttctccacttctattaatgcaggtggagcaaaagccacgtgccctttttagagcttaaagcaattagttatgtctgtaatgaccacccaaaatataatttcaaaccttcccgggttttgtgtgagtttcagtgcaacatgctccacctgattccaaaattgctgtcacaagtttattttctcagaaatcctaggttcatcataagtcaaaagcaaagcatacagtgagttagatatgatgtacataatgatgtgcttgtcagtgctgctaataggaatcaatattcatgagcagtacttggtcccatgtgctaaataaactctaattaagggaatacagcgtttgtgttccacatcagaactcagatcagtcagtcaatcagcaaggagaaaccaacaagtagagtggagctcagcagtgtcagtgtcatagctcattattataagaaattgaagaaatcaaagagtcaaacatctacataccatcaaagcctgctttaaaaacatgttatgactgtaaaatggttgtcgattttatgacccaacttcactattattctgaagttcaatgggagcctgaggccaccaagcacttaggttttacttcatttcatcctcaccacaagcctggtcaccacaattgtaaaagttggaaaactgaggttcagagggtaactaagccacccaagatcacatgttcgtattatgtagctgaactggggttggaacccaagaaggtctgaacacaggtcactcactgcttccttatttgataagatttatagtgacggaaagagtacatgatattgtcccaaagactagagtgaatgttaaaaaatagacttcttcctgcacccaggactcactgctaacagcagaaaaaaaaatacatgtgcatttcattaccaaaaggtgagtaattcctttatttatatagagtcaatgagaaatgagataagccaaataagaaaattgttcagataagtacgacttcaagaaatcctttctttttaatatttttattgaaacatttccattataacgataattttctgccctacaaaatagagtatattgaatatggtttacctttgggtaaagaattatcattatcaatatgaattttcatactgtgctatgagaccactgacccatgttttctaagtccttctgtctagggagttttttaacttttctctttttttttctttttgctgtcagctatcacctactgataacagtgtgttcgctgcttgctttcagcaagtcattttccctagatccaatgcattccttctgggttaaacaagatttttagaacagtatctaaaataagacagacaagattttttgtgagggtatttgtaaatctcctacagctgtaaaataatatttaacaaaataaggaatctaataataggttttaatgcaaccatacatcaacggacaataatttgatcatataaattgatactgccatattaatctcaaagtggcattcaacatcattcttaacagtgaaagataagttttcctgtaaaaagcagaaaaaaagaatgccgtctatggctactattatttatcatagttcagagagttttccaatgcaaaacagcaaggaaaaaaagaaatagttattaagaaaattagaaagtatagatattggcagaagaaataacacagaaaataccctaaaaacataactaaaattcttaaaagtataaagatagttttttaatctaataaaatagctaagtgtaatcaaagtaaatggttttttaatatatgaatactgtaataaccaaaaatgtagtgagaaaaaaagtcaaaaaactggtaaaatatatatatataaatagatgatcaaaatacttaacattttactgaagaatcaaagatacaattatgttatgatccattattaataaaattcttatatttatttataatttaatgtctatcaaaaaatcccattttttctgatcattctaattcctaaaatgattctgataagacattttttttttttttgagacagagtctcctctgtcacccaggctggagtgcagtggcacaatctcagctcactgcaacctccacctcctgggttcaagcaatttttatgcctcagtcacccgagtagctgagactacaggtgcccactaccacacctggctaacttttgtatttttagtagagatggggtttcaccatgttgcccaggctggtctcaaacttctggcctcatgtgatccaactgcctcagcttcccaaagtgctgggattacaggtgtgaaccaccatgcccagccaagacatttatttaaaataggtgaaattactcaaaatttttggaaaaaaagaataagatacattatccagtattaaattttactgtaattaaatatgatttggtttctattaaggcataagaaaaaagattaatgaagcaaatagaaaattcccagacaaaataaataaaatacttgcatatatgatgatgacattttttaaaaataaatcttgaaatgaggcagtttgtattcaaattcccaactccatctcatacactgtgagtatttaaaccttctgagcactaacttccccatctgtaaagtgataatactgacaagattaattaaataatgtgtataaagcagtacctggcctgtattacacatatggatatctgaatccaagtgaaaacgtcatgtaggcagttggatgtgtaagcctagagttcagaggagagtcaagtataagtgaccatcaggtgaccattacagccactggactccataaaatgatgacatgagatggctcagaaagagatgaaaataggaagatgaggccgggagcaatggctcacgcctgtaatcccagcacttcaggaggctgaggtgggcagatcacctgaggtcaggagttcgaggccagcctgatcaacatggagaaaccctgtctctactcaaaatacaaaattagctggcgtagtggcacatgcctgtaattccagctgctcaggagaccaaagcaggagaatcacttgaacccgggaggtggaggttgtggtgagccgagatcacaccattgcactccagcctgggcaacaagagtgaaactccatctaaaaaaaaaagaaagaaagaaagaaaaaggaaataggaagataaggtgtaagccgtaagcctcttgaccctcaacattagtctcctagtgatttttcccacctcttatttcacccccttcaaatcatgttagccattttctagatccatcactataggcacgttgtttcaacactttgtacctcatttttctcatctgtacaataagcataataatctaatgtgaagattaaatgaattaataatgtacatatggaggtcagagcgatgcctggcacaaggtagtgctaagtacctgcttactattataattatcattattattcaagtttctcccagctcagaaggtgtgaaattataaggtatgatctgtagatgtgtgcatgaaagaatcccttgttgcctgtgtttatgtggatgtagatgtgtgtgtgttttggagaaggatggggagtactatagcagtacaatacgagccacatgcataattttaaaattgtggtaaccacattaaaaaagtaaaaagcaacaggtaaaattaactgtagcaatacattttatttagcccaatatatctgaaatttttattctacacaacataaaacttattagtgagatagtttatatcatttttatactatcttcaaaatctggtgtatattttacacatacagcaatctactcttggacaagccccacttcacatgtcctgtatgcacttggggctagagactatcacactggacagcacagctctagataaatggggagatcagaagccagacacatgatatgtctaaaggagatagctagaggagaataatgaagaaacagagcaaacttgattaaagataaaggagaaggaagagaaatttctgcaaatgaaagataactgtgttttcctttctcatgataaaacatgtattttatcattcccctgtcaaacagaatcttgattcatgatctacaagaagagattgagaaacagtttgatgttaaagaagatatcccaggcaggcacagctacgcaaaatacaataattgggaaaaggtacagtaaaaaatgcctgtacttttttttaagttacccttaatatttattgtcattttgttttcttttattctaatttctcaaaattgattttgctcttaagattgtggcttggactgaaaagatgatggataagtatcctgaaatggtctctcgtattaaaattggatctactgttgaagataatccactatatgttctgaaggtaaaaataactcaagaaccactaattcttattactgttgaaaaacatgaatttaaaagttactttgtaacacaactaagctaattctgagctaatacatattatctctgaaagaatatttaagctctagacatccattaaagaatagaaatgacaagcggttttggtggaaccaagaaagtgtctggataaacatttgtcagagattgcacagtggacaaacccaaacaaatatttcatcccacagctttattacaagagtccatgatgtctctggtataaaaaaaccctcatcccttaaaatgcagtgaaactgatgaatgaatgtcatgaagggaatttaaatatcatagcatcataggactgtagaacagtgtgttaggcatttcaaccatggattgcttgagggttccctatatcagagccaacaatttccactccattgctgctggatttttgcacatccaaagatactgctccctgaagcagccacttaacaagtgagaagcccatccacatcccaaacccccattcattcattatctccaaccactcaaaacaaacctgcactctcttcaaaatgacagccattcaagtatccagtactatttcccttccccactccaacacaacacaagatcttctccattccagggtaaatatccccagtttacacaaccagaaaaacaaaaggaagtggcagaaacaaaagtgactttataataaatttctcagaacacaggatgttagtaataaaataaaaacaatggactacaaatttttttcaaaatcctaccagctgccctgacactagaaaaattttttgaaaaatatgcattgtaatagattatgaattatgtatagacatttaaggatatgtcccatggtcccttctgagaacaatatgtgcatacatggttctcattcaacaatagacaggggaaataattgctttgagaatatgaatgagttattggtcaacaagggatcaatgtgtgagtttgttcaaaacaatatctcaagtttacttttaaatagattggggaaaagaatgaaagaagaaaggctatttttatggattgtggcattcacgcacgagaatgggtctccccagcattctgccagtggtttgtctatcaggtaagtgaatcagaagactcccaattctcctttgactgccaagtctccagcacttcactaagtggcgacatctttccaaacacgcaattccacttagctagaagagcccatacttggtgctgtcagggaagaaacgctctgaattttactcatcattacagtttttatgaaattgacaacttccctccaaacaattcttaaactcaagctaagagtttatgaaactcacacttttcttgggctatcacatgaaagtttttactgtagtcaagtatggaaaatctgaaacaaccttcacataacctacaaatgtaacttttcttcaatgagctcaaaacatagatatttaattttaattcctctttagataatacattggccacacatgtacttggaattttaatatttaagtttcctttctgagtgaaaaataactcacttttttcttttttttttttttgagatggagtctcactctgtcacccaggctggaatgcagtggtgcaatctcgtctcactgcaacctccgcctcctgggttcaagcaattctactacctcagtctccaaagtagctggaactacaggcatgcgccaccatgcctggctaatttttgtatttttagtagagactggattttgccatgttggccaggctgttatcaaactcctgatcccaagtaatctgtccccctcggcctcccaaagtgctgggataacaggtatgagccaccacactgggcctacaattcacttttttaaaaggtttatctagtttatatattcaatattcctctcactctattgccaatgtattttgactcctaccatattttaattttctctttctgtcagcttttgcacatggcacagtggtgaaatatgtgtaacaatggttttctgggcatagatatttttctagaaaagaatccaccaggaagtgacctgtagttacttttgctctcccaactgagggccaagagctccccctactcaacacataaaggaatgcacatcacaggtctacaaaaaatcttgtctccaattcagatgtacctagaaggacttcccaagagtggtgagagagattttaggtagctacagaaagtgcatgtgattagagaaatttcagtcagatatagaaaaaaaaaagttgttcaatctctgaattcttgggtattttattaatacaattttttatttaatcctgcttataactatctcacaaattctctccaatattttcatattcctgtgcttacagactctatctatatttatgtaaaagatgtgagagaatcaattaaaaataagttgtattacaaattttccatttggcttccaatctttctatgaaacatatctctcatgctacatttggaatgctataagtctcgataattaaatgctcctttaaagactattcatttccattaatgtcactagtctaaataagttaggtttttttcccctttaaactatatggattgtttatttttgttcattttagggaaaatatgcttgaaaacatgtgaccttgggaagtgactcaagttattactattataaccacagctttccacataatagctaaacttcataccaatagcttaattttttttcacctccgacaggcaaccaaaacttatgggagaaacaaaattatgaccaaactcttggaccgaatgaatttttacattcttcctgtgttcaatgttgatggatatatttggtcatggacaaaggtactgctctctactctcttgtttgcatttagatattatttgctggctttaatacacaatgttatgcattcagcttagggtttaggtaactagttaattctaattcagaaaagtatattttttaaaatctcagtttcaaattaagtatgatttcttggttgcataggtatccttgaaataatataaaatttttgctgctgaagctagttatgtgggaaaatgaaataaagtagtaattacagaggaaatgtatgattgcattatatgatatggcatatctagctaagaataaagccaattaattgattttaaaacaaaaacctttgtatttcatcaattttgaatagaatttgaggtagaatcattgtatcaaaaaaaataaaagagaggtacagatacctatttgtctttttacagtatattttattatcctgcttttgctaaataagaactctcaggcagacactgtcacatcaaattattttctgcaaataatgctccaacagtaaaaatttgacctgcattatatctgaatctatatatggtgaacaagctaatgaagttataatttaaattatggttaatttcagaacaccgttagtcatcttctaatactgtgaactaatcaacagtgtttaaaattaactgaattatttcatcaaagcctaaggatataatattaaaaaccatgattctgaaaatactacaaattataagaaaacaatatttttttctttttataataaagggcctcaagttaactagatagatttcaaataaagttgcagacacctgcagagagaatttgaaatgatcaaattgaaaaatgcaaactgatcttgtgtaaacacttacgtcattcaatctggcagaaccgcatgtggagaaaaaatcgttccaagaaccaaaactccaaatgcatcggcactgacctcaacaggaattttaatgcttcatggaactgtgagtagcagacttgctatcaaggaaaattgctataaggaatatttaggtcccaaacttaactaaaacacctacttgttcagtaaaaatagttatgctttgagtgagtgttaacttttgtatctataacatgaaagacaatcatcactaccattgagggatgtcttgctgtgtggaaggaaatgaggaggaagggactgtttatcaaaccatctcttacttactatatctagtttgctaaaaattaagcacaatccaaatgtataaaaattcagataatctgaataaagacctcagattcctctgcttcctgatgtgagaaatgtcagtggctaaaagcaacatacagacagtttttcagatatttagtgaaaagagtcatctggagcaaagaaagtgaaaaagtttaacagaaatacgatgataagcagaggcctgctacatcagacgatgctttagttgctatacaactatgacttcatcactgcacactttcaaggagaaattaccattgccccaatttatatatttcttctgtgcctaattttgttgaaaacatcacctgagcttttaactgtattctaccataatgaacatagaagagcagcagctatctctaattgagagctttctgctgaaaaaggctgaagaaacttgtgcccagggaaggtaattcacaccagcccccagcgcattagagctggggttgaattagaactggagtgtatctggctccaagtcatggctgcttctgatttattactcctgtggccttgggaaaggacaaggaagtaaacaaggcttagaatattccagtgggctaagtctgttacaatctggcatgtgtgtgcaatgttaatctgtagtgactatgatacaagagacattgaagcagccctgtaaacatgagaggcaaaaacatttaaaacattctgtgaatctataatacattagaagaggcaggagctatatggatggggagcagactgtggtctcatccacctatgtcttctgcagccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggtacgtagacaaaagtttgcacttcatgcatcgacaataccattgactttcagtctgttcttcattaacttgggtatgttgaaagaatttcacattttaatgtcaaagaaaagaactaatgaaatttgccttgaagttaaaatcatgatctttagattgatttttcattgataaaagtatatagataataaattcctttaatgtgattctcaggaggaaaaaaaaatcaggaagaaatgtctaggaaaggcataatagaagtctattacaacacagctcattgtggggtttaacatttaccatgggttgtacggtaaaaccatgcacggaaaaagcccaatagaatagcaaagacatttactagtcctgccccccagatatcagatttaagaagatacattgtatttttatcctgatcaacttggaaattatattcttttacaatccaaagaagattataaatgtttgtgaagcttcttcactaagaatatgttatctttccaaaactatgatccattaagcaccattttgtttataaaaactgatttgataatgtgagctttaaaaaaaaagtctgcatatgggttccaatgaatcacaggaagtgacagagtgaatgggtgcatagagggataaatattttgaattgctatagaagaaaataaataaaacagaaaaagtttagtggcccagatcccatggtgattggcaaatatagcactttcagtaatagctgtggtccaaatactgcctcataaaatattttaaaatttttaagaggttacaattttcattctgacctcagtccattgtatttagcacaacagcatttaatgttaattggagcagagacctgaatcagtcattaaaatcatctccatatatacaacaaagaagacataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtcttttaaaaatctttgtgagtgcaaatatgttagtaactatattccattaaaattcattctgacaatcactctcatagcacaaaacactaacgtgtattaaaaggtcatgacaaaatgccactctgaaagagacaccctaattaacaactattttaaaaagcggtcaaccacccttcttcccttggtatgctgaagtcagatgagtagagaagatcctgtagcaatatgagcctgttagggaccaaggaatgtaaaacatggaagaaaatggagaaactgtcagaagagacaattatctgaagccaaaaaaattgacaggaaaaataatgtatattttatattttagaagaaaggaatgaggagagagagagaaagaagagtagaaacacaaaatgagatatggcattactgtatataatcgactgcatatttaagtctttttttttttttttttttttttagacggagtctcgctctgtcaccaggctggagtgcagtggcgcaatcttggctcactacaacctccgactccctggttcaagcgattctcctgcctcagcctcccaagtagctgagactacaggcacatggcaccacccccagctaattttttgtatttttagtagagacggggtttcaccatgctagccaggatggtctccatctcctgacctcatgatctgcccacctcagcctccgcaagtgctgggattacaggcgtgagccaccgtgcccggccaagtctttatacttaccacatatattactgaaaataagtttctcgtttaaccatttattttattttgatcttcaaatgccaaatacctggtaaatttgacttttttcatccctagtaatttacatatttacatatatatatgtatgggctttggttttgttaaaaccaggaactgaattccggcttcaccagttgcaactaaccaggaaatagtactgtccatctcatagggttgttatgagtcttgaaactaaagatcaagggataagcacagtgcctaacctgtaagactccattaaaaaattgcatacatacataattacatattccttggtatttacacagtatcctattatttcactctaactttcctttctctccaggccaaagttgcaaagattggcactgatgttctatcaactcgatatgaaacccgctacatctatggcccaatagaatcaacaatttgtaagtcattcctcttatttactgagcccttttccctaattattttttacaaatattaaagaaaattatggaatttgcaatttaggttagagcatctggaattgctaatttaaattctactttttacaggatattctgaattatacgtgaatctaggggatagattctgaccttttcttgggataagatttttctagaaacaaattatactgaacttttacagggttacaaggtcaacggaagctattaagtcaagacagatttacagtttactttatctaccttcctgtttcccacctgtaccaccaacaatgttgtatccttccaggaactaatgagaattcactggagtgagaaaaaaaaaaaaattagccaggcatggtgacctatgcctgtagtcccagtttctctggaggctggggtgggaagatcatttgggcctgggaggtcaagactgccatgagctgtgatcgtgccactgcactccagcctgggcaacagagcaagacctcatctaaaaaaaatcacataaaagaaattagatggagtagagtctacattttttttaaccatttaactttaactggactctttcttacttgccttgtctacatgtaagtatggtcttttccctagctgaaaaacagctaggataggaaaacagatagaaaatcagtttcagctcctctggtcgtgtaaaacaagttatctctccttctcacttgctccttctcactatgttcagccgaaatctgtatggtgaactagaagggagatcacaagactctagttctgtcacttttgtttcatactctcagcaccatttcttactcttccctatttttaaatttatgttgtctttgtgtgtttttaagttattgacttggatttcttggccttgattttcttgtctcttattctatataaaagaaatcagtaatttttttttctgtaaagggccagatagtaaatagctttggctttgtggaggtacagtttctgttgcaggtactcaaccggagaatcatagctcaaaaacggccatagacaataagtcagcaaatgggtgactatgtgccaataaaacctcattcacagaaacaggaggctgaccaggatttgccaactcccatactttatactaaataatatctgcaaatttttatggagtctttacaagttaggcactgtgcttaccccttgattttcacaatctcaagcttcacaacaaccctatgaggtggggagtagtatttcccagttattagtaaccggcgaagctggaactcaatctcagattttaacaaacaaaagccctgatcctgaccactgcacatactgtttgtgcatttggattttgtagctgaaatatccaggattttctatttgcaatgaacagccaaaaaatccatttgagtatcaccgaagacaattaactcagatcctgggaagtgagaccactttctgctcttacagcaactcccactaagcttagtttgggaattatttagtaaaaactaccttttctccaaaccaagttcaagcttcagttcttagtctcaaaatttatacaaaattccccatgaaacttctcaaaagcaagaattatgcttcagatttcctcttagaccctgtaacatatagtacagtgcacggcatggaacaacagcagaattagttcccataaacttgctcaatgataatggtgtcctggcttattcaaaagaagtgaatgtgagttgaaaccacaacagtactggacttgattaagcctgcatcactctctagaccaaatatccaacagtgtttagcattaagactaccatttaacttttaaaaatttcatgaacaacccttccaccaccaaagatacactcatatttttattacacttttagaatctgtgcattaaaaaatacatatgtgcatatgaattcaggattccttgcaacaattttacctgaccacagtttttaagtcactttcgtattccaagctgaaagtataaactttgaactgaaagtctacatcctcagcaattgcgatggaatttgaaaatgccggaatcaacatatacagtttctaggacttacttattagatgcttctttggcagaactggaaaatgactaaaaaatggacaagtccctttcctcgagcacattcattaacaatcacctatcaaccagtcactgttaaggtgctgaagaaaaagtgtagtgatacagatgatccccagcatccacatagatcttgctacaacctagccatgctggggactcattacacatacaggtggatgaccacaagatttcaaaatacatgttatgtacccagctatgtgagtggacaaaaagtaagcaaagtaaagaacaagaagacagactagaagatcagtttaaaatggcagcccacttagtagatactaataaatagcagggccagattggccacccagacaccacatgagagcaattcctctaagcaagaaaaacccacagatagtcttagaggcaaagaacaaagcattccaaacaggaacaaactttgcaaaaggcaattaaagcatcaaataattatccgtgtgtgtgtatccacaaaagtatgagaatacagagctgtgcatagcattgcattaagacctcttaatgaacaaaaatatatggtgtacctagctagcaggctagcactttggagctttcagagataaatgagaggacttaggacacaataaactactcttaaggaagtcacattctaagtggaaggagcggagagccaaaactaccatagctccatgccatcatgtgtcactttcaaaatggaaagatacagtcaagagggattactattctgtttaactgtgcagcattatttaaaatttttattacattatactacaacattttaaaggcattgagatttagaaagaattgcctttgtcacgcagtgctgcagcagcttgataaacgatcaagatttctagaacagactgctttaataaagcatctgatagaatgttaatcaaacatgcatgagaaacagggtagcaaagcagttgacttggtaagaataaaaaataaaaatgtgattaaagtttagtcattccaataacctgattgtcacttaacatgtccccagatttaggaacagcatctagcatttgtcagtgatttcctgtcttcgacttgatgaagacagaaaaaaaaggactgggggagcattttttaaactcaacttatggaggatctctggcctttagaaaaaaatatatatatgtttgctctttgaacatgagaggcaaacatatcagataagttaaaatcataaattttgaaaccagggagaaacataggcaatgatctattccatggttctcaagcctgacttcccattagaatcatcaggaagctggccaggcctggtggctcacttttgtaatcctagcactttgggaggctgaggagggcggatcacaaggtgaggagtttgagaccagtctggccaacatggtgaaaccccatctctactaaaaatacaaaaattagctgggcgtaatggtgggcacctgtaatcccagctactcagaaggctgaggcaggagaatcacttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtctgaggaggagctcggcactcaatttttttttaagtaccttaagtgattctaagatgaaactagggttgagaatcgctgatctaagcaaaacttctcatttatagactgaaattcagatacagaaatatttcatcactttagggcagaagaaaaacaaaaatcagcattcaagaccagagttaaaatggtatacctaccactttgccccaaagcagcaatattgagatggcacaaaaaagtaaatagtaatgtttaatgtgaaatgattatatttgcatataaacagcatatccaatccttcatcatcttagaaataactaaacatagtacctagtgagcaagaatagttatttgagttgataagaaccaagattgcattagtaataaaattcatctgtgagtcacatcatgaattaaaaagttaatttcaaagtacatttcttgtagcttcctttgtgtaccaaaattgctagatctaccactgattctcaacccagtgctctttttccatattctacatattctactttttcaaaatttacattctgaaaaagaaaagttaagacttgtagttcataacaccagatctctacttactaagagacattcaaactgatattacagagaaaatatttcagtgtatgcccatgtatctctggcttcagctcttgcttctaatataattttcacttagtattaatataaaagtacaggttattatattgaatacatttaaataatattttttaaaacgatacaatttttcagaaaacactgtatcaagtaagcaataaatgcagcacacattaagtcaccaacgtcactttatatggatccctttgggctgaaatcagatttctagtttggtacggtttcattttgatttgttctcattgaatttgttgcaaccaatattgtgccttgaaataagtaggaaatattttcttaatgttgaacatactcagaatatgctgtcaacaaaaacaaaattatcttatagaactgagtaaagacttggtattggctagaatatagagtggcacataggtagcacagtacaatgattaacaacatgaactctgaagacaccacctgggcttgaatcctgattcgaccatctactagctatgtgtttttcagcaagttgcttaatctctctgagcctaggtttcttcttcggtaaaatggtaattgttacttacatttgggataggaattaattaaatgagttaacatgcataaagcacatagaagggtacttggtatttagcaagtgattattactgtattttataaatgcatacacatgttttagtaggtacacatggagataaagaaaaggctaagtatcatgttaaacaaattaagttctggccaggcacagtgatgcacacctgtagtcccagctactcaggaggctgaggtggaagtatcacttcagcctgggacgtcgaggatacagtgagccatgatcatgccaccgcactccagccaaggtaacagagcaagaccctgtcacatacacacacacacacacacacacacacacatacacacacacacacacacaaattctatatttttttctcaaagtaaaaacttgcaatgttgtatttactttatgacttgatatagttttgtttgcaaatttaagatctagaagatatgaaatgtattctacttcatagcatcacataattatgaaaaatcaaattccatatattctcaatcaccactattaatcttaatgacaaactccacataaagtaaatctctcaaaatagaatagccatgccctttaacccttggaaatcacagcagtttactcgactgcaaatagagagctactgcaactaggaactggccaagtttattaaaatgtctaacatatcctaaattacaagacataattcctatttactttacctcctttgctaccaagcttgcatcttagcgtgatttctttctcatgaacttaaatccaactagctaaaagtggcaatctgtttgatcactgaagccagtctctatatttcagctcacgtgctccataaattacatgcaatatttgaccctgttaataacttcttgccattcctttggcttccttgactttgaactctactggttctcttcttcctcctcctcctttttttctactctcccactgactgcttctaaaagtagacattttccaaaaaatagggtacaatatatggatacttcctcaggttctctcctcaggtccctcctcttacttctgactctcctcatcaagaaataacctctatccccacaggctggaatccctcatttgttacctagggcaccaggcaatcaccttttacccactaagtgaaccaaccagaccaaaatagcaatgcaaaggctttgaaaactatattgtcagctgagcacggtggctcatgcctgtaatcttagcactttgggaggccaaggtgggaggatcacctgagaacaggagtccgagaccagcctggccaacatggtgaaacccggtctctactaaaaatacaaaaattagctaggtgtggtggtacgcacctgtagtcccagctactcaagaggccgaggcaggagaattgcttgaacctggaaggcagaggttgcagtgagctgaaatcgtaccactccacttcagtctgggcaacaaagtgagactctatctcaaaaacaacaacaacaacaacaacaaaaaaccaaagcaaaactgtctgggtgtggtggcacatgcctgtaatcccagcactttgggaggccgaggtaggcagattgcctgaggtcaggagttcaagaccagcctgaccaatatggtgaaaccctgtctctactaaaaatacaaaagttagccaggtgtggtggcaggcgcctgtagagaggagaagcacttggacctgggaggcagaggttgcagtgagccaagattgtgtcattgcattctcgcctgggtgacagagtgagactccatctcaaaagaaaaaaaaaaatactatattgtcatcagtatcacaagacacaaaagtaggccagggcctgtttactaaacctgaacagggtgattacctgctaaattgaagatttaagttacaatttattatttaatgtaatagctaaaatgtccagaatataatcaaaaatcgcttgtaatactaaaaacaagaaaaattacagcttgaatacaaaaagataatccacagatgccaacactgagatgattgcagtttcaaacattggaaaagaatttcaaagttgccatcattaaaaaaaaaatgcctcaacaaacaattacagatggccttgaaacaaatgaagaaatggaaactatcatcaaagaaataaatataagatacaaaaaggaaccaaatggaaaccatagaactagaaaatgtaataacttgaacaacaaaaaaactggaagggcttaatagcagaataaatatgacagagggaagaatcagtgaacttaaagacagagcaatataattcactcgctctgaagacagaaaataaacaaaaataaataactaaacaaagcctcaggaacaaatggcataataaaatatccaacattcatgtcatcggtccaaggaaaagataaataaagggaacaggagctggaaaaaaaatgtttgaagaaataaaagctgaaatatcctacatttgacaaagacataaactaacatagtcaagtagctgagtgaaacccaaacaggaataacccagagaaactcacatcaaagtacatcataattaaacttctgaaaactagacaaagaaacaagtcgtaaaaggaatcagacagaaatgatctagagttaaaaacagttccagtgacagcagatttttcatgtgaaaccatggaagtcaaaaggaagtgacattttctcaagtgctgaatgaaaacacctatcaaccctaaattcaataaattcaatgtattgcaaaaatattcagaaatgaaggagggaataagacattctcatacaaagggaaatcagcagatgtgtgccccgcacacctactcttaatggctaaaagaaccctctgaacaagaaggaaataatcacagcaaaaggcttggaactgcagagaggaaggaagaaaaatggattcagtataaataaataaattaaataatagactatctttctccacatgatgattgaatcaaaaattgtaagtctgtttgatgtgatgttcaatgtatgtagagaagtactcaagacaattgtactttaaaagtgggaagggaaaaaggatctgaaaggaagtaaagtttctacacctcacttgacatagtaaaatgtcaataccattagactgtggtaagttatgtatgtgtattatagtacctggagcaaccattaagaaaactaagcaagtgagactataaatcaatcaaatggaatcctaaaaatgtcatgtaaccaagaggaaggtgtaaagcaagaaaaaaaagataaagggataaaaacagaaagaacaaaaaaaaaaaaagaaataatggcatgtttaagtcatatcaataatttacctacacgcactaattaaagacacatgggcagaatgaattttttaaattataattcaacaatatgctgtttataagaaactcatttccaatataacaacacagataagttgaaatgagaatgatggaaaagatatactatgccataggaagaatagctacattaagtatcagataaagtgaatttcagagcaaagaaatttgctagtgacagagacattaacaatgataaaaggatccatcccaccaagaaaataatgatcctaaatgtgtgcacaccaatttcacctatgatgtctatgccaataatttaaacattcatttttccaagctctttcttgaatgtctgattgatgttaaacgtatcactttgtcttcctttgccttttctttttcccatcccaatgctctctgagttcccatttaacagtatgttttttccagctacccagattgaaacatcaatcatttttatgaaatcccaatgtttcttatgtagaatccctcagttgtttctaatgtggtgactctaccctagtcaggctttcatttcacactacttcataactggtttctattcttttcaatccagattaacaaacctaaagtactagaaggcctccaaaagaaaatctaaacacctagtcccgattcacaaggttttccaagctttactcacaaactctcactgctccctttgctctggtccagctggatctcgttggtttctaacaatgcctccatgcttttctatccttgtagttcactggctagaattcctttcttccatctccagctgaaaacacactagcctttcttcaaggctctcctccaataccatctcctccatcatgaaggcagtatttgagctggcactgggcatgaaaggccatactcctcatcaagaataatctcttttttcttttaaatcttggtaaaatattgtaccttttctatggtacttagcatattctgctctgcctctattgacttataccttgacttctgcctcctaaattgtaagttactgaagacaccagtggcatcttctgcatttttgtaccctgcaacaattactctccccagtgccaagaaatgtgtcttgtaaatattaaaggtttaataaatatttggtgaccaatttaagagccaacactatctcttcatcaaaatatcccttctctctttcatcgcagctttgaattcttatctttcaaatttttcagatctttcaaactgttattattagttaaactcattacttgtcctagaacataaatgccttcacatacaaaaaaaaccttttatatcacataaagcaaaatgtgagcacataaatgcaattatgatatgtatatgcacttgtatatgtatatagcctctagatgtgagttatatgtatataacctttagatgtgtgtttatatttccaatgtttttaccaaaaaatagaaccttgagttaaatttcataaaagttgacatggaaattttgaattaggagattaaatatgtctttaaaataactaaattacattttcttggtcttttgactatgaaatagtttaccctagcaacatgaaaaacaagagacctaagctattagaagaaatgcaattctatgtatcttgtgtgtatagtttttccctggtggttttcaacgaccagtgactccttagctggtttcctcagctgctagcacttgctctgggtacttgtcctcaacacgtccatctgcaacaatgtgtgcctaggaaataaactcaacttactactcacccaaccaaaatgtaattttttaaacgcagcacacactgggtggattccaaagtcatgattatgctttactatgcactctgtactattcagaccactactctcattcattactgcaattaactgcacacataactattttttattgctaattatacaccactgatttccactttaaaaaaacattagcatttgtctctaattaaatatttactgcttgtgttttacagacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgctttaaaattcatctttttatgataaacaatattctctgtatttctctatagcattaataatcaatattaatgccattcattcagtctgttaataagaaataatatcttcaattttcaaaaacataatttgcctatctttttctgatagaagtagacattgtttatatcttcaaaaaagcaaaaggatgtcctagcaggaaataaagtggttcatatagagatgaatctcagtcctttaaataaccgatccagttctcatcagcataatgtacattaaattcaaaatagtttaatttaacctgccataatcagaagaaaccacctgctaaaacatctgtttgccggtacagacacagacaagacagtctggtcagctgtgacccctgccctcctaatggatagaaaggaaacctggaaacatactgtaagttgaggacggaaagtcatgttgaccaaaggcaatcagggtaacttgctgcatttgtaccatttatactcctattatttaagatagtattattggatagcttctccccaacaccaatacctcaatgtgtgatcaagtggcaacagtggcagtgtctacattcccagaatccagacacagatgcccaccacaggactgactataatttgagggacaagtagagagttccttgacttccagtaaacttacttctcagaacaccccagacagttttcaacgactgggaaaggtcctgagaagtcaagtcaataaacaatctgggacatgccccatgaatcctttagggacacataaaagaaaggatggcatcaaagctacaagatgatggtgtgttctgataatcatgaggtagataaaagtttcccatgcaaaattgtccaggaaaagcaaatgtaaactaacaaaattgctttacaaggggagaaggggaaggtgacagagtcaagaaagtaaaagagaaaaatgtggctatgagattatattgtctgattaaaaatatggtatctatgtctaaatatttagcattccaaactagcttcagaacgtgggaatgtaaatttgtttcattatacatgccatattggcattatatactcattcacacttactcaaatgagaaaggactgaaatatattctaaccctaaaattcatataaatacctctaattccattgagcctttagatggaggagataaaagagataatcccaattgcagaatattatcccatgtccatccattattcagtttataaagacacaaaagttgaacacactatttgaattattatgcagcttaatattttttctcaatcagaaaaaaaattagcctgagtggctaaaaataaaaaatcctaacaagatctcatcctaattaaatagtttttgaatggcatctgagggcatttacttctttgactgcatatgaattgtgaaaataaatatgtgaagacaaatatctacattaaagttaaaaaactaaaattttaccttatttatgagaaagtttgagtggcaagtgctgtgattcttcccttttcatttctcatctatcagtaaaagggctttgtacccaagttacaagttgtgctatcacataacaatattcttgacagaggccaggcacagtggctcatacctgtaatcccaacattttgggaggccaaggtgggaggatcacttgagcccagggagttcaagacaagtctgggtgataaagtgagaccctatctctacaaaaaaataaaaataaaaaattagccagctgtgatggcacatacctgtggtcccagctacttgggaagttgaggcaaaaggattgcttgagcccaggaggtcgaggctgcagcgagccaagatcacaccactgcactccaacttggatgacagagcaaaactctgactcaaatatacatatacacacatacacacacacatacatatgtgtatgtacatatatacacaaaatatatgtgtatatacatatatacaaaatacatatgtaaatatatatatatcatcattcattttccaattttcttactataaaactcactcaagaggcattgtttcatattttgaaaatgtgttcttttatggcaatatctaattgttgaggtgcacat

SEQ ID NO: 13266 - DNA, 187580 bp, Human
  misc_feature (1)...(187580): n = A,T,C or G
cctttggtttttgaaatcttgaattattgatttattatgagctcctccccatcaatttttctgttctctttctttctggaactcctgtttattgaaatattgtaccttgtagactgatcctctgattgttttttctttcctattgtccttttctttgtcttttagctttattttcctagtttctcaactttatcatataaactgtctaagttttaaaattccattattatatttcaaatttctaagagttattttttgttctttttatttcatcctattcttataacatctttttacttctctgaagatattattagcttttttaaaagcttttatttccctgcatattctcaagactttgtttcctctctagtttttgttttgttttgtttttcgttgtttgttgttgttgtttttttttttttaacttttgtgtgttctgtctctctcttctttggtaggggcttttttcagatgtctgataattctggcccttcacttgtattttagagctaatgggcacctctgtgccatggatgaagcttgttaccttttgtctttagaatgatcagtctgggccatttctatgggagggggatgtccttgtctttaggtcttttttcttggtctgagcaagttttctagaaggtaaatgtctcctctccttcctagaatggttccttatgctggctgcctctgttctggaggttgaatttggactgagaatagtgcttcattatataagcctttttccaaatctgtctgctttcagcataatattcccagtctttatcgtgcctagtgtcctagctctggcttagagaccctctgttatatcttctgcagcagtcactaaactgcatttgggagggaggcttttggggtagcctaccctgggaaatggcttgcttcttggtttcccctgtgctgatttagaatttagccttcttagtttgttacgtgatatgcaaagtatcctattttttagctcttaaaattttgttgctgtcattattttctcccccttttaatttgttaaaatccttttatttttaatttaatagaggtttgggggtaaacacatttgttcaatcagccatctttaatcagcatttttaaaaagatattcttggccaggcatggtggctcatgcctgtgatctcagcattttgggaggctgaggtgggaggattgcttgagctcagaagttcaaggctgcaatgagccatgatcatgccactgcactccagccttggtgacagaaggaaagcccatctcagaggtttatcagtccattcttgtgttgctataaaggaatactcaagcttggtgatttataaggtaaagaggtttattttggctcatggttccacaggctggatgagaagcatgcgccagcatctgcttctgatggggactcaggaagcttccaatcatggcagaaggtgaaggggagctgatgtgtcacatggcaaagagggagcaaaagagacagtgaggaattgctaggcttgttttaaacaaccagatctcttgtgaactcatagagtgagaactcactcattatgtcgaggacagcaccaaccctcttatgaaggatccacccccatgacgcaaacacctcccaagaggcccacctccaacactggaggtcacatttcaacatgagacttggagggtataaacatccaaaccaaaatgagggtggggaggagatattcttaatgtaatactttttttctgaaaaattagattttctgtgccagaatcccaaatctaagaaatctaagataaagtaatgtgcctgagaatagctttgtaaatgtgttcatttaatttctaactgggttttaatattttggccgtcataactgttgtgtggtaaatatttctgtttgttggcaaaacccttttgggttgttcatcaccttttatgtcattatagatgtaaacaacatgtgtgctccagatggactctgaaatccaggctcccactttatgacacactcctctacaacaccagagactcccaaacacaaggccttatattgactcatttcagctcacatcctggcgactctcaagagagaaacctcagagtgactaaaatctccataatgagaagacatgtacattcagtatctattttggtaggagactttatattcagccttctttctgtagagtaagacgtggagatttggacttagggtgggctgtatgtggggtggagagtaacaagataagcaaggaattaactccatagtaaatgttaacactttctacatctttaaccccaattttatgtgccaaagaaagaatccccacaactgataccttcctggcagaactgacttcaggaaaggcaactcaggcagatattcgagtaggcctagactgtgtgggcctgtggccagtctcacaacaaaacagaatcaacagccttgcagtctcagaaatgcagtggtcattctggtaagcaatagtcaaaactaaaatttcttaaactgattttttgcctctatggtcaaaggagaactgatcctacttgttatttcatagatggaaaaatccatttgccaatcaggatgtgtctgatactccttttttttttggtttcaagagtaaagtcaagaaaagctgctttttgaaagtcaaagaatcacagtagttgttatttcttagtgcttactatttgctacatgcttcacatacgtggtctcatttaatcttcccaaacaattttgccataatattattacaaccatgttgaatctgaaaataataataataataataataataataaggcttagagaggttgagtaacttacctaaggttaccaaattagtaaagactgaactgggatttaaaagcaagatttgtagaatttttctccaaaacccagaatctctgcattgagccagcctgccattctgagacagacaacattcataacacttgcatattgtttgtacagtgttcattgtttaatgtagggcacatttcatacataccaagaggaatcatatgcttattcttgctagtatatggcaaacttttccattctataatacaaatatgactgatgactgctgtcatcagcccagcaaatcacctttcatcacaggtacacagatgacaaatacagagtacggaaggagtcagctgaaggtgctgcttgcctgggctgtcttttttttttttttgttacatctgccacttcatttattttatttgcaggaggagttgaaaccaattttaagggagattttcattttccccctaaacatgaatcattcaagtaaaaccaacaactatagaaatgtagcaaagtaaggggaaagcagcacaacaacccaagaggcaaaggctggggggaaggggtgggtgcagtctgcgtataacatatgcacaaatgccttatgattcccctgctcaggaccgcctccccagaaggcaagcacaagggcccattttaagaggatgtttccccccaaacatctgagagcgcttcaacttaaacagcttacggttaaaaagacaaaaaagaaagcaaaactaaccaaagaaactccaaaaaaccccatgaaccacccagccataactgccttccttaatcgatcataggagtttcattttataaaaagataaataaaaaacattgaaaaaaatattttatcatgttatatttgtaaagataatagaattcatacgtttcttagaaaacagaccagacactgccctccagtttccaccccattgctgggaggatcagcaggactagaaagtttgggatactggagctgccggtggagaatgggaagtccagcccagaagaaattaggaaatagggctcaggggcacgtgaggtgtggttaggagcaactccacgtgatacatggctgcacagaaaaggggaacacaggtgatcggaaaggccttaaactcctccttgacatacaaaaccgattttcacaaagatccaggcagtttggtcccaaactaaggtgaacacttcaaagtttattcacatgctttactttctcttttaagaatcatcgtttcccaaattaaattagatttaaattataatgttactacatatgcctaaaaaaagaaaagaaaaaaaaagaaaggcttttaaaatcaggacaggggagaagagattgaaaatcatcaaattagtcctcttagctccaaatgaaatgaaattaagaacaaaaactctgggcctaccgcaccgattgcagctgcagcttgcaatggcaccttgggctgtcattttatccaaaacaatcactgctccgtagaaagactgcaaagacttggagtcctgtgtttcagtcctggtgttggtgctaaccagttgtattgggcttgttacctacgaagaaaactcacctttgttaaatgcccagtgtgtattgggcacggctttcttttttaatttatgtggttttctttagaagcccatacgtgtccaagggttatgaaggatgctaaagttagactcttccacccatggcccccagcctgtgatcccattcccagtgttatctattgttaccaattttgcataatacttctagagtaccaggaactttaaatatattatgtcagttaagtttcctggttattgctccaatttaatttaatttaatttaatttaatttttttgtctttttcaggatttagggcaggaaaggcaggctagtgtatgtactcagtctgcatatttgctccaatttataaccctattttacagtttctgaaattgagcttagtagctacttgcaaataactaattagtagtggagctaagattaattcaccctttctgtactcactgaataactataatggtaccatgctaggctttgaggatgggatcatgaggcacatagatccttcctgtcagtctagtggaggggttttcttttttttattaattttttttctttaattagggataggatctcactgtgttgcccaaggctggtcttgaactcctgggctcaagcagtcttcccacctcagcctcccaaagtgctgggattacaggcctaagccaccttgctcagccaagtgaagaagttttaaaaagtaaatagataagctactgcttccactgtcaccatgtgatgtgcctgctcccactttgccttctgccataaccaaaagttcctgaagccctcaccagaagctgagtaggtgttggtgctacgcttgtatagtcagcagaaccgtgagccagttaaacctctgttctttataaattgcccagtctctggtatacctttatagtaatgcgaaagtggactgatacagaaaattggtactgatgagtggggtgtagctataaagatatttgaagatgtagaaatggctttggaactgggtcacaggcagaggttggaagagtttggagggctcagaagaagacaggaagatgagagaaggtttggaactgcttcaaggctggttaaatggttgtgaccaaaatgctgatagagatattgacagtaaagtccaggctgatcgggtctcagatggaaatggggaaactgttgggaactgcagtacaggttactcatgttatgccctaacaaagagcttggctttattgtgttcatgccctaggggtctgtgggagtttgaacttaagagtgatgactggctgagcacggtggctcatgcctgtaatcccagcactttgggaggtcaaggcaggcagataacctgaggttgggagttcaagaccagcctgaccaacatggagaaaccccatctctactaaaaatacaaaattagccgggcatggtggcacatgcctataatcccagctacttgggaagctgaggcaggagaatcacttgaactggggaggcagaggttgcggtgaaccaagatcacaccattgcactccagcctgggcaacaagagcgaaactccatctcaaaaaaaaaaaaaaaaaagaatgatgacctagaatatctggcagaagaaatttctaagcaacaaagcattcaagatgtgccctggctgcttctaatcacccacaatcagatgcaggagcaaagaaatgacttaaagttggaacttacatttaaaagggaagcagactgtaaaagtttggaaaatttgtagccttgccatgtggcagagaaagaaaaacactttcaggagagaaacacaagcaggctgcagaataaccacttgctagagagattagcatgactaaatgggagccaagtgctaacagccaagacaatgggaaaaaggcctcaaaggtgtttcagggatcttctaggaagtccctcccatcacaggctcagaggcttaggaggaaataatagtttcaggggccagatccaggacatcactgctctgtggaacctcaggaacactgctccccacatcctggctgttctggctccagccttggctcaaaggggcccaggtacaacttgtgctgcagttctagagggtataatccataagtcttggcagtttccatgtggtgttaattctgcaggtgctcagaatgcaagtgtgaagaaggcttgatggtttcctcctagattctggatatatggaaaagcctgggtgtccaggcagaagcctgccacaggggtggagcccctagagagaaactctactaaggcaatgcctaggggagatgtggattccagtccccaccacagtgtccccaccagggcactgcctcatggagctgttggtgggggcccactgtattagtctgttctcacactgctaataaagacatgcctgaaaatgggtaatttataaaggaaagaggtttaattgactcacagttcaacatggctggggagtcctcaggaaacttacaatcatggcagaagtgaaataggcacgtcttacatggtggcaggtgagagaagtgaaaaccaagtgaaggaggaagccccttagaaaactatcagatctcgtgagaactcactcactatcacgagaacagtatggggggaactgccctcatgattcaattatcttcacctaggcctgcccttgacacatggggattattacaattcaagatgagatttgggtggggacacagagccaaaccacatcacccaccatcctccatattccagaatgatagattcactggcagcttgcaccttcttcctggaaaacatgcaagtactcaactccaacctgtgagagcaatcacatgggctgcatcctgcaaagccatgtgggcaaggctgctcaaggccttggaagcctatccttcacatcaggatgcaggacttggaatcaaggattatgttggaactttaagatttaatgcctgccctcctgggttccagacctgcatgggcctattacccctttcctttggccaactcctcccttttggaataggaatgtttacccaatgcctgtactaccactgtatctttgaattcaataacttgtttttttattttacaggtttatagatagaaggaacttggccttgagtttcagatgagactttggacttttggacttttgagttaaggctggaacaagttaagactttaggggactattacaaaggcatgattgtattttgaaatgtgagaaggacatgagatttgggggtgcagtggcagaatagtatagtttggatgtttgtcccttccaaatcttatgttgtaatgtaatctccggtgttggtggtgggacctggtgggaggaggttggatcatggggctttgggtagtgtggacatattaacaatattgattcttccagtccatgaacatggaatatatttccatttatttgtgtccttttcaatttttttcatcaatgttttatagttgtcatgatccctcgtgaatggcttagcatcatcccctgggtgatgagtgagttctcactctggtattttacatgagatctgtttgtttaaaagactgtggcacctttcccctctctcttgctcccactcttgccacatgacatgcctgctcccacttaccttctgctatgattataagcttcctgaggccctcaccagaagctgagcagatgttggtgccatgcttgtacagcctgttgaattgtgagccaattaaacctcttttatttataaattccccagccttaggtattcctttatagcaatataaaaataaactaaaacatctatcatgtgctgtggttcttactggagcaccatcaactcaacttgtagcactgaggaaagctgttagaaaaagtgacctccgtgctaagacatcaggaatgagctaggagttagccaggtgaaggggaaaatgttagaggatggacagaagagtaatcttaagcctgatgttttgggaggctttcagggtgactggaactgttgtgggagtgtgcccaaggtgactggggaggggtaaactgaagactgagtagttcagatattgtaaagcctgtgaggatttagtaggggagtgatgtgatcacattctaactatgggatggagaatgaattcaaaaacgccatgctcgttgagaggctgccacaggggagaacccatagcagcctgagtcaaggtcaatgctgaggtatttgggaagcagaagcaaaagaccttcagggactggtatgcagcaatgatcatgagaatagattctgtaaccaccaggaatctttgctctgttgtttcctgatagcagaaccattggacattgaattgcttgtgatattgtacagggcattgttataacctttttaaatatcacttttctaatttgcaagatgggagtaaaaatggggtcaaaatggggatactattagtacttaccttgtaaggtcatcataagaactaaaagagaattcctgtaaaggttggttgtagtgtagttcccacatatattaagcatttaggaaatctcaaagcaaagggaggagccaagcatgtctttccaggtacaaccttgggcatctaagtgcttggtgttgccagtctctgtgttgaggaacacagaaaagggacagatttggaggaaggtgataaattcggcctgcatttgtttgagtccaaagcccaaatctcttcactacaccagtttccttaaagacactgccacttcctatctgtgtgatttttttttttttttttttttttgagacagagtctcgctctgtcgcccaggctggagtgcagtggcgtgatctcggctcactgcaagctccacctcctgggttcacgccattctcctgcctcagcctcccgagtagctgggactacaggcgcccaccaccacacccggctaattttttgtattttttggtagagacgggatttcaccatgttagccaggatagtctcaatctcctgacctcatgatccacccgcctcggcctcccaaagtgctgggattacaggcatgagccactgcgtccggcctcctgtgtgatcttttttaaatatatatatatatatttttttcttttcttttcttgttttttttttttttgagatggagccttgctctgtcgcccaggctggagtgcagtggtatgatctcggctcactgcagcctctgcctcctgagttcaagcaattctcctgccccagcctcccaggtacctgggattacaggcgcctgccatcatgcccagagaatttttgtatttttagtagagatggggtttcaccatgttggccaggctgatctcaaactcctgacctcaagtgattcgcctgccttggcctcccaaagtgctgtgattacaggtgtaagccactgcgcccatccctttaataatttttttatttttaatttttatgagtacatagtaggtacatatatttatgaagtgggtgaaatattttcatacaggcatacaatgaacaataatcccatcagggtaaatggggtatcatcacctcaagcttttatcatttctctgtgatataaacattcagattatattcttattttaaaatgtacaataaattattgttggctgtagtcaccctgttgtgctgtcaaatactagatcttattctttctatctacctatatttttgtatgtattaaccatccccacttgcatccaccttcactatctttcccagcctctggtaatcatcattctacactctatctccatgcattcaagtgttttaatttttacctttcacaaatgattgagaacatgcaaagtttgtccttctgtgcctggcttacttcacttaccataatgtgttccaattccatctgtgttgcaaatgacaggatcttattctttttatggctgaacagtactctattgtgtatgtgtaccatattttctctatccattcatctactgatgaacacttaggttgattccaaatcttggctattatgaatagtgctgcagtgaacatggagtgcagacatctcttcgatataatgattttctttattttgcgtgtatacctagcagtgggattgctggatcatatggtagttttttagttttttgagacaccaccatactgttctgcataattgctgtattaatttacattctcaccaacagtgtatgagggttctcgtttctctgcatccttgcattattgcctgtcttttggatacaagccactttaactggggtcagatgatatcccattttgttttggtttgcatttctctgatgatcaataatgttgaacaccttttcaggcacctgcttgccatttgtatgtcttcttttgagaaatgtctgtttagatattttgcccatttcaattggattattattttatttttccccattgagttatgtatcttctatttattaatcccttgtttttttgttgttgtttgtttgttttgtttttgagacagagtcttgctcttgctcttgctctgtcgcccaggctggagtgcagtgatgcgatctcggctcactgcaacctctgcctcccgggttcaagcaattctccttcctcagcctcctgagtagctgagattacaggcgcctgccaccatgcccagctaatttttttgtatttttagtagagacggggtttccccatgttggtcaggctggtctcgaacccctgacctcgtgatccacctgcctcggcctcccaaagtgctgggattataggcgtgagccaccgcgcccagcctattaatcccttgttagatggatggtgtgcaaatattttctcccacttcgctttgtcttttcacttcattgataatatcctttgctgtccaaaagctttttaacttgatttgattcaatttgtccatttttgctttggttgcttggcccagaccaatgttctggagagtttctcctatgttttcttttagttgttttatagtttcaggtcttatatttaagtctttaatccatttatatttgatttttatatatcaagatatacaaaatacaagatattttgtatatcaagagatagtaatctagttttattattccacagatggatatccagttttcccatcattatttgttgaagagactgtcctttccccagtgtatgttcttggtacctttgttgaaaatgaattcactgtagatgtatagattgatttctgggttctctattctgggttctctattctgtcccattggtctgtgtttctgttttatgccagtaccttgctgtttcagttactatagctctgtgatataatttgaagtcaagtaatgtgattcctccagttttgttctttttgctcaaaatggctatgactattctaggtctttggtggttccatatacattttaggattttttttttctgtttatgtgaagaatgtcattggtattttgataaagctttcattaaatctgtagattgctttgcgtagtgtaggcatattaacaatactgattcttccaatccatgaacatggaatatatttccatttatttgtgtccttttcaacttttttcatcaatgttttatagttgtcatggtatagatcaccacttctttcgttaagcttatttccaggtatctaattttatttatagttattgtacatgggatattatcttgatttctttttcagattgtttgctgttggcatatagaaatgctactgatttttgtatgttggctttgtatcctgcaactttatgaaatttgtttattagttctaattgttttttgggggagtctttaggtttttccaaatataagatcatatcatctgcaaacaaggataatttgacttcttcttttccaatttgtatgccctttatgtttttctcttttatgattgctctagctagaacttccagtagtatgttgaataacagtggtgaaagtggagccatgcacggtggcttacacctgtaatcccagcactttgggaggactaggtgggtggattacctgaggtcaggagttcacgaccagcctggccaacatggtaaaaacccatctctactaaaaaatacaaaaattagctgtgtgcagtggccggcacctgtaatcccagctacttgggaggctgaggcaggaaaatcgcttgaacctgagaggcagaggttgcagtgagctgagatcgcaccattgcactccagcctgggcgacaagaatgaaactccgtctcaaacaaacaaacaaacaaacaaacaaacaaacagtggtgaaagtgggcatccttgttgtattcccaatcttagaggaaaggctttcagttttttcccattaagtgtgacactaactgtgggtctgtcatatatggcttttatcgtgttgaggtatattcctcaacacattacccagtttgttgagggttttcatcatgaagggatattgaattttatcaaatagtatttcaagattaattgaaatgatcagatggtttttatcttctgttgatatgatgtatcacattctttgatttgcatatgttgaatcattcttgcatccttgagataaattccacttggtcatggtgaattattttttaatgtgttgttgaattcagtttgctagtattttgttaaggatttttgcatcaatgttcatcagagatattggcctatagtgttcttttttctttttgttcctttttccttttctttctctctttttttttttaatgtgtctttgtctggtgttggtatcagggtaatactgacttcatagaatgagtttggaagaattcactcctcctctattttttggaatagtgtgagtagcattagtattagcttttctttttaaatgatttttttttttgagacggagtctcgctctgtcacccaggctggagtgcagtggcgtgatctcggctcactgcaagctctgcctcccaggttcacgccattctcctgcctcagcctcccgaggagctgggactacaggcgcctgccaccacgcccggctaattttttgtatttttagtagagacggggtttcaccgtgttggccaggatggtctcgatctcctgacctcgtgatccacccacctcggcctcccaaagtgctgggattacaggcatgagccaccgcgcccggccttctttttaaatgttttgtaaaaattagcagcgaagccatagagtcccaggtttttttttgctggcatactttttattatagctttgatctcattgttttggtctcttcaggttttgaatctctttgtggttccatcttggtaggttgtgtgtttctaggaatttattcatttcttctaggttttccaatttattggcatatagttgctcatagtagtctctaatgatcttttgaacttctgtggtatcagttataatgtctcctttttcatctctgattttatttatctgagtcttctttctttttttcctagtctggctaaaggtttgttgattttatcttttcaaaaaaaaaagaaattttcattttattgttcctttgtattgttttttaaatttcatttttgtttatttctgctctgatctttattatttattctactaattttgggtttggtttgctcttgcctttctggttctttaagatgcatcattaagttgtttatttgaagtttttcctctttcttgatgtaggcatttattgctataaactttcctcttactactgcttttgctgtatcccataggttttggtatgttgtgtttttatttttatttgtttcaagaaattttttcttttaaaaaaaaatttttaaattttaaattttttctcaatcaatgccatgccagaatttcaagaaatctttaaagttgtttcttgatttcttcattgattcactggtcattcaggagcattgtttaatttccatgtgtttatatagttttcaaagttccttatgttattgatttctcgttttattccattgtgaacagagaaaatacttaaaatgattgcagtgttttcatagcctaataaatggtctgttcttgagaatgatccatgtcttgaggagaagaatgttaattctgtagccattggatgaaatgttctgtaaacatctactaggtccatttggtgtatagtgcagattaagtctgatgtttctttgttgatttgctgtctggatgatctgtgcaatgctaaaagcagggtgctaaagtctctagctattattatattaggatctatctctatctttagctctaataatatttgctttatatatctggatgctccattgttgagtgcatgtatatatttataattgttgtattatcttgctgaattgatgcctttatcattatataatgaccttctttgcctatttttatagtttttgacttgaaatctattttgtctaagtatagctactcctgctttttttcatttccattttcatggaatgtctttttccatccctttatttttagtctatgtgtgtctttataggtaaagtgtgttttgtgtaggtaacagataattgggtcttgtttttatatccattcagccactctatgtcttttgattggagagtttagttcatttacagtcaatgttatcgttggtaagtggggacttactcctgccagtttgttgttttttggttttatctcccttccttccttcttttctgtcttcctttttgtgaaaatgattttctctggtagtatgttttaatttcttgctttttattttttgcatatctgttgtgggttttttaattcaaggttaccatgaggcttgcaaataatgtcttataacccgttatttaaaactggtaacttaactctgattgcaaaaacaaagaaactaacaagccaagggaaaactaataaaaactatacttttacttcgtccctgcctcttacttttaactccttgtggtttctgtttctatcttattatactatctatatcttaaaagttattgtagttgttatttttgataggttcatctctttagtattcctactcaagatatgagtagtttatacaccacaattgtagtgttatagtattctgtatttgtctgtgtactcactattaccagtgagttttgtatgttcagatgatttcttattgctcattaattccctttagcatttcttataggacagatctgttattgacaaaatccctcagctttcatttatctgggaaagtctttatttctccttcatgtttgaaggatatttccacaggatatagttttctaagataaacatttttttctttcagtactttaaatatgtcatgccattgtttcccggcctgcaaggttcccactggaactcctttatgtgttacttgtttcttttcttttgctgcttttaggatcctttctttatccttgacctctgggagtttgattattaaatgtcttgatatggtcttatttgggttattctttttttttttctgtcttctttgcttttttttttttttttttttttgagataggttctcactctgtcacccaggttggagtgcagtggcatgatctcagctcactgcaacctccacctcctgggctcaagcaatcttcctgcctcagcctcccaagtagctgggactacaggtgcaaaccaccatgccccactaatttttgtggttttggagagatggggtttcaccatgttgccgaggctagtcttgaactcctgagctcaagtgatccacccacctcagcctctcaaagagctaggattataggcatgagccaccactccaagcatgcccatgtattttcaaatagcctgtcttgaagctcactaatactttcttctgtttaagccattctgctgtagagagactctgatgcattcttcagtttctcaattgaattcttcagctccagaatttctccttgatttttaaaatttatttcaatttctgttaaacttatctaataggattttgaattccttttctgtgttaccttgaagttcattgagcttcctcaaaacagctattttgaattctgtctctaaaaggtcgcatgtctcggtcactctgggattggttactggtttcttatttagttcatttggtgaggtcctgtttttctggatggtcttgatgcttgtgaatattcatcaatgtctgggtactgaggagttaggtatttattctaatcttcacaatgtgggcttgtttgcactcacatttctcgagaatgttttccaagtactcaaaggaaattgagtgttgtgatctaagtctttggtcactgaagccatatatgcattaggaggcaccccaatcccagtaatgccatgactcttgcagacttgtagaagtactgccttggtagtcttagataagaactgggaggattccctggattaccaggcagtcttctattctcttccctactttccctcaaatagaatctctctctccattctgagctgcctggagttgggggaggggtgacacaagcactcttgtggccaccattgctgggactgtgctggatcacacctaaagccagtaaagtactgggtctcgcccaaggcctgtgtcaattattgcctggctattgcttatgtttactcaaggcctaagggctcattagtcaagaggtgatgaatcctgccaggcttgcgtctttcccttcagggcagtgggttcccttctggcccagggtgggtctagatatgctgtctggaagctaggacctggaattgggaactttaggaatctatttagtactttattttactgtggctaagctggtacccacattgcaagaaaatgacctttttattcttccctctcctttcctcaagcagaagtctctcttttcctcaagcagaagtctctccccatgtccaccaccaccatgagccccaggtccatggcaacaactgcctggctactgctgatgtttattcaaggcacaaggaccctttagtaagcaggtgaatcctgtcaggtctttgtatctcccttcaggacagtgggtttccttcagacctagggcagatctacaaatgccatccaggagctaaggcctggaattggggaccttaggggtctgtgtggtactttattttaccatggctgagctggtacccaaattgcaagacaaagtcctttttacttttccctctcctttcttctagcggaagctgtctttcccatggccaccataggtgagaacgtactgggtcacacctaaaagcagcactacctagctgtgtgatcttgagcgaattactcaatatcatcatctgcaaaatggaaatgatagtaaatagtacctttctcatatgattgttataaggattaaatgagttaacatgtgaacctggtatattattagctactgtaattggttgtaaaagtctggatatacctaatggtacactttttaaaaaatctttttgcctctaatattacaggttgaatgtcaggcatgccatctcttttcaaatagatttaaactaaaaacattattaaagaagaaatgagagattgctctggctacaggatgaagaaatgatcagagtcagggcaggattcaccaggagagcaactcagtagtgagttccagttagttctagaggctatgatgcagctatcttacagataagcacgcggggcaagttgctaggggaacccaggctctaaaattgcagttgaagtaggtaagctctaaaattgcagtaggtaaaaggtaatatgggtaagataattgctgctggtagaactcaatgagagggaaggcctgggggagactgtcagtagtgaacctggggcctagaggcaacaataaaagtaatgcttattttcagttcctgcagtctgtggctccttcaaacatattcctgagggcaaaaggtaactgaccttagggtgaggtagttggacgacagagtatataggtaaagcaaagaaaggcattgtagagctacacacagcatttgcaaagccataaaatgtgcaacagatgtactcagaactcccatagttcagaagcggggtggatagcaatgagagaagagaccccaggagaatggagaaggggctagattatgctgtcttgtatgctatgcatggcagcctctttttagtgcctgcttagtatttatctatccctcagggaatatgaccctattcctagctcaggggtaaatcctgatagtctacaccaatcataataatctatttcatttcctagcattggtttaggtgtgtgtgtgtaacccagtgtagtcaatgagacatagagaaaagttgcctaggaggtctttgggaaagatttcttcactctattatttatatatatatagagagagatggtgtcttgctgtatgtattgcccaggctggagtgcagtggctattcataggtattcattggtatgaccatagccttgaactcctggcctcaagggatcctccagcctcagcctccttatagccttggacttcagctactggccaccatccctagctggtttcttcactcttaaaggatacctaaggaatagtcagtctcttttcttccactgatgttgatgtctgagatgtgatgcctggaaatagggctactatgttgtgaccatgaatggatctagcctgaaaaccaagctcgaatactccaagaatggtagagcagagatagaacaaactggagtcatttatgtcattgtggggcactgcatcagccaaacataaaggtgctctacttggtaacctcttgctatttgagataataaatgtttcctattgtttaagccaatctgagatagggctttctgttatttgtggctgaaggcatggtaattgaaacaacatgcaaagaaacttagccttatcatgtagggaacatgagatcaaaaaaagatctttaagcaagaagtgacaatagcatttttttgcattgtggactaagcagtctgtcaaataaattcactataattttaacatttaaatgtaccccaagttgattttgtcccatgatataacaaataccatatgttatattacatatgccatttagtttgaagtaaatttacaaactggaatttaaaatgataacgtctactctgctaatgatgttgagtatgtactagaggaagtgagagtgaagaaaaatgatcagttaagtccatgagaagtaatgagaactttaatgaggaggaattgatgaatcaagaagcaatatcatctggacttagtgatgactggtggtaaaaggggaggattacaaaatgattccaaaatgttgggcttggatttccagggctctatttaccaggagaagagcctgaagaaggttttggttgcagtgaccagaaacctaatcaagctagctaaggaaggatacaggagtatctctcagagcccagagcaagaagtttcactgggcctcagccagagtagactgagccctagggaactggattctacctgttctgggtgatggcatatggtctgtcatttctgcttctctcagcacatcagcctcattttctccagactggttttctctgttgggcgtggtgatcttatagttatcccagccccagctttcttggacccagcagagactaactcaggtcttctatgtttcagttccaaactctcgggagagagactctaaatagtccatcttcgatcaggtgcccattctttgtcctgagagttctggttgaacagctaaattagtggtttgtaaggcaattcctcccaggattataagagagcatgtcctctaaaaggggatatgggaatagcgaaacagtaaattgatggaggagatgattacatttcaagtatattagtggctacaaatgatgaaacagatagggatgggagcaaatgataaattaaaatttgaatatattaattttgtggagctcaagggaccatcagtggaaaatgtcttttaagcagagatctgaactgaagttggaaaggtgacaccatcagaatgtaggtgggaataaaaaaagaaagaaggctgggtacagtggagcacacctgtaatcccaacaatttgaaaggcagaggtgggaggattgctcgagcccaggagttcgaaagcagcctgagcaacatggtgaaaccccgtctctacaaaaaatacaaaaattagctgggtgtgatagcacacaactatagtcccagctactcgagtggctgaggtgggaggatttcttgaccccaggaggttgggcctgcagtgagccaggatcgccccatggcactccagcctgggtgacagagtgagacactgtctcaaaaaggaaaaaaaaaaaagaataatgagatatgagacagacctatcagaaggatcacatagactgagaagaggagagtcaaggtttgtgctaccagacacactgatttgtttttattttatctacttttaaagtaatgaatagttcaatttttagaatcttgaaatggtatttataaagagtttccttcccacccgtgtcccagccatacatttcccttccctgtaggcgatatcatcatttatatcttttcaaagatcagctgggcgtggtggctgacgcctgtaatcctaacactttgggaggctgaggcggaagggcatttgaacccaggaactcaagaccaccctgggcaacatagcgagaccctgtctctacttatgtgattatatatatatatattttctaaataaaaaatgttaaaaaatgataatctatgcatgtaccagtaaatacctttattatttctacaccccccatatttttcaaacacaaatagtaatataccatttacttaacttatttaaacaattccttagtgatggatgtttaaagtgttttcaacttttgctattatgaacaaaacaacaatgaataactggagtgcaattttttttaaagaaatgggtgaagaagataaactaatgaagagccttgaggaggtcgtcaatggctcttgctcccacagtgccactcaaactacagtaacaggagccatccataatctccaccccagctcgtctctcttggacattgcatgctgtcatgcttctcccttggctgtcacacccccttcccattggttttccactcgcttatctactctttgccagacccctggctcttgtctaaatctatcctgttctttttctttttctttttttttaaaggcagaatcttgttctattgcccaggctgaagtgcagtggtgcaatctcagctcactgcaacctccacctcccaggttccagagattctcctgcctcagcctcctgagtagctgggattacaggcgcatgccaccatgcccagctaatttttgtatttttagtagagacggggtttcaccatgttggccaggctggtatagaattcctgacctcaagtgatccatccgctttgacctcccaaagtgctgggattacaggcatgagcccctgtacccagcctaaatatcctaagtgaggcagggcaactgcaagaagttattctgtggttacacctctggaatctagaaaggcctttaagtgtaaacccattatgaaaactaacaatctcactaatagggatacattaatatcattcctcaatatttactagccatgtgaccttggacaaactcattgacctttctgagccttactttcctcacttgtaaaatcaaaagaataatagtatccctttcatagggtggttgtgaggatgaaatgaaaagatgtatgtaagcactcagaaataatacttggcagtcgcactctttgcagaagataatgaaaagcatttcatagtaacagctcattgcatttcagctaatatagagctatccccagatgggcacctgggaattcctttccccatctttgtctttttgtcttttctattttaccctattgcacatcccccagggtccatgcttcatcctgccagagccacaggaggttcaaggccaaagtcaagttgggaagactgaaggtggcttcttacagctttccatggcggtttctgcagacaaataaatctacttcaatccacttttatactaaattatcctctttctacctagggtggggagatctctgtctccctgcagtttaatacaatagcttgaaggataaggactaagtaaggaggcagataatgtaaaagtagactatactttttgaaaccttggtagtgaagagaagagagacagaaacactaataacagggttaagattgcaatcatttgaaatttaggcttatttacagtctattcgatattgtatgttgaatgatgcagtccaagctggggaatataggcttttgtagaggagtatgcttctcttctagaccagagaggtttgttcattctggagcactcaaagcaaccaactccaacttcaccaaagtagaaaaaccagcctcttaacaaagaaattctttgcagtccttggttcccatggccaattttaaagtcaaaagacctcaatacattttttttgcttttatcaatttaatacattcacttactattattatctgccttcaaaaacatctgactttagggatgacagttttcactatcctggggagttaaccttaaaactaataagtgtctctatggtgcagccaaagttacaaagccagactgaagtctgcagataccaatgatggttggtctttgtttaaccactaatcactaagagacctcactcccaggggtcttaaatgttagggtggaagatggtggatcagtctacagtacttacttcctgacagcaagtcagaaagttgatctttttttcatttaaatttaatttttattttactgtagtaagaacatttaacatgagagctaccctcttaacagatttttaagtatgcaataccatattgtcaactataggcacaatgttgtacagcagctttctagaacttattcatctcacataactgaaactttagcaactccctattttctcttcccctccttctgcttctataaatttgactattttaggtttttcctgtaagtggaatcatgcaatatttgtccttctgtggctggcttattttacttagcataatgtccttaagtttcatctatgttgtcacatattcaggatttccttctgttttaaagctgaataatattctattgtgtatatacaccacattttcttatccattcatctattgatgaacatttaaattgtttccacatcttggctattatgaatagtgctgcaatgaacataggagtgcaaatatttctttgagatcctgatgtcaattctattggataaaatttctgaaataaagaactcccacaactcaacagcaaaaaaactaacacctgattttaaaatggactaaggatttgaatatacatttctccaaataaagacatacagatggccaataggtatattaaaaaatgttcaattccactaatcatcaggaaaatataaatcaaaaccacagtgaggtatcacctcactcctgttgaaatgactgttaccaaaaagacaaaagataagaggtgttagtgaggatgtggtaaaattggaacacttgttcactgttggtggaaatgtaaaatggtacagccactgtggaaaacagcatggaggttcttcaaaaagtgaaaaatataacatataatcagccatctacttctgagtatttatttaaaaagttgatcttgattgacaacccgaagttagacaaaatgtgggaaaactcttacaccacacattcagtctcattggatggcagtttatttagatgtatcaaattgttttgacccagcaattctacttcttgtattgaaagctgtaagtacaagatgtatgtacaaggtactacagatgtatgttctttgcagcattgtttgataaatgtatccatctttcactaaaaataaaactgaaagcaaccaaaatgtttgtaagtatggaactggttttatataatacagccaccaatattacataatacatatgttaaaaagaaaaataagagtcaatttttatttcagagacagggccttgctctgtcattcaggctggagtgaagtggcatggtcatagctcactgcagccccaaactcctgggctcaagcaatcctcctaccccagcctcctgagtagctgggactacaggtgcatggcattaagcctggttaattcttttttcatttttttttttttagaaatggtgtctctctatgttgcctaggctggtctcaaactcctggcctcaagtgatcctcccatctcagcctcccaaatacgtttttttgtttgtttgtttgtttggttggttggttttttttgagacagggtctcactttgtcacccaggctggagtgcagtggcacaacgttggctcactgcaacctccgcctcctgggttcaagcaattcttctgcctcagcctcccaagtagctgagattacaggtgcctgccaccacactgggctaatttttgtattttgagtagagacagggtttcgccatgttggccaggctggtcttgaactcctgacctcaggtgatctgcctgcctcggcctcccaaagtgctgggattacaggcatgagccactgtgcccggccccagataagtattttacatatataccctcatttgatattcacaacagctctacatgtaaggtaatcatacatcttgatttgccagaacagtctccatttatacctgtcacaatataatgattagtagtgcccccttcattctcaaaagtacctctcttggacagtaaattgtgtggtcaccttatctatgaggaggttattgtcatcaccttattgaatagctgaggaaagggaagtgttaagtaactttcccacattcacacaagtagaaggagagaccagcagagatttaccatgatgtcagaatacagttctgaatttcttggggcaaagaaatgttgcctgtctctctaggacgccatcggcttccaatcaaagcttgagaaatcagccctggaaaattgggaaatgctagtggcaggcttgcagatggaaggcagtgtaggacagttaagtctgtccatttcctcataaaagtatatcattattccacctgagaggtttttatcatcatccctaggagctcatcacttttctttgccaacctttggctccctctcaggaattaaggcctggttttacctttctgtgttggcattttactttttttttttttcccaccattccatctgttctctttccctgaactcccaacagaggtgatgctttgagggcagggataatcatgggcataatgatatttatctaacttatctatactgtgctaggatcagtccagctaaactaggtaaattcctcttgtgtttactattttactgggagccaacttatctggaaaggctgaacagtacagagaaaagaggctagaatttcaggaagttaggacatattcattggtgaatatgttggctgccatattgttatatcatgctcaaaataaccctaaaaggtaggcagtattgtcctaattttctgatgtggaaattataaagcacataaatatatctcactaaattcaaacatatgtatccattcttaactcttccttaacttggtattccaaaatgctcatcgccaacccaacagaagtcagagaggaaaacaacaacctttactgattgcagttgaaatattctacttttataaattttacaaaaacatatggccttgggccaggcgcagtggctcatgcctgtaatcccagcactttgggaggccaaggcgggcagatcaccggaggtcaggagttcaagaccagcctggctaacatggtgaaaccccgtttctactaaaaatacaaaaaattagccgggcatggtgatgcatgcctgtaatcccagatactagggaggcagaggcaggaaaatcatttgaactgggaggcggaggttgcagtgagccgagatcacgccattgcaccattgcactccagcttgggcaacaagagcgaaactccatcaaaaaaaaaaaaaaaaaaatacttgtgaacacgttaatataattcctccaggaccttggaaagttcccatgaattgagggtcctgatgtttaagatttattagtttcatgaaaaatctgtaaatccatttctgataacggagatagaatttggtagatgagggagaaattccaaacttgtgtgtcactggcagctggtacataaagaaattgatactgtaagccttcacagtggcagggtagggcttggcgacttgcctcaggctgtggatcaaagggctccagagtgtgggatctaatggcatagactgtggtccctgcagagtaggtagtgagcatggtgagtaatgtctgccactcactgcttcctgtgattaacagaacatgacaattaagcagaatgtactactggccattatggaaaaagggcctgcagaactgccaggggagtttgtgttccagatgaagggaggctgacttgggactccacagttctaagggatggcctcaaacctgtctttacataagttggccacttctgtctatttgttgcttaggtaccctcctattagcatccactctagctgcacagtaattataatcactgtgtataagtgttctgtgaattagagcttcaagataattttgaaatagttgagatgaaaagttagactagattagaaatccatctcattatctcaagaaatgcaccattacatttgccaatgatgttaggttgaatataacatcaactgtgaatataacatcaactggctgggtgtggtggcccccgcctgtaatccccgcactttgagaggccaaaacaggtggatcagctgagatcaggagttcgagatcagcctggccaacatggtgaaaccccgtctccactaaaaaaaaaaaaaatacaaaaattagctgggtgtggtggcaggcacctgtagtaccaactactaggaggctgaggcaggagaattgcttcaacttgggaggcagaggtagcagtgagctgagatcgctgtgtcacccaggctggagagcagtggtgcaatctttctcactgcaacctctgcttcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcaaactgctgacctcagttgatccacccgtctcggcctcccaaagtgctgggattacaggcgtgatacattagatagattgagttttaggttcctgtgggaacaccgtaggagacattaagtggtgtctaatactggaaagtgctctgtagatatacatttggagcttgtcagtgtatgaaaggtagtccaagtcatgggaatggatgagtttgaccaagacactggataatgggaagacaatagagccaacaacagaattttgggatcactactttaatattacgtgccagagctgtttgtatatacagtggtttctttcataaatgtatttgggaggaaagcatttttagcaaatatgaaattgctcctgtaggggagtatcaagttgcctagggactgtgccctctccatttaagagtctcagccgggtgcggtggctcactcctgtaatcccagcactttgggaggctgagatgggcggatgacctgaggtaaggagttcaagatcagcctgaccaacatggtgacaccccgtctctcctaaaaatacaaaattagctgggcgtggtggcgcatgcctgtaatgccagctactccagaggctgaggcaggagaattgcttgaacctgggaggcagacgttgcagtgagccaagatcgccccattgctccagcctgagtaacaagagggaaactccgtctaaaaaaaaaaaaaagagtctcaaggttatctagttgactgaggagggtggatggtggtgacagacttcaggatttaacataatctttctggttgctccttctctgactcttttgctgactttcactattgaaaagcatgcacactgccaatcccattgctttccctgctctccctttattgtctcccttaaaaagtcagtggtgtgtggcaagcagggcatgtaccttgaaaataggcagacccggtttagaatcccagctaactgtgcgcatgggcaaattacttagtctctctaatcctctgtttttctcatcataaatctgaactaacaatatctgccaggcagggttgctgtaaggactggaaacagtatgtaaaagcaccctgcaaaaaacctgatgtactgaagctgtgcttaccatcatcagacaggtcatctaccctaaaggattttttttcttgttccttctttccgcaaaaaaaacacaaagaatctagtctgacaaggattttgccctgattcaataaaaatgagactggattttcatattgttgaagagatgatgaggactcccctttaaaaccagagatgctaaaatccttaaattatctggaaagattcttactaaattttgctgataaagaatcaatactgaagatttttttttgtctctttcccttctctttttggggaaatcagaattcctgttctgaaatgtaagtagatctttatcttaaaaataggttgacaaggacatctctctcctttttctttaagcagatggtaatttgtgattttttccccctggtgctggattccgcctggaggtattaggtgtggacattaggacatggtcaatgttccaccataattccttaccagtagataccagtttctgcaaataacttctgcattgaaattttgagttctaggctgggcgcggtggctcacgcctgtaatcccagcactttgggaagctgagacgggccgatcacgaggtcaggagatcgagaccatggtgaaacctcatctctactaaaaacacaaaaaattagctgggcatggtggtggacgcctgtagtctcagctactcgggaggctgaggcaggagaatggcgtgaaccctgggaggcagagcttgcagtgagccgagatcgtgccactgcactccagcctgggcaacagagcaagactccatctcaaaaaaaaaaagaaagaaattttgagttctaatattactccttcactccacttccatgtttttaattaggttctggccattttacctagaaacaccactgctcctcacactagacacttttaacactggtagtttcattgtcttcctctaagctctttcttctggctgtccaaatttcttcggtaccattattctcctggtgatacaagttcaaaaatcaggaggctgggtggctgaaaaacatgatcaaagaccctgatcattcctgtctctctgttcactcatcttcatcttcaggccagctgccctcttggttacaaaatggctgccagagatctaggcatcaccctagatactccaatgttcagatgaagcagacagtagtttctcttgtatgtgtaatatgaataaagaaatatttccctaaagtccttcagcagacgtctcacatctcattggccaaaacatgctcattttaaaaacaatcagtcactggtaaggagtatagggttgtcatgattggcttagattaatcaagatatggccctgagccagggatagtgtcatcttccctgatgtgtagatacccaaataaaactggagttcttctaacaagaaaaaaggggaaaatcaaaagaagtaagatatatgattctggtttccttctaccgtcttagtccaaaccccagaccagcgtctcaaggacagctgtgatagtttcccaactggtctccccacattttttccatcacaattttgttggatttatcttccagaaacactgcttttccacttagcccttttgtttaaaaatgccattggttctctctaaccttcagaaaaacattcaaacataccatagaatgtttaaaccatagaatataagagttagaaggcccagcgagctttgaatgtcaaaactagcaccaagagctagactagaaaacatggacgtgtggtcttagctaaacacctcttttgcttaaccaaaggaacagtatacagaaatctccctaaaagaacaatcttcaagctaagttaagtaactttctaaggaggtgtatcagtacagattcttaagagaatcaattttggcttgttctctctgaaggctagccttaagtttcatacaaattcttttttttttttagatggaatctctctctgtcacccaagatggagtgcagtggtatgatcacggctcactgcaacctccgcctcccaggttcaagtgattcttcttccccagcttcccaagtagctgggactacaggcacgcaccaccatgcctggctaatttttgtatgtttagtagagatggggtttcaccatattggccaggctggtctcgaactccggacctcgtgatccgcctgcctcggcctcccaaagttctgagattacaggcatgagccaccatgcctgggcctacaatttttatgtgtgtgtgtgtgagagagaaagagataaagaaagacagacagagagagagagagagacagagacagagagagagagacagtgtcttgctctgtcacccaggctcaagtgcagtggcatgatcatggctcactgctgccttggcttcctcagctcaagcaatccttccacctcagcctccccagtagctgggaccacaggcctgcgcctaccatgcccagctaatttttttttttttttttttgtagagacgaggtcttactatgttgcctaggccggtcttctactatgttgcctaggcttaagcaatattctcacctcagccttccaaagtgcgctgggattataaacatgagccatcatatccagccaaattctttattttcaccttccattgcaaaacagcctatcttctccttacctgtcttgactcttaccttggtacctccaaaatcttgagacctctggggaataggggagggggaaacaaagggaccatttgaagtattggctcctcccatccctggcctctctggttattgtcaaagaatgcataactctggagagagagacccatgacagcaaagtaaagaacacttcaaatgctaaaaatggagtctgctttttgttttcacttattttcaaaacaaaattctcaaaacctaggaggggccattagctggaaaaaatgtctctgagcagcagatgcagtgccagatactgatgctgattcagggctgagtgatgcatccataccaagcacataccaaattttcacatgcctttccgagtgtcattcaccttttgtagaatgcagtgtgaatgatccctctaaaattgggggtaacataaaaatagttttaaatttaaatggaatgttttctgaggttactacattctctactacacaagatagaattcatggattaaaaattcacctgatttttttacataacgtacacatcattgaataaagtaattaaaacctacttctatgaaattacgtcattgaatatttttccagtgatagtcaattctcaacttatttcttcttttaactgatttttaatttttattttttttaaaaaacagagacagggtctcactatattgcccagactggcctcaaactcctgggctcaagtaatcatcctacctcagcctcccaaagtgctgggattacaggcgtgagccactgtacctggcctatttcttcttttaaaacatttatttttactcctattaacacaaagtaacattatatgccagctgccagacttcatttttagcaattcatactttttctttttcattaagtagataggaaaagttaacaataaaagttctaaaaacagctggatgtggtagcatgcgcctgtagtcccagctcctcagaggctgaggcgggaggatcgcttgagcccaggagtccaaggctggaatgagctgtgatggtatcactgtactccagtttgggtgaccaagtgagaccctatttcttaaaaaaaaaaaaaaaaaggaaaaaacttcttccattaccatccatcctcttatatatctttttatagaaagattttttatataaacatttataaaaataaaaagtaggcataaaattagtactctaagttgagatacatgaactaattgaaaatagtcccattcatcttattaagaactatatctctaataaaatgtttctttttaagttatttatattaatttaacatgtatgtgggtcactttgatatttttacaccaataataattgtaataataataagtttttgactctttagaggcttggccatggtagaaactattacctggctcccacaatttgttccaccctccttcgggtacgtaggtagcctacttttccccatcatccttgctgtaacatgtagtcatgtaattgttctggcaacaacatgtgagtggaaatcatgtatgtcacttccaggcctggtcccatgaaatatcttctgtgcttttctttgctttttctccttctaccagctacacgaattgagaatgaggctctaggaaagcggttggcgaactttggtaaaaagccagacagtaactattttgggctttgcggccacataaagcctctgatgcacattctactggttgtttttttgtttgtttgtttgtttgttttttgtttttttgtagccttttaaagatgtaaatctattcttagctcccagagcacacaaaaataggcccacaagctaaaccctttttctaggagacagggaagccataagatgaaaggaattaggttcccctcatcactatgtggtggggagcactttgcttacctggggacctcacccaggactattctgtgagaaagaaataggctttgattgtgttgagcagttacatgctggacctatttgttattacaaatcagcttcataataacacaggaaataaaaaaattacaaacatttttaatgcagagaagtataatataaaaaatgaataataagacctttaagcataataatatagtacattaagataaatatgtagaagtagaataaaaataggagcttagggaaaaaacatctgactgttaaaaaagagctcatttgtagacttttaaaatggatgtggtgggcatcaaatcgcttggatttagattcaattggatatttcaaagcaaattgcaatagtttattttaaaatatctatattaataacatcatgaaaattacaacctttgcaattattcaaacatacgatgtaatattttagatgtcaactgaaaattttgtgaaggagtacatggttttaaaacattctgttaggggatatgccagcagaaacttttgaagaggcttcaaagaacccttatagactcagaaccaaacctcttttgaaagcttcgtagattccctgggctgaatgtacaagcaggggtttttctggtttgcctctgctcttttcgaaatcctgtgtctaggtcaccttagacagtgttcatacacaggaatgtccttgcttgtcaggagtcctgccagcggtgttgagaggccaggtgtagacctgtttcttctgaccttagattccccagtggatcatgaggatgaagctgttttctttcttcctttcaaaagtgttcccttcttggtggttctgaggattcatgagttaaatatttgttaagtttttgcaatatttggctgaaagtacgaagtcttatttattattgctggatggatgaaaggtattatacaagtgcaaagtatcatttcttcccaggacagacggcgttgtcatgcttaatccccaggcagctcatgaccccattctcttgcacggcctcctcatttacataaccagccacaaactgagttgaaaggactcctgcaagaggatttgcactttctccttttcttcagaatgtgtatctgcctaagcagtgggataacttttttcccagactggatcgatattccttagctggtcctgttgcagcaggagtccggtgactggagagaggaagctcttgggcagtgagtaaaaaaagagaattgacttcttttttttatctgtttctgtctactcatcaggccctggacaagtcacttcacctcttgcctcattttcttttcttttcttttctttttttttttttttgagacggagtctcgctctgtcgcccaggctggagtgcggtggcatgatctcggctcactgcaagctccgcctcccgggttcacgccattctcctgcctcatcctcccgagtagctgggactacaggggtccgccaccaggttggacatcagcacctgtagaggggatagcactggatatggaaaacttagagtagatagtgaaggaggaagaggataaatagcagttatggcctcaagaccaactacagcggtaggggctgtggtttgtctcattaatcgccctcttctaagattcccctgaggaggaaaggcccacagcaaccttggatgaactgcgccctgaaaaatggagaagtcagcctgtgtgatgcagtctgtacgcactgtgataaaaaccatgtgggtaaatgcttaggactttcttcaatagagtcactgtgaggacagcagtgagctgacatcttcaccagccacacctgtaaaattgcttgcactgttcacactgaaggccgtggtttcttgtctaccaagggttgagcccagctgggtgctagagctgagccattgctgcccatcgcgggacgcccctaagggtcagctgttgccttggaagcactggcctggtcggggctgagacttttcctggccagccctccttcctaccctcctccttcactattgacagacgtgcattgcaatctgaatactctcctagcttactcaccttctttctcctctttaacttttgcaggcattttccccaatacatctctgctcatctgactcttatcttggcatctgcttcctggtggatctgaactgacccataagccacgcttactagtgattttccaggtaatcatctatttttattcatttttttttcttgattggtagtttgaacatgatattaaacacatttactgtataaatatagatatcattgttggccaatttgctgtaattgaactctccagaggggtttcaggatggttttgctttttctagaaattgtagcagggaagcagaggtctacctttgtctgttttcagaagggcaagtttaccttcagagtttccctggattacttttaatgtttcctttccttttccctcccactggactctagtactggggaccttgtttgtcttctttaaacgatagaagtgcaagttcaagtgaaatgacatttctagaagaatggaaatttcttatttaagtgaagcccttttgagttcagatgggtatgtgataacagaaagagaagagcactcttgttcccagactagctacccactgctgcccaggctgcagagtaatgggactggtgcaggaactcatttgggattttccttggtaagattatgtggtcacaaaggaggttcccttgtaagatgtggggttcttgtatatgtgggggtatattgtatatgtgtattgttcttgtatatgtgggggttcttgtatatgtgtataaccttgtatatgtggggttcttatttcttgttccacaaaaacaaaacccctggcagtggtgaaatagaaaagactgactaaaggtaaaaacttggactctgtacaaaggcctttggtgattttgggtaaaaaaggccaagtctctcccacgccaatggcttgtgttggaggctgtaaagttactcatttagcaaagctgaccagaaagtcaaagggaggattcattagcaaggttgaaatttaccactagattatgcttgtctttccagccaaacagaatgagacttcatggcagtctttttgtggggtgttcaaacactaatgaaaaaaaatttgaaaccaaggtgactttttggtgagtggagtgtctgagggagcttatgtggagaaatcaatgtaactattgcctcagtgttgtcagagaatttattaaaagggatcccccgttccccattggtaactacttatttttttctaagaatgggatccaacacttcaaattttagaccttgagttgtgatgtgaagcaatgaagactcagttttttgttgttttttttgagacacaatcttgctctgttgccctgcctggagtgcagtggcgccatctcggcttactgcaaccactgcctcccaggcccaagtgattctcctgcctcaacctcctaagcagctgggattacaggcgcccgccaccatgcccggctaattttttgtatttttagtagagacggggtttcaccatgtcggccaggctggtctcaaactcctgacctcaggtgatctgcccgccttagcctcccaaagtgctcagattacacgcctggccaagagtcagctcttgacagccccaaaaatctatccttagggcagatagaagagagagatttttcacatgataatgtatttaaatcaggattagacaaagaacttcatccttccttgctgaaagatacaagttgtcatatttaattggaaaaaggcagtcttttacacttatgagagaagtggatacctaaaaatctagaggcttctttccctaaaagccattaaccagtattatttttatagatttaatgccaactaaccagactctgaattattatcatctctagtgttgaactccaggctgtacaatctatacgagggataagccttgactgacactttcacagacagcagttacagaattttttaggaaggtgacaggtagatctcaagggtcttctcattcactttttctttggtatcttatcaagatgttttaattctcttttcaaatatcttcagattcttttccctctggtgaaacagatggcaggtaggaggaaatatacagaatgaactgtgaaatttctcttgtctaaaatcattcacaaaaaatgggagatgatgactcagtagaactacaacgtgcagccactgggttagtgcccatgtagtcctaacattgtttggctgttaagagcttcatgtgatacctccaagtctagaaggactcaaccagagtatcaggacagattgagacttggggcttccacgaatttggagcatagtgggatgctgggttgcctagacatcattagtaagatttttttcataattttttttttttttgagatggagtcttgctctgtcgcccaggctggaatgcagtggcacgatctgagctcactgcaagctccacctcctgggttcacgccattctcctgcctcagcctcccaagtagctgggactacaggtgcccaccaccacgtcctgctaattttttgtattttttagtagagacgggatttcaccatgttagccaggatgatctcaatctcctgacctcatgatccaccccccctcagcctcccaaagtgctgggattacaggcgtgagccactgcgcccggccccattagtaagatttgttttttcctataacaaaatgcatcaagttccaactaaacaatttacaaaataattttaggaatacaactcttaaaaagtagagacccaatgtttcatattaattagaaataatgattcacatcacagaaggattctttaatacacacaagcgctccaataatcagggtttgattgaattttcagtacctccaacacatttaagtttttatttatttaatgagagggaggagacaactaagcttcgatatacattttaggagcctctgtacatcgtatggccattagatgacaaaacatttgtgaaatgatactgtaagtcagtggaggaaaaatgcctttaaaaacagcctctctttccctctctttaaaggaaaagacaaaatagtgtatgctcacagaggaggaagtaattaagagtctgattctgttaggaaactacagaagaaatataatttgaaagccggagagatactggaggggttgagtcctggtgctcttgttataaatcaatggcctttggcaagacataaacttttctaaaccttggttttcttatctgtaaaatagttctagtaaggtgtatctgcccattctcacagggttactatgagattcgtgtgtgactgtacatgtgaagttgttttgtagtctgtaaaatattatataaatatgatttattattattgccatagttgaaatactaacagcttttaatgatcataactagattgagatgtcttcaatcatatggtcaaattaggatgtattgtgtggcagatgctgtatgagaattaatctactctcttatctaagattatctagaaatatatatttttaaagaaaatttagccatttttaagcatgtgtgaattgaactggtgcccacaggcactggctttcttatactcaggtcctctctccaccttgttttggtttggagggctctcttctccttggctccaaaccacaaattaacttttttgaccaggcatgaaaagtgtcctaacttgtgtctggacaatgctgagacagagagataatagtagagcccatatatacttgactcttgtcaccaagaaaaataagacaaggaagagcagtggcttgaacagctagtgtaaccagatctgtgacttatttgggtaaagggaggagttgagtgaaattgtcaaacaataaatgttttaatcaggtggcaaactcttccaagctcagcttgaaagatcacttctgcccttgaacacaatggatattaaaaaaatatgtaccgtatttgttgaatggatggataatattgagcaccttgaaattccccccaccccaaacactgctaattagttctctcatcacacccaaaataatactaataatatggtttgtacttctgagagtgatgattcagtgttatcatgttacacatatatacagatataagcacacaaagagaaatatttatctttttatttctacatagtttttaatataattttagcatctttttattcatttttccatgtttttgaacaaagttataatgatagtattcacagatctttgtttcgtaatttttctcattaaaattataaaaattcttaaaaacatttttcaggttgtcacattgtcttcataaacactttcaaataactatcagaatcttcattgcatatgttaagctgttagatatacttaaccattctcttcttaaatatttaggaaatttctgagccgggcgcagtaactcatgcctgtaatcccagcactttgggaggctgaggcgggcagatcatgaggtcaggagatcgagaacatcctggccaaaatggtgaaacccccatctctaccaaaaatacaaaaattaactgggcatgatggtgggctcctgtaatcccagctacttgggaggctgaggcaggagaatggcttgaacccgggaggcggagtttgcagtgagccaagatgacgccactgcactccagcctggtgacagagcaagactctgtctcaaaaaaaaaaaaaaaaagaaagaaaggaaatttctaatttcccgttattatagatcatggtgcaatgagcaactctgcaatatgccctgatcattaacttctaaaccatactgtatattgttgagccttttcaaaagtgtatttttattttctaggaaaatatctattacttaatatttcccatttaaaaatatttcctccagtcccttgccccaaaatgatagcaaaaatactaaaggataaataacttacataaggtactgaagttaagattaaatatcaaaaattccttttttctctagcccaaatgcattactaaagcaacagataacatcagacaaaagatagtgccttctggccgggcgcggtggttcactcctataatcccagcactttgagaagccaaggtgggtggatcacacctgagatcaggagttcgagaccagcctgaccaacatagagaaaccccatctctactaaaatacaaaatcagccaggcatgatggcgcatgcctgtaatcccagctactcgggaggctgaggcaggagaatcgtttgaacccgggaggtggaggttgcggtgagccgagatggcgccattgcactacagcctgggcaacaggagcgaaactccgtctcaaaaaaaaaaaaaaaagatagtgccttccatcatcattatcatcaaaattatcttccttatcatcatgccagtgatgcatttattaagaacaccaaagtgaaacatggcaacaaaagagtaaatgcaaaaatgagtggcagcaccaattattttttatttaggtatttgcatatttgctatatgctggacactgtgctaaacacttgggatatggtaaattctgaaaacacaagtatcacgtttgatttgtcaaggaactggtcaactcttatcctcatgttgaaccttattcaatagttttctggactcttcattattcaaacctttatctattcaaggtccttgtctgttttgctcctcttcagttgctaatggtgacccaaccctggctctgggaattttctccatactggttcagcaagtcagggcaggttctgccccaagggcttctgggaccacagtcctctaacttagccaccccaccaagtttctaaccatacacctttgctgaaatcagtcattcagaccaagtcagcaacccggaggtagggctgagaagcagctgaagctttcctgaggcaaaaatggcagatgaatagcaggggcaaaatccactgggttaggcatgtacagaacactcctgcatggagaacactttgttaggcatgggagaaacaaaaagaaagtgaagttctcttagacttgttctcagagagcttgcaatcttgttaaagagttgagtccagaagtagctgaaatcgtagtgaatggtgagaaattatctaacaaactgcacagtacactaatgggtgctgaaagaggaatgggcaaaatcatctaaaggtcactatgctctcaacaaggaattgtggccttcttaggagcggtttcataagaaaatttttttttaagatggagtctcgctnnnnnnnnnnnnnnnnnnnnagtgaagtggcatggtcatagctcactgcagccccaaactcctgggctcaagcaatcctcctaccccagcctcctgagtagctgggactacaggtgcatggcattaagcctggttaattcttttttcatttttttttttttagaaatggtgtctctctatgttgcctaggctggtctcaaactcctggcctcaagtgatcctcccatctcagcctcccaaatacgtttttttgtttgtttgtttgtttggttggttggttttttttgagacagggtctcactttgtcacccaggctggagtgcagtggcacaacgttggctcactgcaacctccgcctcctgggttcaagcaattcttctgcctcagcctcccaagtagctgagattacaggtgcctgccaccacactgggctaatttttgtattttgagtagagacagggtttcgccatgttggccaggctggtcttgaactcctgacctcaggtgatctgcctgccttggcctcccaaagtgctaggattacagacgtgagccactgcgcctgacctcataaagaaatttaagctgcttctagccctgcagctatttacagtccagttggggaggcaagagatttctgaggcgaattttacaatacaatatatgccgggcctggtggctcacatctgtaatcccagcactttgggaggctgaggtgggtggatcacctgagatcagcctggccaacatggtgaaaccccatctctactaaaaatacaaaaattagctggcgtgatggcgggcacctgtaatcccagctacttgagaggctaagacaggagaatcgcttgaacccgggaggcggatgttgcagtgagctgagattgcgccattgcactccagcctgggtgacagagtaagactctgtctgaaaaaacaagacaaaacaatgtaaggcagtgttatgtttgattacatgtggaaagagtgaaaaagacaagaacaaggagaatttaggaagaagggagagattactgaacgcctggcaatggagtttggaggacaattttgagcagaattcaaatagcaaagttcaggtaggtgtattaacgaattaggccaaatatgcttgggtcagagcctggctgaagtgggagaaagatactttattactggatcatgtaagaaccagggtcagaaagctatgaagatggcagtgtgttgggaaacctttagtgccagattgatagctttgactcatatacttgtgaacagttgttaaaaaaaacttctgagctgggtaatgacatcataaaagaaggagaccagaaaacagagactggaggcagagaaaccagttaggagaccacttcaagcattttgagataaggtcctgtcgtgagagtgggaagggaagcatggattttgggggacactagaagaaagaatcaatagcatttgccgctgattggatgtgaacagagggaagagaaagggatgactcaggagaagcttcagtaggaagtgtgttgtggggaggatttagaagcaggcatggactttgttggaaagtgtttgcaaatggaaagatttacatatctatcagcaggagtgtgctctcaactgattatcttataaaagctgtggagtttctttatgagatagtcagacaaaaagtatcacacgatttaaaatggcaataccagggagcaactcctggctcacacaggatgcagtctggagaatgcactctgctctagagttacaaccctgggctgaatctcagggttttttgtttttttttaacatggtttcattgtatatatttggacaaaatactttctaactcatcgatccagtttccttatctttaggtctccatgaaacaaaacagccatatttgttgagtgctttattatgttaagcaggctttgtgttaagagctttatttggccgggcgaggtggctcacgcctgtaatcccagcactttgggaggtggaggcgggtggatcacaaggtcaggagttcaagaccagcctggcccaaatggtgaaaccccgtctctactaaatatacaaaaattagccaggtgtggtggtgggtgcctgtaatcccagctactcaggaggctgaggcaggagaatcgcttgaacccgggaggtggaggttgtggtgagctgatattgtgccactgcactccagcctaggtgacagagtaagactccgtctcaaaaaaaaaaaaaaaaactttatttgtggccgggcatggtggctcaagcctataatcctagcactttgggaggccaaggtgggcggatcacttgagaccaggagttcaagatcagcctggccaacatgatgaaatcctgcctctactaaaaaaatacaaaaattagccaggcgtggtggtgcacgtctgtagtcccaactactcgggaggctgaggcacaagaatcacttgaacctgggaggtgaagggtgcagtgagctgagatcaagccattgcactctagcctgggcaacaaagtgaaaccctgtctgagaaaaaaaaaaagactttatttgcaactttttattcttagaatgcacattctacatttaaaaaacatttcaatattttgtggcttaaagcaatatccattttatttgctcacaattctgcaatctgggctgggcttggctgtgcagctctgctggtcttactggtggtcactgatgtgtttgcagtcagccggtggggttggctgaggctgggctcagctcaggtgctgggcagctggacttttccctctctccaagtatctcagggcctttccttctccatgtggtttatccaacagggtaactggacttcttacttagtggctcaggtctcctaaaagtacaaagtggaagcttccataccttcctaggggatgggatgggaaaggcagggaagtggcacaacttcactgccacattttcctggttaaggcaaatcactggcccagtccagattaagtggaaggggctacgtaaaggtataaataacatgaggctgggccattgaaaggcagcaacgcagcagagagactaccacaatattatttccaatttgtaaatgagtaaactgtgacttaggaatgctaagctacttgcataatgtagcagatagagccagcttcaaatattgtgttctaaatcaaatatcaacaaataaaatgtgtatgtgttttcacctagaatcctgtggggtgggtactgttattgtccctaatttacaaaggaggaaacccaagaatagagagcttaaatgtcttgtctgaagtgactcagctgttttgttccagaaattatacacttatccactgtgctgcctcttacgggcagtacctgatacatacaagacatctgtaaatgttatttaatctgaagctgttgttggaatggctgggacaacagcaaatcttttgaattattcactattacatcttatatgctatttgggaactgggagtttttcagttatcctgtgttaagggcaatttccgtttcatacatctactttatctgttgcactatctatttcttgaagcttggaaagaaacgaagactgcatccttgcccatccagttccaacccagattctcactgcccatctaattccaaccctgattctcacctttcttcgggagtgaggactttcctagagtagggctggcctcaagttttcatcttttaatcatcaagtcagccttgtgacttctgaattagtatcattaggttccagtcacttcctcttgttcgatagcttatttcccctgttgttgcaactgtgatggcttctgagagtagcttgcaaagattctactttccaaggagtgacctgtgctagtttcccctttccttttgccagtcctatgggcagaggacttgctgcacagaatcccagctactcgggaggctgaggcaggataattgcttgaaccagggaggcagaggttgcagtgagccgcgatcatgccactgcactccatcctgggcaatagagtgagactccatctcaaaaaaaaaaaaaaaaggatgatacgtgtatgcctgccttagtctaagatggccctaatttcttccagtctatgaggagtctggaattggagccacctccaagtacagataacaggggaagtggctcactttggtggttctgttttggatatggatgcagccattcagggagtggccccaaaattctaccttttccgaggcaaaactatgagtggccttgtcttttccttaaacttttctcctccaaggcagctccagattttaacttcgactttattttaccctgtaaaaatattaaggcaggctgggccgcggtggctcatgcctgtaatcccagcactttgggagcctgaggcgggcggatcacctgaagtcaggatttgagaccagcctggccaacatggtgaaaccccatttttgcttttaaaaaatacaaaaattagctggggcgtggtggcaggcgtcttaatcctagctacttgggaggcagaggcaggagaatcgtttgaacccgggaggcggaggttgcagtgagctgagatggagctattgcactcaagcctgggggacaagagggagacgtcactcaaaaaaaaaaaaaaaaaaaaaattaaggcacaatacgtgaacttgaagaacatacagttctcttttatttaacaaacacttacgtaaccagcccggtgctgtgcgaagtgctttacattgtctcgtttgatttacttaataaactcctatttgaatcaaatggggtggagtaggggcttcctggaatttggcttacctcgccatctccccccaccctttcccctcagtggagaggcaaccagagagaaaagaaattgagctgctctgaagggcaaggcctcctcctacttcccgcagctgtttcgccagacttgaccttcttcccttagctagaggcagggggtctccatccctcgcccagatctagttggtgggaaggtgggtggcttttttcgggtcactggcgcaccctctctacttccagccacctgctcgggttccatcccggctccaggctccccggagggcggcagggacattccaatcctcccacaaccctcacggatgttgcgggggaggggggtgcaattgctcttctcttccaacacccagctttttcttctcaatctctagtggcctgagtcacccccgtagaggaaattaaggattgatgaatggtttgaaagttgtttgtttacaacccacccgttggcgaagccgcatctccagtgacagaggcactttctgggcaccgtctgtgctctagcagacaattgagagccaggcagccaagatgcctcctcgccagaccaaatatggtcacaagagctaagcagcctctcgtggaaaagctggccttgttggtgtctccccgcgccggggcgcacccgggccggccttcgggcagaatcgcgggtcagtgcggcgctccgggtgctgcaggcctcggcgcctggctgcaggggagggcgcggtgtccaggaccggcccttcctaggcctgagcccctcatccgcgtgccctccgccacccccggccttggtttcggtccacaaccccttgatgaaacaggctcaggccactttccctttgatcccgccccaagtccgtggtaaactcaaaggaatgcagatgcaggtctgcgcgggagaggtccgcgcggccgggaggagtgggtggggggcacccgtctcctcttacccagtaaagtacccatcacgcccagggttttctggagccgaggtgggaggaggaggaggaggaagaggaggggcgagcgggggctggccggctagggactaggaggtcatacataattcaacagctcaactttcgggcccgcctctttcctgggggtgggagtttgctccaaactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaaacgtgcgacctttcctttgccatcctgcggttcagcaagccccgagtgcagttattccctccacccctcgccctatcttctcctcctccaggcaacttctttgcttcaagaaagttgcataattctcgaggtcaggagggacccctcccccatcctgctggtcttaccgctgagtgtctgggatctccaggcgggcaattatctgtctcctcgtttccttttccctctattctttctcccaccatctcgccctctcaccctgtaaccctcttacccacttcctccgactttaaataaaaggctgatctgaccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaagtaagtcagcctggagccgaagaaggcaccaagtcacagtgcccaacgcgcgcgtgtgttcgtgtgtgtgtgtgtgtgtgtgagagagagagagagagagagagagagagagaaagagagagatggtgcgtgtccttccacggttatttcacagatatggagagctggaagcagggagtgagtctctgagtgttggaattgtaagggatcagaagcagggatcagaagcagtggtgaagttcatccaccataaaacacacaggtgactttaccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaatcacaagcctgctttgtcactcttcttcctttcacattgttccagctttttgatgtcatgaattttacattagttgaaattttcaaattacaccccacaggaaaatatattctcaaacactagaggaggttgtttcaattgtggtaccctaagataactacattcctcaggagaaaccaggctggaacttgaaatgttccattgaggtcatagggtcaggctatcaaagatggaggttgtgccagcctaaccacttgtttcaggattgcctgcactgccagtgagggaaactcctctcctaagaacttgacttagacttcattttaaagcccatatttctttagtagagtagccttagtgcaaaagtgaagacactatgtacaattttaaaagtttaatcaagcctttctttggcactaatatttgatgctctgattgctatgagagagccctaagaatgaatacacagtgatggatgaagtttactatagtgagcccattgattcataccagtgaccaattcttattacttccccatctcaaggctgttgatatcttgtccaaggagttcttttgttgtttctgagattggtgtaatgctgagattctgaaacagacttgatggtcatttatgccacagctggtcttctctgggttattgagtgatagtttggacatgtgctcagtcctttgacttctaagtagctggtggagtcaagaatatgatgtaataacatgacttttgttgttgttgtttgttgtttgtttttgtttttgagacaaagtctcactctgtcgcccacgctggagtgcagtggcacaatctcggctcactgcaacctccgccccctgggttcaagcaattcttctgcctcagcctcctgagtagctgggattacaggcacccaccaccacgcctggctaatttttgtatttttagtagagacgaggtttcaccatgttggccaggctggtcttgaactcctgacctcaagtgatctgcctgcctcggcctcctaaagtgctgggattacaggcttgagccaccatgcccagccctacatgatttctttctttctttctttctttcttttttagatggagtctcgctctgtcgcccaggctggagtgcagtggcgcgatctaggctcactgcaagctccgcctaccgggttcacgccattctcctgcctcagcctcccgagtagctgggactacaggcacccgccaccaagcccggctacttttttgtattttttttagtagagacggggtttcaacatgttagccaggatggtctctatctcctgacctcgtgatctgcccgcctcggcctcccaaagtgctggaattacaggtgtgagccaccacgcctggccccagccctacatgatttctaaactgtgtttatgaatatatacacacatacgtatggtatatgatcagtataactgtgattattaaaaatatgaaataggagctaggcttgcctaatatctgaggaaaactagacgaaaaagaccctgaaacaaaagcaaaacaaaaaaattcctttatacattgtgttttgaatgattggagtagctcagaactgcctgtgaacaagggcaaaagtggaagttagccttggatttagagaaagttgctgtgatctctctgcccatccccccaaccacaaccactctccaatccaaagcagagtgcatcttcatttcactttgggtagtcaatgaaaatgacagctgaaaaaaatgtgtaagtagtaggctggcctgctctgatgctatccctggaagtattttggccaagtgactaagagaggttaagaatttgtcagtgactattgtctttaaggataagcaatctgccaagagttctctgaatttcttgtagagttttgtttaaagttggaattaggtaaatgtcatacactttgttacacagcctcaaaaggcagtgtatttcagtggattaagtagaagcttgaaaaatgatggtgactcacttggagttacttttcattatgtctgtttattactttacttgccatctatgaaatagggctgaggctagcagatacatttttttttttaatttttttatttttggctggggtagagatggggtttcactatgttgcctaggctagtctcaaactcctgtactcaagtgattctcctgccttggcctcccaaagtgcttggattacaggcatgagctaccatgcccagccagaagaagaatctttttcttgactctgttgggagttgagagctttataagttggaaatcaaaggattttagaatgacaagggtcaattttgtttagtttagtttttgactagaaaattgaggccacggaagggtgatgataggaatttgggaaagtcatgtggttatttaatggtggaccctggactggacctctaatctgttgctgtctacttaggcaacagttttcctttttccccaccgacacctttcccccatgtcacttccttagctaaacaatgaacttaatgggaaacagagcctggacatctaagaagctttaaaaaagccttttgtcattttctcaggtaagattattcctaggtatatgatgtaatcactttctgcaacctcctgaaggcacctttcctgagcattcacagctttcctgtggtgttcaggtgtcctgtggtattcagatattcctttagagtaacaatgaccagggcatggtggtgcccacctgcagccactaccacccccaccccatctctaaataaaaagtttttaaaaattagagtaacagtgaagcagattgaatgttaaaacacctagcctctgaaaaccactgtgttcattcattattcctgctgtcctctcaatctcatgaatcaggctggggtgttgggcaacctggcacactgactgaatactgatcacattaaatttttaaaaggtctctgattataaatagaatacatgctttctatacataaaccagaaaatggggaattataaagaagaaagttatctagcttcagtagaatttcccatctttactctttcgcaaacattcttgtaaaaatctttcatttgagtaacgtgattttataagaaaaaagattttatcctcctcttaaatacaattcagactataacatttggctgccacgtctcatttttagtgacaattttagtgttttgccttttctcaaatgtgtgacagaaaattatttttgtccaagtgatccatgcacttggtaacaaatccaatatacaggaggacatttgttgaaaaacaatggtttccttcacctcctcaaggctcacagagggaaacttttaatttttttcaactgtacccatatttaattcttagattgttaccttcttaagcttaagtaatgtgcttttaccaccatgttttgatttatcaacttttagcacctgatatgaaagtgagaatgtagctctttaagctagttttcttttttctctcccaggtttgatgtttataatattttaaatttgtctgttaggtcaccttttttaaataatcatcttttttttttttttttttttttttttttttttttttnnnnnnnnnnnnnnnnnnnnccttttaaacaaatcagactaataacttggcgccacgtttccttttaagggccattttagggtgtgccctttttcaaataggggcaaaaaattatttttgttccaagtatcccagcccctggttaccaattccatataccaggggccatttgttttaaaacaaaggttctccttccctccccaagggtcccaaaggggcaatttttttttttttccaccggtccacaatttaaattttaaaatggttccctttttaacctaaagaaaggggcttttcccccctgtttttatttttccacttttagccccctttattaaaaggaaaaagtagctcttttaagcaagttttttttttttttccccgggttgaaggttaaaaaaattttaaattggctggtagggccccctttttaaaaaaaccaccccttttttttttttttttttttttttttttttttttttttttttctgagatggggtctgtctctgtcacccaggctagagtgcagtgggaatcatagctcactgaagcctcaaattcctgggctcaagtgatcctcccacctcagcttcctgagtaactacgactataggtttgcaccaccatatttggctaatttatttaacttttttgtagagacagggtttcctatgctgcccaggctggtctcaaactcctggcctcaagcaatcctcccaccggcttcctaaagcactaggattacaggtgtgagccaccacacctggctttttcaactttggatagtatttcttgattccttatgctgtatgtcagtaatgtttggattgctaccagttctactgttcactttttgacaatgttgctttccacattgccaaagccctgaacccataacctgtatttgtgctttgccccaaagttgaccatcttattcgtatatgattcttaaagttgaaaatccataaggccgggcgcagtggctcatgcctgtaatcccagcactttgggaggccgaggcgggcggatcacgaggtcaggagatggagatcatcctggctaacaccgtgaaaccccgtcttttctaaaaattccaaaaaaaaaaaaaaaaaaaaaaattagccgggcgtggcagcgggcgcctgtagtcctactcaggaggctgaggcaggagaatggtgtgaaccccggaggcggagcttgcagtgagccgagatcgcgccactgcactccagcctgggcaacagagccagactccatctcaaaaaaaaaaaaaaaaaagaaaatccataggcaacatttacatgactacaattctgtgaaatgattcattgccttgtgtgtcaggattggattttagacttgcactgtgggtctggttttaggattcctgggccaatcaaaggatgagatatctagccccaaagtcaaatgggattttttgttttctcactcttcatcagttgtttaaatttgtgttaccttttagttttttcatatttggaccatgactttcttaaattttttccctagtatttctgattgccttttaatgtgttcatgcattatttgccattattatgatctcaaaagttttctaggctctcaatcttgtctaacctatcgagtcttctttgtctaagctgtatgccgagattcctttctcgttctgtgccgttctgaactggttattcactaagcccactacagagctgtcatcctggaacttctttccatggctggaagtgctgtttccttttcccgtgtcttcctatttttttggtttatccctcattttgctgcagtacatgcttgagtaacttcttaagaagtggtttgtaggaggtaagtttttcaagtccttttttatctgaacgtatttacttaaaaattgttctgactctggcttgttttttctgtttatctttgaatgacagtataatgtagctgttttcataagggccctttgtcattcaaaaaatactgtctgctaactcagttgtctgtaatgtgaagagagtgatacctgttgcattgtggtttgaaagatgagcatatttaaagcatctggcgcacaggagatgttcagtacaagttagttcttgctttctcttctctctctcccaacacacatagcctatttacccagccaaaatcagaagcagaaaccttggcaataggggtcaggtgatttttgactctggattacagctgtagctttgagggacaacctggatctggagttgaaagtcagttttaagtttaaaataaggagttagagtcaactttcctggttaagagaaacctaaataggaatgctcactgtaagtgcccttttgcttcagcattttgggcagaggatacccaactccatctgagaagtgtctagtttttattgtttggaatctagattgtcactacaaattgagctgtttttgtgtgtgggataggggaggaagaggaaatggagaagggggagatgagcaggaaaggtaattgacatttgttgattacctgctgtatgccagacaaggcagagagtgagagtcagcacatcccagagagatagcaacagaattatatgcatatggaactttttcataaccctagatgcttttacgtatattatttcttttaaccctcacagtgatcccatgaacaggtatatattattacctcattttactgttaagtaaactgaggctcagtgaggttaaataaatgtcctggggtcatataacaggtgagtggcagagatgggattagaactctgtgattccaaaacctgtgttcctgtccttatgccatgctgtctcatgccaattgtgtggcccataattaggtcttgtaattatgtatccttgatgatcgcataactgtggtggtggagtggtggatggatttttagagtttgcttctgaactgagtctgggttatgctatttggaactgtcattgatggtgagatagagatgatggaagaaaacccaaatataccagaaatgggtagtacacctccattgtctatttatattttattctcatcaagatttccaccaaggtgactcacaccactaatcttatcactttggggggccgaggtgggaggattgcttgaggccaagagtttgagacaagcctgggcaacatagcgagattctgtctctacagaatttttttttttttttttttttttgagatagcgtttcactcttgtcgcctaggctggagtgcaatggcgccatctcagctcacggcagcctcctgctcccaggttcagctgattctcctgcctcagcctcccgactagctgggattataggcatctgccacctcgcctggctaatttttgtatttttaatagagacagagtttcacccatgttggccaggctggtctcaaactcctgacctcaggtgatctgcccaccatggcatcccaaagggttgggattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgcctggcacaaacaccacctttgcaagttcattcctgttattgttcgggatttagacggtgaaaggggcgatgatcttccagggccttgcctttgtgccatctaaaagatctttagccagttcagctaatttacaactagaaatcatttgaacttggctgggcgcggtggctcacgcctgtaatcccagcactttgggaggctgaggcaggcagatcacctgaggtcaggagttcgaaaccagcctgaccaacatggagaaaccctgtctctattaaaaatacaaaattagccgggcatggtggcgcttgcctgtaattccagctactcaggaggccgaggcaggagaatcgcttgaatccgggaggcagaggttgcagtgagccgagatcatgccattgcactccagactgggcaacaagagcaaaactctgcctcaaaaaaataaaaaataaaaaaaattaaaaaaaagcattgaactcctgtttgtgttagcatcgtgagtatgtcctaaaagaagaaatgtgtggctggctttatcaccgcaggcagctgacagaatctggagagagaaggggaacacagacaaaccaggccaaagagctggtttcgacctgtggtcctagagcctggatcagctgccttccaccttggtttgccggaagcctttgtaaggtgtgtcctaagtcagtcatttataatatgactaaaggtctgaaatttgcagctgtacagaatgtctgtcagtttctcccattggctgtactccttctggcctcaggaacttggcacaagctgtttcctttgcctggaacattatttccctgctttttgcctgcttaactcctccattaccttcagatatcagcttagatgccacatcctgcaggaacttttccccaacttgcagctcccactctggattagatgctgctgctcctcctcccataggcccttctgtttcctcagtcattgctccactctcatattactgttttttttttgttttgtttagttttggttttcctttttttactgcactgtaacctccatcaggggaagaacgatgtttgtcttgcttggcattgcttaacttgagcacagtgcctggcacatagtaggtgttcgaaaggaatcctgtattatttatttttagccattttcattgtaaacttgcaccctggaattcgtaggagtcttccatgcttggaaatggcattccattgtatctgtgcccctttgactgcaagattaatgtcagagctccagatactaaatgcagtggagagggagatgaatgaaggctgggtgttcagagaagtctcataaaggtgcttagacataaatggaaccttcaaaaagtggcaaagatataggtaggtgtgcagacaagccttccaggaaaaacaggatgggaagagaggtatagaggcagaaatgctgagggtgtgtttttgagactaagaggagcttgtactgacttgtattaaaagataggtgttggttggtagatgattatgcatcccattgaggttctggagcctcagctagggtgggctcattgaccttttgctagtaaatgtcaactttctcactccttagttttgagatacacgagtcctagctttttgtgactgtagcgtaagaccccaccattgtcacctatgttgagatcttcctggttgtttagagaactaagcattttatgctgacttaaaagagtctggaaattatggtctttttatctttccattcatagctccatcctatattcaatttagcaagtacagttccaaaattgtgggtggtctttacttcccaagtaagtgggataccaggctacccttgacttgggaccgcccctgctggatctatcatttctgcttgtaaatgaatagcttttgagtctgcttgttcccagaatactctcttgtggttttcggtactttctcagttcctctgaggctgatcaactagacacagacaaaactgagattctggaaccatagtcatcccaccagggcccacctaggcccagttccctgaggatgccctgcctgggcagccagtggcctccctctcaggaacgcattttctaaactcgaaagttcatgttttcaggtgacttctttaaattaaaaaaaaaagtttttaaagaggtaataaatacatttaaataccaagaacctaaaataagtacaaaggcatttactgggaagagtctttctttcactctcctccagtcctcttgtccccctccccagagcactagtttttttgttttttcagagaaactctttgtgagtacaagcatgcatgtatcaatgtagatatccacctagaccatgtcaacacaacacaatggtagtgtactgtacacactcttctgcaccttctttttttttcacttagtataatatatcttggagttcatttctcttctgtacataaacctctgttttttttaaggaccacatagtattccattgcttaggaatttaaatgtacatcatgtcccctactgatggacatttaattgtttctttctctttttaattaaaattttatatgctcaaacactgttggagggaggaaagtggaaaagaaattcttctgatcttctctgaatcccccatttagaaagtaccattgttaacactttattcagaaatattctttgcccaaagaacagctctccggttcccatctaatttgttagctagctagtcggttatctaatttatctgtcatccactgttctatctgtcaatcagtctgcttatccttcttatacaaggctgatgcatggtctaccaaattcaataaccagttagagtggatgcccaaccaataagaactgatggcatactgctgggaagtaactgattatatagcttagtgctactcaaagtatggtccatggactgatgccagtgtacagttgaattataactggcctatgaagagctagatagagaagttgagagtatttagaaactttatggcaaaatggcattgctatgacatccaagtaggtgaccaatgcaattatcttgtggaacagggtagtttgggtgtgtcactcttgtgtggtgagtcacatgtggtgtgagctatgtataagccatccaccataggactacatactggtcttgacagattggaaataaaaccccggtccttcaccacagatagtttgagaagcagtaatctgtttatctctcttaacgacctatctaatgtgtctgtcatccatctcttaatcaattcatctatttacttacctatcgttttatttttccatccatccttctagctataatttttgcatcaaccaattaatcatacctttcattaacttaataatcattctaagaggttcagtcttaaaatggaaatctatggcacaaaggttgtatataatctgttttctagtacataatatattttatgtctttgtggcttctacagtaactcattgttttaaaattttgctgtggcacatctcaattctgaacactgtacaaaaatccaatttctgttcttttttgtgactagtctgctggtaagcattgccagtgacagactcaggagtcaaaacatggtgactggagaaaaatacacatgctaggttgtttatttaaaaaaaaaatattcatttgtgatggcttttctgcagatattaaaatactgaatatctttctcctagtttgcacttgcaaagcatttcttagcctaggttttcaaaggggcacctgggcacctatcatagttgaggctgcaactgtgtgtgataacccatcagaaaggagaaaacccaagcaaatggtaaatgtgactataatgaacaaacgtaacttttactgacttcatttattttggggtttgtttttaaaaagctggcttttgttataaaaataatacatactcttaccaaaaagtccaaacagaactgaaagttataaagtgaaaagtaggggctgagcagtggctcatacctgtaatcccagcattttaggaggccaaggcaggtggatcacttgaggtcaggagtttaagagcagcctggggccaggcgtggtggctcacacctgtaatcccagcactttgggaggccgaggcgggcagatcacgaggtcaggagatcaagaccatcctggctaacacggtgaaaccccatctctactaaaaatacaaaaaattagccaggcgtggtggcgggcacctgtagtcccagtgactcgggaggccgaggcaggagaatggcgcgaacctgggaggcagagcttgtagtgagctgagatcgcgccactgcactccagcctgggcgacagatcgagactccgtctcaaaaaaaaaaaaataaataaaataaaagagcagcctggccaacatggtgaaaccccgtatctactaaaaatacaaaaattagttgggcatggtggcgtgtacctgtaatcccagttacctgggaggctgagacacgagaattgcttgaacctgggaggtggaagttggagtgagctgagatcaggccactgcattccaggctgggccacagagcaagactctgtctcaaaaaaataagtaaaaaaagaagtgaacagtaaaagtactgcccacctccctgccaccaccaccctgcaaccccaagacacacactaggtttactcctcagaagtaactactgttcccagttacttgtgttatcttccaaggatttattatgcatatatgtatatatgacttgactgataaaaacagcattagtttgtttttgcattgtgggaagtctctgttactggttgagcctcacataacctcaggaccgggtagagtacagacatggattaaattctggagaactggatgcaatgcctgatgggatgtctcagggtgaaaagccttatcggggtaaccatgatctagagactgggatttgactttttggttcaagaaagtgacgtctctgctggcccaaaactggtcaggttttcgaggactgtctgatgtgagccatactggggagaaacagggatagaaattttcattacagttccagaagcacaggtagtgactggaatattctgccactctggaatgaaggtattcataagagtgatttaattgctgaaaagttgctttagtggtgctggaaaagagaagaagtgagatcattttaatcactgaagggatattagcaggtaaatttgacaggatttggtgatggattggataaaggcagcgagtaaagcaggaggaaaggaagatttgcagattgctggctgtataatgtcagggctggtggcgcctctaattgtagcaagccgtactgggagccttggaagaagtggagaaattatttaacatattgagtttgaagtgactttaagatgcccaagggaggaaaatggggtgtagtggaatgtgtataattattcaaatcctggtgtggttgagatttcttagagaggttacagatagaatgagaagaaacaagaagtactgatggaccctgtaaagagatggagagagaagagaaagagaggtaggaggaaatccagagagtggtgcgtggaagccagggaagaaagtctttcaagaagaaagaatggttagctctgtggtgtgtttctcagaggtcaaggaagataaggactgaaaaatgtccagtgaatgacttttccacgaggacactttctttcccaggataggtcataacagggcctgaggtactaattcttatgataattcagataatttagttttgagagacagaaaaataaggaaaataaagatctcaattagataaggtgtgaatacactcccacatagtcccacaagtttccatataacctatagtgtctctcactttattgccgtataccacacgtttgcttgtttaagcatcctattaaaatggggtccgaaatcagtgttttataactaactgagctaagttataagactcgggtaaaaacatgactctaattgatatgatcattacttgctgtgaggaaaattacagtctgcaatcctagcttggtaaaatcttcgtcacaatttgtagtgcacaggactgttattgctggcacacgtcataactaaattacagccataaaaatagcagattatgtttggagagtatcagtaaaaaatttatggttccaaatattatgtaactgtagtttcagataaatgtttatctttcctatctttgtttctccattcactggaactgattttgatacctggcaaaggggactcagattaatgcaagtaagttcgccaggccagtttgccctttcacaatataaggtaaataaaacatgtttaattatatcaaactggtttgagtttggctgcattttgtagttaaagcttgtattgtagttaaaaggctattctgtattttgctaatttgggagcatttggtggccttgttacagatttgggatttgtaaagacatgtgaatttagtaggcgggattaagaatcataaaagaagcagtaaacttgagtgctgctcataaaattacttaggttttctgcagatgcattctctagtgcaaccgtccccactttttgggtctttgttttaggtattatgtgaaatataaccctatgcatatgcaacttttggcaaataaggatttcttttttttttttttttgagacggagtctcactctgtcgcccaggctggagtgcagtggcccgatctcggctcactgcaagctccgcctcccgggttccggccattctcctgcctcagcctcccgaatagctggtactacaggcgcttgcaaccacgcctggctaattttttgtatttttagtagagacggggtttcaccatgttagccaggatggtctcgatctcctgacctcgtgatccacccgcctcggcctcccaaagtgctgggattacaggcgtgagccaccgtgcccggccggatttctcttacaaaattatatcatccaacttatatttgggtattcgtactttcgtgtgtgtgtgtgtgtgtgtgtgacagagttttgcttgtcgcctaggctggagtgcattgatgcgatctcagttcaccgcaacctctgcctcctgggttcaagcaattctcctgcctcagcctcccagttagctgggattacaggcatgggccaccacgcctggctaattttgtatttttagtagagacggggtttctccctgttgatcaggctggtcttgaactcccaacctcaggtgatctgcctgcctcggcctcccaaagtgctgggattacaggtgtgagccaccacgcccggccacattcgtacattttaacataaaatccaaccataaggctatattgtagaaaagcttgaaggaaagaaggcaggaatggagaaaggatcagctacctaaaagttgagctgtagccaagggtatgtttaaaacatctcttttttacctaggcttttaaaaaagtttagctatcttatctatcatctaagaaaagttaaccttgagttattgatcttgcatgtctgcatttgaagtatgaagatgacaggggctgtgctttgggccttggaaagctgtgttctcaagcaaaggtccaagagctgtaatccgtatggtacacagtggaaacattgttctttgtatttgtctgttgctaactttttaataaactattaagtagttggtgattattaacagtaggagcagaatgtagggtcattatggacaatttggagtgtcaacattaaagaaatgattttaaaggttagatcccaattgttgagactttgcctgaaactttggcaggtaagtagagtgagggatggaccagcacaaccttttgtaattattagccgtagtgaagtgagtcaagttttgccacagtgctttttgtttaacctaacaattggccggccctagttaattgttgaaaaccattaaaggactcaaatttcccagttgcacatgcattggaatgtccagcttacctcatgtgtgtgaataaagggccagtggtgtggctaattaaagtgcattgtcctttaagcaaagcgtcagtaacaaattaagttttaagagttctcgaaaggcccttctgaggactggtaaacatcttggtggctggtacatatcgtatggagtctaggtgtgaaagctgctgaaaacaagcattataaacttccaagtaagtgtggaggtgtaaactgatgccatagagttgcttcagctgaagcgaaagatcatatttactgacacttattacaaatgggtttttaaaacaatgtctgttttgtacagtgacagtaaagtctgccaagagtaaaacaaaaagttatattgtggaacaagataaaaggaccctgcataataaataatatcgaatgccttaaaatatgaggtttcatttccaaaatataaatatgagctcctaaatgaatgtttaaataatttggtttttctttgatttgccagtgacttgatacgtaaaataattttggctctgaatatgtccagatctaggccatcacaataaagaatacatctgtatagtaaatacaaaataaagcaaccacaaatgacatcatgttttagtgatagcttaggaattgttttttttattatgatagaccaaaagtagtttattggctataaataatatatttattatctgccagtttctaagagtagcatgatatctctgatccaaactgtattgattctggtcgggctcggtggctcatgcctgtaataccagcactttgggaggccgaggtgggtggattacttgaggccaggagtttgagaccagcctggccaacatggtgaaaccctgtctctactaaaaatacaaaaattagctgggtgtggtggcacatgcttgttatcccagctactcaggaggctgaggcaggagattcactagaaccagggaggcagaggttgcagtgagccaagattggggcactgcatttcagctttgggggcagagcgaaactctgtttcaaaaaaacaaaaacaaaaccaatctatattggttctaacctttatctatagacaaaagcattggtttatgaaaaccatcagagatgcaagccatagaaactttcaaaaagttctttaagatgcaactgtctggatctgataaatagtttcaattgttttgctcttgatctggatgggttttgagcagaggagattgggtgaaattaaaggtttcttaaaattgttgacactggtagagaggcatttatctgaatacagtggggaagaccagagatgttgcttaaagagattttgtaagaaaagtaggcacaattcttgtgaaaagtgggctacgtgaataagggcaatccaagaaatcatgttagtgcccctgtgtagttgtatgacttctgtactttttctttctttctttctttctttctttcttttttttttttttttttttgagacggagtctcgctgtgtagcccaggctggagtgcagtggcacaatctcggctcactgcaagctccacctcccaggttcacaacgttctcttgcctcagcctcccaagtagctgggactacaagtgcccaccaccacgcctgggtatttttttgtattttttagtagagatgggatttcaccgtgttagccaggatggtctcgatctcctgacctcgtgatccacccacctcggcctcccaaagtgctgggattacaggcgtgagccactgcacccagccaacttctgtactttttcaaaggtgaacttttggggaggtgatttcttgagaagtggggaagataatgggataagttgtaaaagtgcccagaaatatgagtttataagagaccttgagagctacatactaatgtagctgtccattagtatgaaagaagaccagacatgttgtccaagctgtctataggaaaatagaagaggtaactttaggttgtcgtggctcacacttataatcccagaactttgggaggctgaggcaggagaatggcttgaggccaggagtttgagaccggcctgagcaacagagcaagaccccatctctataaaaaagttttaaaaattaacagaatgtggtggtgcacactgctatagtcccagctacttgggaggctgaggcaagggggatcacttcagcctatgaattcagggttgcagtgaactatgattgcaccaccgtactctggcctgggcaacagaaagagaccctgtatatatatatttttttccaagataattttagtcttagtctactctgaataacaaagaagaatgatttattcatttagaggcattttaagagcagtctttgtagaccattgctagatctttttggaatgggctgccttgaaagcagagagaatgtaaccatgtgtctttaagtggcattgtttagtggttcttcacggcagcccaaagagaaagtatctggcatcagatttgctggatgtgcagagatgccagtatctctcgtttgagctagcctctgcggtgtttttgctctcaaacctggtggtagagtgacggctttgatttgcttcctgcctgaagcctgctttggatgaatttaaaaacctgtttgtttccccatcggccggctgagccttacccataattcctgaactttgattatgggggttattacaggacaagagcttctttgtaaaagagcatgtttaatactctggggtctagcgtgactagcggatataaattgtatggaagcaattaaatgcgaaggaaatgtcatgtgggctgaatttaaacataacttgcggcattgattttttttttttaacttacactaagaaggatggagagagaaaaaagaaagagaatggaaacaggccaagcgagtcagagaagcacacgcagagacaagagaaaaggagtcatttttaacatttggttaaaagtccaaagcccagagctagcattatgtgaattatactagtattatgccattgccctttaaatgaactctttaaaaacacaaatgtcagggaagtatactgtacttggggcttgtatctctttccagttgctcctctttatcttaaggcatatatgtacatacagcagtgattttttttggaatatgttaataaacaggcctgaaggaagctccgtaaacgattaaagtgcttctttccctagttttctctccttttatgctcacggccactgcatgcctcttttcttttcttttctttctttttttgacaaagtttcgctcttgttgcccaggctggagtgcaatggtgcaatcttggcttcctgcaacctctgcctcctgggttcaagtcattctcctgcctcagcctcccaagtagctgtgattacaggcatacagcaccacgcctggctaatttttttgtatttagtagagacggggtttcaccatattggtcaggctggtcttgaactcctgacctcaggtgatccaccacctcagcctcccaaagtgctgggattacaggcgtgagccaccgtgcctggttgccactgcatatgtcatacagagtagctcatctttgcacttttgattaggagtagtgtgtcatttctcacttgcctagaatgtcctacatccctatgcttggtctattaagacttagccagccccatctcctgtctaatgccttattacaccaaccaactagaagggatctcctcctactccagatccccatagtaatttgatctattggggtaatttgccacttaatcttttctactgtccatcagagtgtcgtgtaaggtttgtttgtaaatgaatgggtttatttcatttctccaacttgccaattcttagaatatggaactggtgttgtattgtccttcatgcctagcacatattggtactagggaatatttattgagattaatgttaatactgaatatgggccgggcacggtggctcatgctgataatcccagcactttgggaggccgaggtgggtggattacctgaggttaggagttcaagaccagcctggccaacatggtgaaaccccgtctctactaaaaatacaaaaaaaaaattagctgggcatggtggcacacccctgtaatcccagctactggggaggctgaggcaggagaattgcttcagcctgggaggtagaggttgcagtgagtcgagatcatgccactgcactccagcctggccaacagagcgagactctgtctcaaaaaaaaaaaaacatactcaatatgctgttaaaataatcaaaatgtgactgggtggtcacaggcagaaattgatgcttttagattagatgtaataatatagcaagtttgatgtgaaattgagtttagaaataatagacaacnnnnnnnnnnnnnnnnnnnngtaggcagtcattcatcaccaccaactagatctgggcgagggatggagaccccctgcctctagctaagggaagaaggtcaagtctggcgaaacagctgcgggaagtaggaggaggccttgcccttcagagcagctcaatttcttttctctctggttgcctctccactgaggggaaagggtggggggagatggcgaggtaagccaaattccaggaagcccctactccaccccatttgattcaaataggagtttattaagtaaatcaaacgagacaatgtaaagcacttcgcacagcaccgggctggtaaatactgatattgattatattttagttgatagttttccctaattcaggtgaaatgaacagtaaaaattatgccactaaaaagagtaacactttggccgggtgcggtggctcacttctgtaatcccaacattttgggaggccgaagcgagtggatcacttgaggccaggagttagaggccagcctggccaacatggtgaaaacttcatctctactaaaaatacaaaaattagccgggtgtggtggtgggcaccttgtaatcccagccactcgggaggctgaagcaggataatcacttgaacccgggaggtggaggttgcagtgagccgagatcgtgccactgcactctagcctggccaacagagcgagactctgtctcaaaaaaaaaaaaacatactcaatatgctgttaaaataatcaaaatgtgactgggtggtcacaggcagaaattgatgcttttagattagatgtaataatatagcaagtttgatgtgaaattgagtttagaaataatagacaacctttgattatttgctgtgatagagagtacttgtcctttatttttattctatatgctatgaactcatagtgacaagaaccaaatcttacctgccttgcataatacttctctcttttttttttttttttttttttttcacttgaaacagtcttgctctgtcgcccaggctggagtgcagtggtgcaatcttggcttcctgcaacctctgccccctgggttcaagtgattctgcctcagcctcccgagtagctggggttacaggcacctgccaccacacccagctaattttttgtgcataatacttctctaatgcctggcccaaagcatggcatgcatagtagggattcatttaacttttgctgaaagaaatataaatgatttttttcttttaaatttctacattatttagattttctggtgactctttcctatgcaataagccaatacatatttatggagcacatactgtgtgccacatactggtactgtgcttagcataaaggatacatataatgtatattttactttagaatatattctattctttgtatttaattcttagcccgactataaattctaaaaaatcagtttttcaagcaaaaacaatgaagatccaagaaaggaaaatttcctggtattaattcaatatattcatctattcccagattatttccacattccacttgatggtggaaatttactaccccctccttgcctttcaaatgatcctaagatcgtaacctttcccaatggagctgaagaggtagagtaggctgtttgggtttcaaaggacttttcaggacacaaagtaaataggggaattggagatatcaacaaaactaattaagtggattgactgtgtcagtagtgagtacagagatgtcagaaaagctagttgtagcaagtatttaaacacagcctcaagttcattttcagtggtgttgccatcatccacaaacttcaaagaaagtttagccagattaatccaggaaaattcattctcctgggaacatcacattctaaattacttattcattgttaatatcttcatttaaaattttgacttgaacttttttattctttacttgtcctttaagatcacacagacccaagatttgataaggttatcatcttttcagatctcagaaaagtgggaaaatgaattcccttttgaccagaataaagggaagaagaatttaaaattataaaccaggtttactttactcatagatggtcatatattcaacattgccttttttttattttaaaaaactgcccaagtcataaataaatgcattcttgctttaagaaattcagctaaagcaatagactttcttgaccctctatccccaatcctgctcatctccccagaaggagagcccatttctcagttcagggactgtccttcagacttatgcatgtagaaaccaatgattcaagtttttcttcttctccttcttccttcttcctcctttctccttcctcctcctccctcttccgcttcctcttctcctcctactcttcctcttcgtcctccttcctcttcttcttctccttctctttctccttctccttctccttctcctccttcttcttcttattctccttctatatattgtaccttaacttcgtttttacccaccactttaaagtattttgttctatgacagcagctagagatcttaatacgttactccatttcatggctatacacagtttatttacccgttttcctagtaatgggactgtaatgttacttaaacctcatctcaaagacctaatataaattaaattctagcttcatttgaatctttcatcactttgaagggagatttttagtaattatcaaaagatatgagatcaaacaagtccaattactaaaaatacaatgcatttgtatgataatttaaacttcttttaaatatggagacccagagcactgtatccccagcactcctgtgagctagccaggagaagaggaacattgtcacaaccacatgaagaagagggtagagcagggcccccttctgctgatttctgattatacagggctctttggtcaagatcacagaatgtgtttctccctcccatgcaagaaaggcagggattcctcctctcctctttagtcttccatccctgctcagagctttttggctagcattgtcaattcaaggtttggcctcagagtctttgatttaagttgtgaggggacagacatggtgaggatataccgtggccgggtctggagggtgagctactgagaatcagggcagggaagaggctcagtggttgctggtgctgaggtagtgtctggaaagcacatccgtgtgaaagggcgaatgccagctgagcatggccttgggtcactggctgccttgcaaacaggagctccacaggagaggtggacttgcacaacagcagcctgacagatccagggtctttcacttgcttctttgggatcctcaccaagcatgtcattcaaccatttattgtgcatggaccttggtagggaataggcattgctctgttttctgatttatttctccttgaaagcccattctcaagggcagggaacatgttttattcttcccagaaccttaggataaataaacgggaaaaaatgagtgaaaaaggaaactttggtgggagataatgaggcttttccttactgctcttatctttagaagctgggtcacagacatcttaatatgcatttacgtgtatttatttaacaaacgtgtacctagcacttactttgtgccaggcattgttctcacactgttcacatttaattatgccaagaactctgacagaaacactatttttatccccactttgctcagaaaactgatgtacagggcatttaaggaacttgaccaaagccgcacactagtaaggacttaaacttgggcagtctgggcccagagccaccctggctctccttttccctctcaccggtcttgacatggttgggtcttcattatttttccctttctggacctctcatctttccttcctctttctccattcctgttgcctccaccctactgtgtgatgtgatcatttatttgtagactgcagcacactagcctctgacttcagtcctttgcacaccacagccaggctaatcttccttcatgatggctctcatcacccttttcctgctacagaactcttcttggtgtcctgtcctgtcagggctgatctcctgcctggttcctaaacctctagaatctgacagtgtgaccctgctcatcgagcctcacttcccttgcaacccatttgctgccacccacagctcctggcagtgcttgtaccccttccctggagcaccctcactcacctcttccctgaccctccatcagttcattctgccatggatttccttctaggtctcacctcctgcctgactacacagctcttagtgtccgctccacccctgaacccagtctacaggctgttggatttcattgttcctggcttcaaaaagcctgattaggtttaaactctttgggggtctaccattatacctagcactgagctgggtcccaaaggacattgttgagtactgggattagtaggtaggacgcttgcctaatattggactttttacttggtttcctcacccttaaatgaagaacttaaaggagataatggccaagtttccttttaatttgcttaaccaattacacttgcatatatattttattttttagagacaagttctcacttgtcacccagagtgtaatgcattggcacaatcatagctcactataacctcaaactcgtgggctcaagagatcctcccacctcagcctcctaagtagctaggactacaggtgtgcgtcaccatgcctggctggcttattttatttttgtagcgatggggtcttcctatgttgcccaggctgtccttgaactcttggcctcaagccatggtcccacctcagcctcccaaagtgctgggattacagacgtgagccactgtgcctggccatacttattttttaacagcttcattgatatataatttacacagcacataattcactcattttaagtgtgtaattcaatagtttttaatagattcaggtatgtacaaccatcatcacagtcaggtttagaacattttcatcaccaaaaagagaagccccaactaactagatagctattagccatgcccctctcctccacattctcatcttcaccagtcttaagaaattactaatccactttatgtctctgtagctttgtttattctggaaattgtatgtaaattgaatcatatgatatgtagtcttttatgagtggcttattgcacttggcataatgttttcaaggctcctctatgttgtagcatacatcagaacttcatcctttttatggcttaatagtattgcattgtatggatataccacattttgtttatccattcatttgttggtggacttttgggttgtctccacctttttgaaaattacatccatttttgagtggaaaatgatcttcctttagtggcttctacagttgccaacagcagtttccctctactgctttaaaggtagggatctgggcttaatggctttgtttgcgttgtgtggatggacaggttggatgcttggtcatcaatgtcagagagcagtcatagagagtactcatgagctttgtaatcagacgtactggtttgaatcatggatctgccacataatgagcttagataacttcaggaagcacgtttcctcgttggtaaagtgggaactaccttgcctgtttccttagagtcagagctatgctagaaactacgtggccttggggcaactcaaccaatgcagagggacctcaaggctataaaaataaataagtaaataaattttaaaaagtaaaaattattttttaaaaagtactctcacgcccgtaatcccagtactttgcgaggctgaatccaggcagatcgcttgaacccaggagtttgagaccaacctgggcaacatagtgagactctgtctctacaaaacatgcaaaaaattagctgtggatagtggtgggcgcctgtagtcccagctactcaggggagctaaggtgggaggatcacttgagcctgggaagttgaggctgcagtgagccgctgtactccagcttgggtgacagagtgagatcctgtctctaaatgaataaataaataaagtgcttaaagttctcaattttattaaggtatcatgcctcacagctcttccctaccaagcatggagcccaggatcaccaccctagttgcagtacccagagtggacctacttaattttgttgggataattcatgtctcccttcgtgtgtgttaatggcctctcttgatcttggatctggatttgtgctccagtcactaccccatcaggtcatttgacaagaatggctatagggagtgaaatgtttttccctctctgagaagatacagcgggagtgtaatttcattctttgtgggataggcaaggaggatgcattgctgttttttggtaagctttacctgaaagtagttatgccagagggtaggtggtgattctgagcttgcttatggttattgaatatccattggcacttatatttggggtttgtacgtgaagactgaaaatgccttttttagtaactggctgaaggagagatgaaatgttaatttgatccaaactttgcttggagagtggtgtttcagaactgattttgctaatgtcattaagaatcaaggaacccgacaattttggattttaggcaaggcctctctctacacccagagtaacaacttaaaaaaattattttaaagtaaggaggttttagaaacataaactcttataatagtggatcttttgagagaatggaaagtaagtcattttcctcatctaaacttagcttctgcccccatgatattggtaggaggtcgagaaatttgactgtgagaattatgtgaatctttattcctcttcctctattctgaccccaggtgagtggggacagctcttgcctggcatttctcccactggcttgacccattaatggcaactgtgaaaaggtcaacatttccaggctgacatactgaccacattttgtgtgggagatctcaacaaaagaatatttgtttctgggaggctgacatccccttttgtccattaagcctgtcctttccatcattagattgtgaaccttgtcagaattaagtagagcttaaaaacaaggaaggaatgagtaaaggaaatttagtttgctacatctaaatgcaaattgtgcaaaaacagatgggtgaggtaagaatggacgtcattcctggcgtgactgcaggtactcttggtctacaccatgatcctggaaaaggaggatttaatcatctgagttattaaccgttctcattaccttaggcattgtgactctgcttcctattgatcctagagctaaggtgccccgatttatatgcaaactcttgtttacctgcccaataagtgcaaaagggcttaagcaggtgactggggcctcacatgaagtgacaagactatttctgcctagaaggtacgggagctgagcgggactgagctggtctgcaggaaaggcaagaagaaattctgattatctgtcccaaatagagccatatcctgtctatgaggtggccagctaggagagtggaaacagtttagatctttgtctttggctactggtccgagagaagttgctgttcttcttttatccttggtagaaaaccttttcttcatccctacctattcattgctagagctggaggccaaagcaaaatgacagactgtaattttatatgagttattttgggactaacactcttataattatggttcacttaaatattataatattacttattgcaaaagcaatttatagggaattggaatttttttacagaagaaaaaaacgcaccgaagattttattattctaatatccttgaagttagcccggtgtggtggctcacacctgtaatcccagcactttgggaagctggggcacgaggattgcttgagcccaggagtttgagaccactctgggcaacatagtgagaactcatctgtacaaaaaatgaaaaagttagctaggcacagggtgtgtgtctgtagtcccagctaccggggaggctgaggtgggaggatcgcttgagtcatggaagtcgaggttgcagtgagccatgattgctccactgcactccagcctgggtgacagagcatgaccctgtctcagtaataatacccttcaagtttttccctatatgtttgcatatatggttttcatattgttatacactttcatgatcagatactccatagtagatgggttggctgatatgaaaggattttttgttttgttttattcctttaatatgtgtcatcaacagtttaaaacttacagggatttttaatactcatttagtgccagttgtctttgaaacaatatttttatcaaagattgttgtgacagagaagaatatcttcatggttttgttttggtcttcacttgggtaacaagttactggtatttggagaacaggagagactattttcctcagatttcgaaatggcaaagcataggagtgaggttggagaaaccacagggtctagcgggaaagtcttttacaggccacactcaagtcctggttggggttagcttcgcttagcagattccccagcgtaggaaatactgacctagttcttagataatctctgaggagtttctctgtaagggtatataagtatcctaaatgaataggtggaaaatacaatataagtacttttgtgagcctgagggactcttctgtaagatcaaagacaaatattttagtttgattgagaaaggagtgaaactttttaaataaacaacagtatttattttaatagggagtctgaggtctttccagtaggagttgggaaataactttttttcctcttaaactcatgctgcacaattaaagaaaaatgttttttctctgaacctttccttcaaatacttggcagagattactgccagaagaatgagatgggcacagtggctgatgcctggtaatcccatcactttgggaggacacgatggtaagattgcttgagcccaggagttcgagactagcctgggcagcatagggagacccatctctacaatttttttttttaaagccaggcagggtggtatgtgtctgtggtcccagctactcaggaggctgaggtgggaagatcacatgagcctgggaggtcgaggctgtagtgagctgttatcatgccactgtactctatctagcctgggcaacagaggctagagcaactctgtctcaaaaataaaataaaataaaataaaataaaaaaaataaaaagaatcatttgtgagacttgagagacttgtaccattggattagaatctttcttggtactaaagtctgaaagagctggacttgagctaggttaaccatccattttccctaaccttcaaaagctcacctagtctatcctgcggacaaggatatatgtgctccacgataccgaaaaagatactgctggggcaagaattagcctgtcatacaaagcaataaacaataccaagagccaaaatttgacttcagtggcagctgtttcctagagcagtatttgtttgagtttccttgttgcaaagcatgcagctcacaaagtgccccaaactggcttaataagttttgtttgtttgtttatttgttttgagacggagtctcgctctgttgcccaggctggagtgcagtggcgtgatctcggccaccgcaagctctgcctcccgggtccacaccattctcctgcctcagcctcccgagtagctgggactacaggcgcccgccaccacgcccagctaattttttgtatttttaatagggacggggtttcaccgtgttagccaagatggtctcgattgcctgacctagtggtatgcccacctcgacctcccaaagtgttgggattacaggcgtgagccacctcgcctggctttttttttttttttcgagacggagtttcgctcttgttgcccaggctacagcgcaatggcgccatctcggctcaccgcaacccccacctcccaggttcaagcgatttttctgcctcagcctcccgagtagctgggattacagacatgtgctaccatggctggctaattttgcttttttagtagagacggggtttctccatgttgatcaggctagtcgcgagctcccgacctctggtgatctgccccttctcggcctcccaaagtgctgggattacaggcgtgagccaccgcgcccggccaataagtttttaatgtcttcagaattttttagaaagcgtcaactttctttaaaaataataggaccctctcaggctacaaatataaggagaagggaaggagacccaccctggagagttttggaggtgaaccccgctgtgatttcatggacaacatggatatctctgtttggtttaatacaaactttgaccagcttgatttgggggcctcctgtagccatagcacacactcttcagttatcaccacctattcctttcttcctggcttctctggcatttccagggggtgcaggaaagggctggtttaaggcagctggcataccttcctttctctcaggcttcctcactcctaggactgtataccatagtttcttcccatcaaaatttcgtgttcctctgctcattgcatttcattgttcagcataaattcagggttgattaccccacatgacaccctacatggctgaaaatggggtggatgtttcccaaaggaaattaggattgtggtcaggagagaaggggaatagatcatgggtttaccttaacaatatgtttaccctaagaagggttgttggataaaatacaggtattcagttaaatttgaatttcaaataaacaataggtaaatttttagttttaagtatatcccagatattgcatgggacgtatttgtactaaacaaattatttattatttatctggaattcatatttagctgggcatcttgcatttttatttgctaaatctgatgaccctaggtccctaagaaacttctcatgtctcattttatgttttttgttagcttacctggcctaagatttctttgctttggagaggtgctggggagtggcacggtgggcaggatattacacttgtgtgaattaagagagggcagggcataaataaagtattggccaagcagctgcttggtggcctcaggacggagtaggtgttcaacaacctgtgcgctgtgtgccaaggttgggcaacaccttgtttttgatactattcttagatgcacctttatgctgtgtgtatttcatcaccccatgtgcctacacattcaatatgggtggttttccaattgatgctcttttgtagtcctcgtgggaagatacctctggtatcttcccttggagtatggaaaaaaaggagtagaattttacctctaaccaaaaacgctcagcctgctttgggattttcaatgctaattactttagtaaagtaaaaattatttttctatactgaacatcacatcagttctggccattttttttttttttacatactatagaatatgtatatacttgaatgcaaacattctctttaaattctagctcaaacaagatattattagcttggttttatatattgactgatttcaactggatggattttaagggaggaaaacccataggaaatatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaagaatggtttatgagtgtcaccttaatccatgagctcaactgggtgtcagacgtctaggaagggagggacttggtaggtacttaaatggtaaactcagggtgctgcatggaggtgattaaggaggtggcatttggtttgagtcagggcttttagtgctatgcatagaacaacttgtttccttttgagaatataattgtttgcatgtgatgctaatttccgctttttttttttttatttggaatctcgctgtgtcgcccaggctggagtacagtggtgcagtctcagttcactgcaacctctgcctcgtgggttcaagtgattctcctgcctcagccttccaagtagctgggattacaggcatgtgccaccatgcccagctagtttttgtatttttagtagagatggggtttcaccatgttagccaggctgttcttgaactcctgaccttggatgattcacccaccttggccttccaaagtgctgggattacaggcatgagccaccataccatgctcagcccctaatttttgctttattaaaacaaaaacaaaatttgagtcactataattctgtcacagaaggcagggatgaaaaagggtagagttggccgggcgcagtggctcaagcctgtaatcccagcattttgggaggcttaggcgggtggatcacgaggtcaggagatcgagaccatcctggctaacatgatgaaacccaagctctactaaaaatacaaaaaattagccgggcgtggtgggcgcctatagtcccagctacttgggaggctgaggcaggagaatggcatgaacccgggaggcagagcttgcagtgagctgagatcgcaccactgcactccagcctgggcaacagagcgagactccgtcacaaaaaaaaccaaaaaaaccaaaaaaaaaaaaaaaaaaaagggtagagttgtctatttcactaacaaccaacttttcctgaaaaaggactttctgtaaagattaagaatggtacgggcatggtggctcacacatataatcccagcgctttgggaggctgaggtgtgtggatcacttgaggtcaggagtttgagaccagcctggccaacatggtgaaaccccacctctactaaaaataaaaaaataaataaataaaataaaataaataaaatgaattagctgggcatggtggcacatgcctgtaatgccagctacttgggaggctgaggcaggagaattgcttgaacctgggaggtggagattgtggtgagccgaggtcacgccactgcactccagcctgggtgacagagtcaaactccatctaaaaaaaaaggttaaaaatgattatgatttctttttctaagtttattaagaaacagtacgtatcagttcattccccttagcagaagcaatgttattttagaaggatgcagcaaacttgatcttatatagtcccaagtgtggctcccatctccaaggtggtagccagcctggacagcttgaagaacagagactgggctgtttggccatgaatgcagcacagaatatagattcctgtctctggcttgtgtgatggagggtggactagtcaggactgttccagctgaagatgacagaggtctagctcacactagctggtgcatgaaccaagtgaggccaaggttggctccagatccagggacttcattagtatcatttagacttctcatctctctgcctcttggccatattgccttctccattggcaggaatatggcctcaggaaggttgggcatccacatcccaaacgagcagcctctaaagggacaagagggcttccctctacccgccctcacccgcccacttcaatgtatgccagtatctgttcatttgacctcctgtgagctcagcagagaagggtactggattgttcatcattcaggaatcacagagttagaatggagaaagatttagttcctcaatggaagtggtcatggtagtggtggggagggatgtggccggacgaagggaagtgattctgggcagacgataaccacatactttctccacagagagtgatgcaagccacatgggagatagggaccctagccttaaccctgtagcctggctggagagctaagcatatatgcaagagagcacaacattgccaaaactacatgaaggtaacgaggagatgcagaattaagtgcagccatgaagcatggcccttcagaaaggactgtgaggttctggcattgtatataaattcccatttgccataaatagtagccctctagtttgcttatcaggattgtatcttctctacacggtcacatagtggatgattagccctgaaagcaattacataatttccacttatacagatttacatttacccatagaaagtatttctctcctattcaaataaggatgtcagaatgcaagttcgtagaagtgatgtcattcaatggacaaaaaatggattaattcatcagaaagaaagacaacatatattgcaaacttaaatgatgtgggatgcctttcacagctaatggcatcatagcatggcctttgggactgcccagaattccattttatagctgtaccctactttgttcatctagcccctcttactgagcatttaggttctttcccattttcacactttaaatggccatatgataaacattcttttttttgagatgtagttttgctcttgttgcccaggctggagtgcagtggcacaatctcggctcactgcaacctccacttcccaggttcaagtgattctcctgcctcagcctcctgagtagctgggattacaggcgtgcaccacaacactcaaataattttgtatttttttggtagagacagggtttcaccatgttggtcaggctggtctcaaactcttgacctcaagtgatccacccacctcggcctcccaaagtgctgggattacaggcataagccaccgtgcccagctgataaacattctcaaagatttttaagatgcatcctgagtgcttcattagaatttgttcttagcaatggaattactgaatccaaggctattattgccataaatttcgatggggatagtaaggaaagaataatgataaactcagacccactttagtgggttactgaatcgagcacattattattattattattttgagacaaggtctcactctgtcacccagactggagcgcagtggtgtgatgtgagcttactgcagcctctgcctctcgggctcaagtgatccttctccctcagcctcccgagtagctgggactacaggcatgcaccactgtgcctggctgattttctgtatttttggtggagatagttttggtttggttttggttttggtttggtttggttttggttttcgccatgttgtccaggctggtcttgaactcctgagctcaagagatctgcccagctcagcctctcaaaatgttgggattacaggcgtgagccactgcgcctggacgcacgctcacttgcttgctttctttttctttctttctttctttctttctttctttctttctttctttctttctttcttccttccttccttccttccttccttccttccttccttccttccttccttcctttctttctttctgggaaaatatggtttggttgtaagtacaaaaagataattatcattgttatatgttatttgtattatattattggtataaatttaatgtctctaataaattactttgacaattggtcattcatattttcatggtttttgaaaacaaagtgtatctttcaaataacaacaacttgatagaaaagatcattgcacctgggagaataataacaacatcccaaatttgctttaaggttatacctgaaatgtcattgtcagagaaacaactcataagtctgggttaaaacaagcctcttgctgattttgaggtgatcaaatttatcataataaaaaaatagttattaccaatcatgtcataagactggggggcatgcagtgagcagaagcagataggttgtgcaggaggagggtgtgggatatggattcataatctctaccaaaatattttttagataaaggtgagtgagtgagagttgaaataaagataaggaaagttcaatgattgattaaggcattttgactctttgggtcccagagcagacatccttatggtggcaaagaaaaaccacgtaactaattcggaaattgtgccaacaacatgttgaaacagtagtagagaaattcaaagtttaatgttaggtcactggtccatcgtccatgtacaactttgagaacacctgtaatgcattacatcagacattaaaacatatgtagttatttaaaaactgatctgtaatataactgggcatagaccatattagtatgatttctgtcttctgagtgaatgttttatttggacttcttcctctctttagatttttgctcttcctgtattttttctttctatcatctttagcaaaagattgctagtgaaaggagttgcacctggttaccttgattaacacatcaagagctctggaaaatctggttgctggtctccaaatagtcctgaccatgggaatatacaacaagctactgtggtgcagcggtctcttgctctcggggccttatttattacagcacttgctgctagcattagtcacttctgtttgggcactgtggttttctgcttccttccaataacattacttgagttaaaaaaaaaattacagaaatgtagtttcacaaagacttctgtgattagaattactgtctggaatttttaaaagcagacagcaaagaagcaaatttaagaaacttgaaaagtttaaaaacaaggactgtttctttataagggaggcctaaaaactgttgggttcatattttttgcccttttaaatgccatatttagtatacttcaaaacagtttaagcaaagcaaaagctgaggtagaaaaagcatgttattctgtgacattttcaggaccctaaagtaagaacggcagcacatttgttttcaggaacctgtggttcattcagcaaaattaattccaatacagaattgttcctatcaagggtgacatggattcttttatgatgctccagatttctggtagtttgtttgcattctctccacttgtgtcattctgagaaaagagaatagtcataggacactacagttgaaaagcttgagattcttgtgtaaaggctgatgtgtgtggtctcctagctctgcatcctagaggtgtggtttattcccccatgtggggcagatgcaattgtaactttttgcaatggaaatgctgttagtttccagacagatgggatgtgagctggaacttgaggacctagatagataaataggacctagataaaaatgatctaggcatttgtgttggctgctataaaaacatcctctgtcatgtggagtagataagatactctatgttgttttaaagaagtcttttacaaagaagatgagtgtgtgtgtgtggggggggagcggtggaggaggggtgcagaagaacatatgagatccagctccccagaggatcttccttaaggcacttggaactaagtttgaaggcactgcccacaaattctctccttcatcaagacttgtcaatccagctaagctctgtggtcacacctactgtcatcttagaagatgaattctgtggttgcctcaatttaatggctgaccaaagaggttccaaaaagatccagttagatcctcaggtctcatatcatggaggttggggtgtccatgacctctgtttatgctctgtgtgccacgcttccctttatgggttctttatctaaaaaataaagaaactgagttgtctgaaaccctctttggaggaggcaatctggtgtagtggttaagaatatggattctgtagtcagaatgtttgggttttgcaacatctctaaactgagatgatacgaaaacacctacccaacaaagctgtttctaggatttaagaaagcgtttttctataagagtgctataagatggagcccaggaccaaaatacatcaaagcgtgtagatgttaaatggagctaagtcccaaattgggtgactaaaggaaggtgtaatgatggaatcctgggtgcttctaatggaccaccaatttggaaaacaaaatttagaaatcgatctgtgagatcctgagagaacgagaccattgatataatatgatctccagtttcagcctgtgcgaggattaaccagcaacccaagaaggcaatattactggggccaccacatttttgggcaagaaaggtaaactgtgtcccttggcagtcagttcaagcctaaacctaaagtagtaggcttgaacaaaattacctttgttgtgctctaataaaaataaacagagtgtggagattgaagaaatcatcaaccagtgctatatacctgtttgtttgtttgtttttggtgacaggatcttactctgtcacccaggctggaatacagtggtgtgatcatagcttactgtaacctggaactcctaggctcaagtgatactcccgcctcagcctcctgagtagctgggactgcaggagcatgccactatgcctggctaatttttaaattcttttggtagagataggatttcactatgttgcccaggctggtcttgaactcctggcctcaagcaatcctctcaccttggcgtctcaaagtgttgtgattacaggtgtgagtcactaatctggcctggttccttttttaataatactactgacaaacactgcctcgtagaaactcctgtcagcgtgaagagttggaaggggaggggaacagtgctatttttcttcttcaagaagtttcagggggctcctcataggattgccttcaggagtgtccatactccctgcctctctggctgtttcttatcagctaaatggtacaacctccaagaggtgtgactgatggtgaatttcatctctttctgaaaggtgccatgaaaacatgcaaggctattcctctctgccattgtttctgtctgtctctcagcaggataaggtcatgacagaatggcacgtttatcttggatttccttgtttggcaagcagcctggatatctctgggttgaacgtctctgggtatctcacagacgtcaatgggttgaaggagatgttggctcttgcactgattctttcagaagcccaggaggtggtggggaggggggaggagaagaggggacaggattgtacttgtcgtgtcactgccctctcagttggagcttcctttacctttccaggctcctacagcgtggagaggcagcctagtataatgcaaggcacagagactttatgtctaaatagagctgtgttcaagtctcgactctgcctattttaaggtttttctcctatatactcctcaaaacccctgtacttattcttcgatgatattttttcacatctgacattacatctttctctctctctttttctgcatttgtctgtaagctttagatatgtggggaccacatctttttcatagctattagattgttaaacagtttctggagcttggcttactgagcttcaaacgctggctgtgtgacattgggtaagctctctagcctcttgcctgccttgggtggtgttgtcaggattagagataaatacatgttgtatcgctggcaccaagaccagcacagatggatgctcgagagatgttgttctccttacctcaagcttggtaccagcgcctcagtgtctgctgaccccaccagcatgcccggatgtatctgttggctgcaagacattgtagccccaggcttgtagccagcctgggcaggcagcttgttggctcaaggagtccttcgtactgttcttcagtccttcgaatgtcttattctcagacgctcttctgagaggacatgcctgcaaagagcacaggctttatctttggaatctcttgtttcagtccatccctaagaaattgacagtagcctttaaaaagtaacccttaaaagttatttcaaaagtaattatagttctttgttaattaagggggaaaaatctcccatagtctatcatttgtatatctactgtttgctttggtatacatccttccagatttttctatgtgcatgtactataataacgttgttttcttttagccaatggtggaatattctgcattttatttttgtatccataggagggatttttcagagtccatgaataatattggactctgaatattggtatgatttatggaactttattttattttactttattttgagacagagttttgctctgtttcccaggctggggtgcagtgatgcaatccctgctcactgttaacctccacctcccgggttcaagtgattctcctgcctcagcctcccaagtagctgggactacaggcatgtaccaccatgcccagctaattttcatatttttagtgaagacaggatttcaccatgttggccagactggtctcgaacttgtgacctcaggtaatccccctgccttggcatcccaaagtgctgggattataggcatgagccactgcgcctggcctgatttatggaattttaaaaggttccaaatcctttgttagaatgaggccagttagaaataatgaaaagtggctaatccgtggaaagccataagcctctagtggttttgaacttgaagaagcacagcaaagcacacacactgtgtgtgcattgacttatccacatgctactacataagcctggagagagatggggacagaaggaaagagaagacggattgcacactgctccaatccaattgccctggagtgagagtgagatgagatgaaagttcgtttttccttctgctcatcatggtccccaggagaccctcaaattgtgaccaccttgtcatggcacaaggtggctcctaaatggaaaccagctatcttctcagctatctgttccaaagcgggaggtaaaactgggtgtgctggttttaattaagagatagcatgtctaaaaatggcacataaacttaatatgcagttaggagattttcagggacattttttttctacattagtttcgcattttcttggtgactttagaaactaacccccttattagactctctggcctatgcacataaagcaacatttactccctccctccctccttcttactttttcttccactttaagcttctagtttgtgctgggactgcgggatgtagtaatgaataagtacatggcctttgtcctaaataacttaggttcagttttagaaagaaatctgaaaatgacttctcataatacctggcagaatgaaagaaatttattaaaagagaggacagcaggccaggtgcaatggctcatgcctgtaatcccagcactttgggaggctgaggcgggcagatcacctgaggttgggagttggagaccagcctgaccaacatggagaaaccttgtctctactaaaaatacaaaattagccaggtgtggtggcacgtccctgtaatcccagctactcaggaggctgaggcaggagaattgcttgaacctgggaggcagaggttgcggtgagccgagatcatgccattgcactccagcctgggcaacaagagtgaaactccacctcggaaaaaaaaaaaaagagagagagagagaggacagccattttattaggaaagtacagaggaagaaatacgtagttctagccaggggatttcattacatgggattacagagaagggtgttccctgaactgaatttttaaagatagggtcaaattttcataggcagaaagaaagggtgggaagcggacattctcaattaaggggaaaaatgagatcttatggaagctttaaagcctgagacatttgagggaacagaatttgagaattgagtctgcgatgagacaggaaaagcccacaggcagtaaaaaatgccggtggctgagtgcagtgtagcttccactgaactctgtggatgtttatgcttatttgaaccttgttggaatattcctggtttgttttatgaagggatgtctctcactgaggatattgactcagggacgtttcctctttcagtcaggatggcctccatcagaccaatattgttctcaggccatttttttgttttgttatcttggataaacagagagaggctgattcatttttctagaaaaacaggatgcactaaaatactgcaagtgacaatgaaacagacatgctcacgtacaataatatttataaagggaccaaacaatatatgtagcagacacctctgtggtgtggccgctacccctcctccatctcacttgccttgagtccttggccaagtgggttgtttctttcgatctgtttcctcagatatcaaatgagaccaataataccaactgaacaggcatgtctcaaggaattgatgagtatcaagtgctagaaatagtgctgggcacgtagtaagtagccattccaatagagcttaattatttgtgcactgggtacgaaatactgattcgtaattggagcaatatatattcacaatgatttttttaaaactttgtattatggaaatattcaaatatccataagagaacagtatgataatttcccacgtacctaccatccctccacttcagcaatcgtccacattctgccattcttattcattgatccccttcctcttttagaaatgttttaaatttgtaatggttaactgctacctaaattattttaaagcaaattctggagagcatataattttgtgtatagagagtttttaagagtctgataaatcagtgaccaaagaagaaatccttataaaaaaatggttgaaaccagtgttttgaatgcaattttcagagctgaattataggtatttctgcaaccaaattaggacatgtctgcaaatctttaagagtggcattttgaaagttcagtattgtttatttcatttaaggagcatgccacatgctggtctgcacatagattagcacttaggtgcatatgcaaaacacttttttctaatggaagatttaaaacatacctcaatactagtagactagtataatgtacccccctgtaaccatcacctaagctatctttttttttttgagacagagttttgctcttgtctcccaggctggagtacaatggcgccatctcagctcactgtaaactccacctccctggttcaagtgattctcctgcctcagcctcccgagtagctgggactacaggtgcatgccaccatacccggctaatttttgtattattagtagagacagggtttcaccatgttggccaggctggtctcgaactcctgacctcaagtgatccactcacctcggcttcccaaagtactgggattacaggcgtgagccaccatgctcaccctaagctatcgttctgatgtctccttttgaaagatgttcatattgtttgtaagagacttcttaggtcaaaagagccttaatgattttggaggaagatgtagaatcaaacatttatattacactacatgaaaagaaattcttattcatcagtgctattgcctttgaaaagtacagtcagtactgcttgatgtgggtatgttctgagaagggcatcattagatgttttcatcattttgtgaacatcatagaaagtatagtctactacacatataggctatatgcatagcctattgctcctaagctacaaaaactgtacagtatgttactgtactgaatactgtaggtattcaatggtacagtggtacaaatacaatggtaagtatttgtgtatctaaacatagagaaaggtaatgtgttgtgccacgacatttccacagctacgatgttgccaggcagtaggagttatttagctccatcatgatcttatgggcccactgttgaatgtaccatctgttgttgacccaaaagtcatgctgcacatgactgtgtgtcagtaatagctctcagaggaactgattttcccagatgaaatataagtaaaatctgatgtttgaaagcagttcaagcaagacccctcaaaagacatttaagcaagaacacatttggaagccagtactgaagtgttagtaatggatagggaagttatgtattttctcttctttcttttttccattcatctttctctctctctcatttttgtttatctgcattttacaattttttttttcaccgtgagtgtggattttctttcaccatgaacatggattatttgattgttgaaaaataacaaaagcccagctgggtgtagtggctcacaccactaataccagcactttgaaaggtggaggcaggcaggtcgcttgagtccaagatttcgagaccagcctgggcaacagtgagacctcatttctacaaaaaattaaaaaattagctgggtatggtggtatgtgcctgtagtttcaactatttgggaggctgaggtgggaggatcacttgaactcagggagggtcgaggctgcagtgagccaagattgtgccagtgcactccaccctgggcaacagagtgagaccctgccaaaaataaaaataaaaaagtaacaaaagaatataagttagtaaatcaaagaagagatgccgggagtggagattggctgtattgagatgagtatgtcaggggcagatagataatgtttctgaaccagcaagcttttacccttcatcttgctgcttgtctttaaccctttccttggtccctgggtcttgcctctgcattctcattactgatggtagggagtggtactcatcttcatgacataatctcattaggccaagagagaggataattggccatagttcctaggccagtcccctaagctgtgttaggctttcatatatgattctgtctggtcctgtgcctttacatttcctggtcttgccttctgagactgcccaggttttaagaggtgggtgttgggaaaggctaggagatggtggatgctggaagacaaaacactagcagagtgtagtctctccccttatgatcctgaaagtataaaaagccatctctgctctgctgccagcctacccacctgcactttggaagaagagctgttggatatttcagaatggttttcagactggcattggaaccgtgttctaaagttaacgatgatggaaataatttagttgtagaggactctagacaggcttgtgtaaagcaagcaggtaaaggaataaaacattaaaaattgtgtaggaagagatgttttgaggtatcagtgtaggtggattgtgagtggagtgacatggggagggagttaagaggagacgatgttcatggttaaagaaaccatttatacagacgtgacgagtgcaggaattctgatctctcatatgacaaatgctgagaataactcctattttccatgctaattgctaatttactcatcacattgaatatcctgctggtggaaaaattcagtgttgcagcctcatatcctcctgcataggaagtactcagtgacccaagatgttagagtctcttttatggcacttccctgaaaagaaaatattattacttaattggcaggcaacaggggcttttaagggactcatccgaacaccacctgtttacttacaagtacaaaggacaggaaaattaattacaaatgatacctttctcttaagggttctaggtttccagtgcaaaataatgatgatccaactgccaaagtatatactggtaggtggagtttttttttttttcttttcccctcctataatggattaagttaatctgtgagaacgtttacccaatgcccattgtaacaaaattatgtgaattgaccagatttcattaagtataaaatgaatgtacctcgaacttggtctttgatgtggattttgagctactatcaggccacagttcaggtatagcaaggatatgccccaaaaaagcattcctgtttgattatttggtgtttgattatcagaatttctggtctagaatacagtccaggtggtaacctttccaatatgagtgtcttcctaaggtgggtcatgagatgggttggagaatccagggttctaagccagtctcttgcccctgacgccatatgggacatgaggtgagttgcccagtttttatcatttgtcaagtaggaatagtaatgtctgatgtgattgaggattaaatgtaagtctaggcaataatgtaaatagaagtgtttttgaaattaaactgacatgcaaacttttgattgatcacagtaatcaatcagtgaacaaacatatttgtgagctatggaattagccataaatgtgaaggaagctagagaaaaggggaatgacatttccagtaagctagcaaacactctggagctatgttattaactgttaaaccatgtagtctgggtaggtatcattagccactttgccacaactccccacctcatatcctgtaccccattcaaattcagtcctttcattgctcagactcatctcgccttggccattctgcccctcacaatatgattttcccatttctgccttttgaaacgttgagtaatcaaaacttagatcaaatgtcagttctttcatatagtcttctctgattactccagttggattgatccctctctggcctatgtcagggataggcaaactttctgaaagagtccagattgttttttggctttgccagacacatggtctctgttgcttccactcaactgtgccattgtaatgtgaaagcatctgtagacaatacatagataagtgagtgtggccatattccaataaaactttattcacagaaacaagctgccagctagacttggcctgcaggctgtagttagctgacccctggcatgggtcattgtcttgctacgcagctttcttggttctgcgtacattttgccttaacctgcatgttagtggccttctttttaaaaaaaaagtttttaaaaacttttactattattcttatttttaaagatgaggtcttgctgtcacccaggctggagcagtggtgcaatcatagcttactgcagccttgaattcctggggtcaatctatcttcccacctcagcctcctgagtagctgggatcacaggcatatgaaccaccatgcccagctaatttaaaaaaaattttttttttttgtacagatggggtcttggttcactgcccaagctggtctcaaactcctgacttcaagcgatcctcccaccttggcctcccaaagtgttgggattacaggtgtgagccactgtgcctggacagtaaggcttcttatgaacagcagtgtccaggctgttttcttcttttgagtcccccggatgttgtataaataggagagtgttcagttgatgtttgacaaatgagtgaacagtgaatgaatggtggctgctttcagaagttggcaaccctgctgtccttctggatggctgagctcttccagccttctggcgtcctgcctcctttccctggcctgccctgctagaaagagaggagagaaggcatcttttctctgtcttcctcagccacccttccacttctttgagcaactactatttacaactcaaagaattctttatttatactgtgtgagagactgtttacccgtgttgaactaacattaggtttctttaaatctgctattaaaacgaagagtggccatttgtaactttaggagcataagagctgggttcatgatgtaagtgaacagagacacccttaaagttatttcccaaggccctgggaatgcgattttcttagtttatttgttacaagggagtgttttgtacattggtagaggaaaatactatgaaacaaaatcaaacaaaaacatcattacattttaaaatcattttgcaacactgagcaggtatgaatttggtactttgcttgtaattggaaaactggaaagttgaaaatttaagtatggatattatgattttcaatttttagaagatgtatagtatataatggcagtttgcatttgatgttagaaagaatagcatctcaagggaaaacaaaaatgctttccgttccagaaaatgttaaacattcctttttttcttaggataaactcactactagctacttttcttctgcctgagcccttcattgtaaaagtgaattaatgttgtcctctgaattctgttggggaaaatgacacagaacccctgtgaatgaagaattgcttttaatttcactggacgtgaggcagaggaggaccttggaaaaggaaggttattatttcctctgtggaaacgtttatcttcgttttctgggtgactggtaaaaacaatagtttgctgtggagtttcagtaatcaaagaagaggaaatagcatgtgagtgactgcaagttggtggggacaaccctggctcttttgaaggtgaaacttactaaagccacattagctatctcctagtgcaaaggtcgagaaacattttctgtaaagggctagaggtaaatagtttagacttcatgggccataaagtccctgttgtaaattttcagctctgctgttgtggtatgagagcagccatagacagttttagaaacaaatgagagtagctgtgttccaatacaactgtatttatggacacaaaaatttgaattttcatatgtcacaaaatagtattattttaatttgttacaattatttaaaaatgtaaaaaccattcttagattccctgttgtacaaaaacaggtagtgggtaggatttgggtgcagggcatagtttgctgaccctatcctggtgaactagcgcaataatttcttaggtggggaggtgtagtggataacacattacacattctgtaccttttagtaggtaatccgattatgattagctaacccaaacttgtgaagaaaatttcctggtggagttggatggctttgaggagtccagtgttcttgtccctgccctgttagtgtaaagctgaatggcactttggaccttggctgcccatctggtacatgatgaagttggactagatgacttctagggcttcgtgtagagcttaacattttattttaattaattaattaggttttttttgagacaaggtctcactttgctacccaggcaggagggcaatggtgtgatcagggctcactgctacctctacctccaaggctccagcaatcttcccacctcagcctcctgagtggctgggactacaggcacatgccaccacagctcactaatttttgtattatttctattttttttcttttgtaaagacagggttttgccatgttgcccaggctggtctcaaactcctgggctcaagcagtcctcctgctttggcctcccaaagtgctgagattatagcgcgtgagccacttgactgatcttaacgttttagaccctttatcacttgtgttttggttcttcttctgataattattgcaatttaccttttaaaaaattatttaggcctggcgtggtgactcacacctgtaatcctagcactttgggaggccaaggcaggcggaccacttgaggtcaggagttcgaaaccagcctggccagtatggtgaaacccccatctctactaaaaatacaaaaaaattagccaggcgtggtggcacatgcctgtagtcctagctacttgggaggctgaggcaggaaaatggcttgaacccaggagatggaggttgcagtgagccaagatcatgccactgcactccatcctgggtgacagagcaagactccatctcaaaaaaaaaaaaaaatttagatatttgttgagaaactaatatgtgctaactgtgcaggctctggtgatggtggttgtgtgtgtgtgcacatttgtgtgtgtgcatgtgtgtgaaacagatggtagggtagttacaatacaaaaatgtacatattagtattctaaataaattttttttctattttgtgcagtctttcttgaagttataaaaacaatataatgggcaattaggcatttacactatttttattaaaaataataaatgtatatgaataattatactcagaattcaacaatatcagatattgatttttgcagttactttagttattcatttatttattcattcatgtaacaaatagttcttgagtacctaccatgtacttcaaggcactggcttaggccttgaagactaaactatttgccctcacgaaacttgcattctaatggaatctcctgttgaagatgctaggtagatggttttattcgtacttttcagaggaggtgtacttattcattacttatttttctttttttgtttcagttatctcttgggaaatctctgagtaatgtttttgaattaccagaggaaattttacagtcacacaggtctttgttgacttttgcagtcgcctaaagttgttaatcattgaagagaactctgattcctcactgacaaagaatgaattctatcgttttagttatattagttaatttggaaagtacttcaatcaatttaaaactttagggaagatcaattcagtaagttctttagaaaatcactacgtcaaggctgggtgcagtggctcacacctgtaatcccagcactttgggaggccgaggcgggcggatcacgaggtgaggagatcgagaccatcctggctaacatggtgaaaccctgtctctactaaaaatacaaaaatttacccgggcattgcggcgtgtgcctgtagtcccagctactcaggaggctgaggcaggagaatggcgtgaatccaggaggtggaggttgcagtgagccaatatcacgctactgcactccaacctgggcaacagagtgaaactctgtctcaaaaaaagaaaagaactatgtcaaattctcaaaggtcactgaagttaacccgtgttatcagtcttctaagcagcattagtggatttatatttatgttacacatttctcctcataaaaaaagatttcacatgcatttattcaatgaatactaaaaaagatgaatatttcaaaaagtaaaagcaactgaaaatagtaatatctgttaaaactgcgtcatggctttgccttgatatcatgagttttgtctgcttttatgagggtggcatttttgggctttacaaataaaaaaataccattgtaatagtagtattataaccgtaaccaatagtccaacaatagcgaaagcattcactgtgtatcactcccctccaggccaccccggctttgctctgcttctagtcagagtggatgcctcgcagttctttttgaataaagttaaatctgacttcaggtctttcacacacacatttgccgccctttggaatctcttccttctctgcctttatcatctagttaattcctggtaagtctcaacttgaaaggtcttctctttatggaagctttccctgagttttatgtggactgaagtttcccctgttagcatccttacttcttctgagcaactgtaattgtttatgtcattatctgacaagaagctggatgaaggcggagtgtgtattgcccatcactctattctcagcacttggtttgaatgagcctataagtggtattttacccacccctcacaaaagaagctatatcaatataagctattattcgtgtaatttagtgagaaatactgatgtttcctcaccccatagttttgtgtatcttttgtagacctcagtgtttcatgacctatatattataatgtttactgactagatttggtcagttactatttgaggaaatgctgggatttcttagaaattttaatgataaaagaatgcatagggccagaatgtttgaaaccaagactgccttagagaaacccagggcatatagcagacacatttttgacctgaaacgcttaaagcggaatgggacaggaaaatacatatgcatgaaataattagtatgtttctcagtctgtccaggctactataacaaaaataccataaactaggtggctcaggaaacaacaaacatttatttctcacagttctggtagctaggaagtacaagatcaagacaccagcagatgtggtgtcttatgagggcctattcctcatagatcatgccttctacccgagtcatcatatggtagaagggataaacaagctctctctggcctctttcatgagggccttaatcccattccatgtgggctctgcccccatgatctaactaccttccaaaggccccatgttgggaggttatatttcaacatatgaatttggtggggacacagacattcacaccatagcagtatgccacctgtgacagtacctgtttgtctttatagctgtgttctcttgtttctccagtatctcagtggtattggacaggatattagattcaggagaggacttcagaatgttaactagtggtaagaaagcagcttcatggggtggctggggcttgagggagtctgtaactcgggaccacattttagtaactagagaaaatgtttcagcaactgtatggtgataagtccctagtctaaatctctagcacaaatctttcttttgagtgctggataccctattcttttgcccattaaacacgtctacttgcatgcgccacagtcacctcaaaggcaacatgtccaaagcaaattcattatctcactctcgaacttgctccttctccgttgttatggaactcagtaaccacattgctcaaattactgcctcacccattatttcttcctcacctatcacatccagtcctccaagttctctcagtcccgcctcatacatttcctccataacctgctcccttgtctatgttttctagtgtaggtcactacactagaaaggtcatcctttgcttgtgctcctgcaatagtcttctaactggtctcctacctggtagctggtcttactctcctctgatccactctcatgctgtggccaaagtgattttctaaaaagacagatgtcttaattatgcatgtgctttgaagctcctcgtttggcatttaggataaagttcaaatgccttagcttatgagaggccctgtgaccaggtctccactctccaaccatattgatgatcttacagtttctcctgtgtattgtgctgtctccggcctctggacctttagtgctgctccttctgtctaaattacttgttttctcaattagtgacccttccctccttcagtgcacaggcttggaagcctatccatgaatctcactaccctgaaatccaagggataaggtgaccatgaacctcagcacctcaagccttccattgacatttccctcctttgctccatgggtaagaatgcagaacgtatggcttcagcttctgtgtgggcctttctctatgcctggtttttcctggcacctgtcctcccacctgccttctggcctgccagtgtgtctgatctgagcagactgggagggtgtgaagaagggccagtaccgcttcagcaggaagggcagcacacggaaggccagcagccttgggctggcctgcatctgcccctcacataccctacagagaaacactgagcagctggtcagcatgtgggctgggaggaatggggctgggctaggggactagggattaaggcagcccttgtagcagcaactgtgacacaaggagcacctggccctcctggaagtcccagggctctttctttgacctccttccttcacttcctgcattttctaaattgtagctaaaatttgagatagaaccctaagagtaaaacctggccctgctagcattgatttcctgagattaacttctcttttagctaaggagcatctctggatgatgagtagagatggaagccaagtcatgtgcccttaaagtcctgtgcaagctccttcccgggatgtggtggggtgtgcatgcagtgagctgtgagggggtggccctgtcacagggaatgaggcctcagccattgtctggcagtgttggcagtgtgattttaagccagttatttaacttctaggtctcaggtccttagcctataaagttgggataatacttatcttacagggttggagcatgaaataaatattaagagaatcaaaagcaaaaatgctttgcatattatgtaatatgaaactatttttcatgtactactacttatagtattactactatttatggagtttaaaaagtttctgtgttttgaatatatttaatgaactcagtctttctaattatctgtatgtatcatgaatacaacataaaatctatgaccgtggcaaaatactatcactgaccttagatgtggccaatgtgttcttgactgagatctgtacagcttcacatgcttttttttttttttttttttggtatgccgcttatgtagcaccagtagaggatttttttttcattgacattatcttatattcccctcattattaggagaaaatgtcagttgattttctgcgttactaaggacatgaacaaagaaaactgtgtaacacaaaactttctgtgtggaatagagaaatttaatcactgtcatgatttcatcagtggggcagttcacagctttagggcatgccaatgagctgtatcacttcagagttaaccaaagaaagaaatgtaatgggggatggagaatgtaattagagtggagtacaaggggggggtggggaacctttgtaactaaattattagcattatcatgaagaaactgtcttttgaattgtttttaagctaaagaaatcataaagcagtgtttttatgtgactatgtaattccccttgtatttgaggttaatatgctgcaaattcttcataaatcttcattaagatgtcaaaattccttgtgaagcctgtcttcatttgcattcccttgtacagttattaacaaagaccctttatgtctctgcccagcttgatttcagtcatgaactccattttccttttattatttcatagaatctggttccttgattgaacttagtaaatcatttcttgaggacttggtgggaagccagagagtggtagtgaggggggcagtttatgagcccagggtgggtggagacccttgttcctcaaagcaagacattattaactttagagtctcctcttatcagatcttaaaaattcttgcccaaagttaatagtttttgaagtttgcaaatagatttctacagttgaaacctagagtagaaagaagcctggttatttatttatttatttatttatttatctttggctttaaaattaggcttttctggccgggcacagtggctcatgcctatcatctcagcactttgggaggcccaggcaagcggatcacttgaggtcaggagttcgagaccagcctggccaacatggtgaaaccccgtctctactgtaaatacaaaaattagctgggtgtggtgatgctgtaatcccagcaactcgggaggctgaggcaggagaatctcttgaaactggacagcagaggttgcagtgagccgagatcgtgccactgcactccagtctgggcaacagagtgagactccgtctcaaaaaaaagttgggggggaagccttttctcaccaattgagtgtcagtgtggccagtgtaaacaaggatgaaaatagctatttgaggggtttggtggccactttaaagttgtgtcagggcaatgatcaacactagagtttcagttcctgttgagatctgtgctctctacctttcagtctgtgagactgagtcggaatgtccccaagtatttaggaccctgtgactgctggaatttcagggttgctcagggtccagagtgaaaagaacgctgctgccaataacgccttcccatcttgggttgcctttgttcacatagctttgcttattctttaatccaaatcatcagctcattccaaaatagttgctagcaaaaatacatgtgaatgctcattcaagaatataaaggatattaaaatatcctcttatatcatgactctgcagacggaaaattctacctgaactttgcctttggttttcttaacatttcctcttagccctacgtagatacatttttctcctgtgggggaaaatttattgtttcctcattttcccccagcattatttgagtgtctgcaaatgcatattggtagtttttctagtaggacctggtttgtggttgttaatggtaaatgtgaaaattagatgtagtccaggctcaaaaggagtttaaaatctgatagaaataagactttccacaaccactagtgtggcaaaatctctgtgggtaaatgtaacttcaagcataatgtacccatctctcacattttgctcaagttgaatttcttccgttctgaggcagccactccctctgtaccatatgattacatggcttgcttacttgctgtactgcctttagcattgtcggttgggtgttttaaacctgcacgttttatttctcaagtagaccggaggatccttaaaaggtagccaaagaatagaattatataatattttaaaaagtaaaaaaaaaaaataatttttttcatattctgggtcattgtagctttgtttacaaggactttacatgttgaagaattggaggatgtattagttttgggttttttaggttggtttttagagaagtattaggaagttcccaaggggattgaccttgtagtttcaagaaaaggagaaatggtcatgcctgggcatttttgggtgctttgtttgaaatatgcatccacttggctgggtgtggtgcctcatgcctataatcccagcattttgggaggctgaggcaggtggatcacttgaggttaggagttccagaccagcctggccaacacagtgaagccccctctttactaaaaatacaataattagccaggtatgggggctcacctgtgtcacctgtggtcccagatactcaggaggctgaagcactagtattgcttgaacctgggaggcagaggttgcagtgagctgagatggctccattgcactccagcctgggcaacagagtgagactctgtctcaaaaagaaagaaaaactataaaaaattataaaatatgcatctacctcttgaaattgatacatttttgaatttggaaatgttgaataattagagcctgagcataggtctatgttttgctaagataatgtacttgggagggtggttaaaatagtcattaattttggtcacaaatttaaacagagcttgcttgacagggacagcttctctctgtttcatgcagtgtcatttggagtggcttgactgggggacaagggattaattttcaagggggctcacccacatgactagcaagttggtgttgactgtcagccaggcaacattttctttccaagtgggtctctctacaaaatgcatgagcttccttatggcatggtggctgggttccaagagtgagcattccatgaaacagaaagtaggagccatgagttggtgccggaaactggtacatcatatttaccatattctattggtcaagcagttgataatgtgaattttaaataggaaattttatgactcatggaaagactttatttggatttcatttaatgtatcaaatgggtaccccagggtggctattgccttgaggaaggtgctttatttccactaatgtataaaggaaggtgccaggcccatgaggtacaactaatgcttattatcaattttattttattcttccccttcaggtgagtggagtgagtgtcaaggacagaggactgaggtcccagcttgaggtgcttggagggacagagaagaatcagggtgaggaagctgtcaggctcctcttttcccttttggccctgtgactttattagcttaactaatacttcatagtgtttgctatgtaccaggcactttacatatattaactcaattatattcccatcggggactgtgttacaggtagaatcttaattaaagctactgctactgattcttaataatggcattacttgaagagattattattaataggcccttgccccatttgattacactgtgtgatatacagttgtcccttggtgtccggaaaggattggttccaggaccctggaagatacaaaaatttgacgacgctcaagtcctttatagacaatgtcatcatatttgcataaagcctatacacatcctctcttatactttaaatcatctctagatttacttataatacctgataaaatgtaaatgcaatgtaaatagttgttatactgtatcattgtattgttttttatttgtattcatttttacaaattgttgtactatcattatttattttgaatattttcaggccaatgttggttgaatcccaggatgtgaaacaggtgaagatgaagggcccattatataccttgtcgctatttaaagatgtctcaaactcttggaattttgatgtttttgaacatgtaacttaatggatcctccttcatattattgtagtttctcttaatactaaagtagatattattgccttggtgtattttacttttaagtttaaaaaatttttgatttaatgatactcttgaggattttagtttgggatattaccactgtcaaagctggcaggttcttcacttgattaagtcttatttccactcaacaccatttaagtagtttgagactggttataatgagcattggtacaggactggcccctcttttcagtcaaggtcagttggcaacagctatacactgtttctttattttggaaaggttttgcttgcgcaaagacttactcttttaaccaaatcctgcttttcatctgtttttgatggcaacagaccatatttcccagccatttgcaaacagtgcctgtctggcgggatttcctggacacagcccttgacaaccattactggccaacttttgaacttcagtgtttaacctggttatttgttctgtgttttctgccatgggccatgggaaccataagcttatccttttgagactagcagaaggtccaagaacaatccatttgctaattggacccattgctttccccagcccattaaccttcatgaatcaaatcttccttccaatatccagctattcatctacaagtcagtactatgcagagtgatactttctaaccaaggtgcctatggtagaccttggtcattgccattttggaatctttaccttatggactgatataatccaaacatgtcagtgtgtcataaaaattggttggccaattaaagataatttgatagtgcaaatatcattaaaattgttcttatgtacaaataataatttaaaaatccatatataatgacttacaagtaataaggccgtacttttttcactctaaaaaaaataagcaaatgataaaacattcatgctctttgacccagtggtactgattctggggctctagcctaaagaaataactcaaaacattgagaaaagcttatgcttatggatgtttgttgaagcattatttgtaatgaataaagaaaaatataaatatctaacagtaaggaattgttaattaaattatgatgttgatgaaagtttttaacggcatttgaatattgttatgatgttaaatgaaaaaaaaatggaatacagcattttccacaatatggtcacagccatggaaaaaacatgcattagaaaaaagacagaaaccagccaggcacagtggctcacgcctgtaatccaagcaatttgggagacactaggagacactagaaagaagattaaagaaaatttcaagagtgcttggcttgagtgccagtcagacttgggtccaaattcctactcttttacttatgagctatgtagcttcaggcaagtcttttaaacttttgagcctcagtttcctcatttataagatggggataataatttttccaggattattgtgagtattaaatgagataatgatacaagtaaaattcttgataatctataggcaaccaacagctggatggtggcaagtactaattcgtagcttcaagatgttctcagttgtattcttgactttggcattcttctgttacgtttgcactgatttttgacatgctgctaggagacaggtaatgtgaaggatctattggggggtttgcctttacggcttttctggtacattgtaggtcaaacaccaacacctgtgttaggccctgtcacatattcagggaccttcactgttcacctgagcttaaccaacaacactcacctgcaggcatgcacttgagtacagatgctgcttgttttgagtgaagcagatacagaaaatctttaactacaatcccatttataaaagggtggagcttatttcttttaaaaaataatcattccaaaaagatttgcacagaattaattttcaaagggtgacctctcttgtgcatttaaaatgtgattcaagcaaaccaaacaaaaaaaggattcggcctacactttcagtggcacgaagtaaagtgcacttgtgtccaaggttggactccttgcttttcttccaagcatctttcccagtctcatcatttactagtttatattttaaacttagcttcagaatgcttatgctgatgttaatgagtctatcttcaaatgctattttagtttatcttttttactttattttatttttttttgagacaggatctcactctcacacagctcacagcagcctcaccctcccttgagctcaggtgatccttccaccccagcctctcgaggcactgggacttcaggtgtgcgctgccacgcctagatagataatttttctttttttcttttttttttccttcttcttcttcttcttctttttttttttttttgtagagctggggtttcaccatgttgcccaggctggtctcgaacctctaggctcaatctatcacccatcttggcattccaaagtgctgggattacaggctcctggcctattttagtttctctctgttctttatagtggatccttaaggcatagagaattttaggaagagtatgagcatggaatagtaaagtcattgttgtcagcatacgacagagggaaagtcactgagtctttttgatccttggcttccttatcaataaaatactaatattggcactgtttacctaacagttattgtgaagccaaatcacaatagctaacatttattaaacaattatgtgttctaggcaccatgttaagagctttgcatgctttattaactttaatttcagggtaactttatggagtagatcattgtgtcctaatcataatggtagctaatatttattgatagttttctatctgccaggttttgttctaaggtctttgtgtgtcatagatattggtagaaaatggaggcaccaagagattaagtaatttgcccaagttaatttaagtagaaagtgtaggagctactattggaacacaatctgattccagacgtcttaaccactgtgcaatatctccactgtatagatgtagaaactgagaaatagaagcacagtagcttatccaaagtcacacagctagtaagcggcagatcttaccttcaaacaagattcgccattgcgcacatcattatctgttatgcaacatggcttcaaagtctgagtgatggcaccaggtactgctctgagtgctcttcagcctctgtcctcagagtcaagaaaatgtgtaccagtggcgggtccactagaagatccactgcactacggctgttgccttgtgtattcaaatccacagttcctcatgtcctgaggtcagcgagccacagagaagtgggctcaccttttctaacttaatcagtgcactgacagaggaacaggttacagagggatttctctgggaaagctgtggtgccagggcttgcttgtgcccagcaagggaattagaaatgccagggctaattccccagtggagaatgattcagaagaaaaatgaattcctgaaggctgttgtgttatcagtgccaggtctgagagagcagggcaggaatatgatggcttgtctttggaaaacatccaaacaactttcagtttcagaacagacttcactacttctcttagaacacttactgtcctttactgtaatttttgttataactggaggatagaaggaaatatgctatttgattttatgtacaaagaattttgagtccattgagctaataatgtctcccaagacaataccagtttatggagaacttggttttttgtttttgtttttgtttttttttgagagatggaatctcaccatgttgcccaggctggagtgcagtgatgtggtgatctctgctcactgcaacctccacctcccgggttcaagcgattctcctgcctcagcctcccgagtagctgggattacaggtgcgtgccaccatgcctggggtaatttttgtatttttagtagagatggggtttcaccatgttagacaggctggtctcgagctcctgacttcaggtgttcacctgcctcggcctcccaaagtgcagggattacaggcatgggccaccgcgcctcgcccaattatggagaaatttgaaccataatatgaatgttaatttgggaggaattctactgcagttcattttggaaacttgaaccaagtaggaaggattttattgttaaaaaaatctgatcacattttatgtaataaaatgtcaaacatgcaaggagagagtaatagggtaatgacccaccatataccccttgcctagatttaagaattgttaacatttggtatatttgtttaatatgttatttaatagtagtattttcaagcaaataaaatatatgatattttactcctaaatacttaaatagttgcctctaaaaaagaagaacattttcttacataacaaaattactatttacatgtgtgacaaaatcaacaataacctatttttttcttttgtttttgaacattttcaaacctgaaaaaatgttgaaagagagtttgctctttatctaggttcagcaattgttaacctttttccaaaagaagttataggcaaggctgggcgcggtggctcatgcctgtaatcccagcactttgggaggccgaggtgagtggatcacgaggttaagagattgagaccgtcctgggcagcatggtgaaaccctgtctctactgtaaatactaaaattagctgggcgtggtggtgcatgcctgtagtcccagctactagggaggctgaggcaggagaatcgtttgaacccgggaggcggaggttgcagtgagctgagatggagctattgcactcaagcctgggggacaagagggagacgtcactcaaaaaaaaaaaaaaaaaaattaaggcacaatacgtgaacttgaagaacatacagttctcttttatttaacaaacacttacgtaaccagcccggtgctgtgcgaagtgctttacattgtctcgtttgatttacttaataaactcctatttgaatcaaatggggtggagtaggggcttcctggaatttggcttacctcgccatctccccccaccctttcccctcagtggagaggcaaccagagagaaaagaaattgagctgctctgaagggcaaggcctcctcctacttcccgcagctgtttcgccagacttgaccttcttcccttagctagaggcagggggtctccannnnnnnnnnnnnnnnnnnntgggcgtggtggtgcatgcctgtagtcccagctactagggaggctgaggcaggagaatcgcttgaacctgggcaggcagaggttgcagtgagccaagtatcgcgccactgcactccagcctggcaacagagcgacactccgtctcaaaaaaaaaaaaaaaaaaaaaaaaaaaaaaaggtaaaaaagaggttataggcaatatgagattttccctaagtactttagaatgcatttcctaagaataagacattcttttataccataacaaattctattattatacccaagaaaattaaccttagtacaataatatgacctaatatttagcccttattcaaattcccccagttgttccaaaaatgtcttttgtagctctgtgtgtgtgtgtgtggtgtgtgtgtgtttgtgtgtgtgtctgttttccccagtgcaggatccaatcagattcacatattgcatttagtaataattatgtttctcctgattcaaaaagtgtctctccccttgaccattttgtttgtttttcgtcttaacctgttttgaaaaaaactttagaccactatcacacacgatgggttctttatgattaaattaggttaaaatttttcacaaaaatacagcataaatgattttgtgaatttcttattgtatcttatcaggatagaagcaataatttcttaaaatattatttaatatccagtacatattcaaatattcctaatggtctcagatgtgtttttttacatcggcttgctcaaaccaaatattgtacaccatttaaaaaaaatcgacatagaaaaatcaattacagtctttttgagggggagggggaactcctaaaccagaataagttcagagaggccccctgaccacagtcttaatttctattccttgtaaatgcctcagagtaattcttaggcttctgctatatggaaactacatccctttgtcttttatacaaattacttgaaaaaaatggaggtaatttctcttgattactttaagaaatgaagtagaatttttgtagaacagtatacaaaccataaataaacggcttgatgaatttgcacaaattgaacacacccacgtaagcaggtctctgacccaagaaacaggatttttcccagctccaaaaagcgccccttccagattccccaagggtacctactctaacatccagcgtcatgggttcatttgccttatgcaaatttcttctctttccctgaaaaaggaagcacgaagtagagaagccatacaaaatatgtatattttaattaggtattttgaaagcccaccttcaaagacattttaaatgatatactgtatatattttcacacaaaataattcccacaacaatgttttacataatggtttcattcaatggctccccctgcttccctagaattgggatttcatccaaaacactaaaggttaagttatcaatagaactcaaagagcattttgtttccatttgtataagtcgtttaatgttttttaagtccacgcatgtgttaacaaaggaggcagtcaattacaggggagcttagcaaggcattcttagagttctcttcagtggtgagcagtgtcgaagtggaatcaggaaaagagcaacccttttcactgaaggaaattattttaattagtaattctcaaagggtaataaacagtcaaatatttctgaaatctcctggctttggggcaagtaattacaatgagcatgcaattaaaaaaaaaaaaagaaagaaaactaagacgagggcatgtacaatcaattaaatagaagtaattacattatgagggcttcatgagtagtgtacggtgcattaacattgtggagacaaaagccaccagacagcacattgtatgtgcaagtcttttgaatctgaggttggttttcatggtcttctcgattctacgttgtggggctctgccactggtagtcggtaactttctaatgcactgaactggcaggagtgatggcagcatgcctatttgtggtgtctagggaagccttcttaaatcattggtatgcccagcctaaatcagatcacgcggatcctgcagtcggtatctgggtgatactgtgattggtacatgagtgtaacttggctcggtgtgcctggagttttttttagcagggataggaatctaccatctctggtgtgtttttcaatgtggcatgccccagtgacattagtggagaagggacttgctaaagttagaaagtaagattgaacagctgggttcaaggccttatactaggttcccaccagctgtttcaaagggatggagaggagccacccagagtgctttgcagcagctgtgaccccgaaccaagggaagctttatttcgaaagcacactaagaatagatacaggctcctgattttaaaatacagcggacgattaaaagctttctgggtataaacagttcaggtcactttttaaaaacacaagttaatttcaagctatatggaaatttacatgtgtgttttacatatgtatatatatttatacacatacatatatgcctgtatatatatattctgatatatgccgattaatctctctaatctatattagctctgctttgaatgaactttgtcgttgggatgctttggcatcagggcttcatagcattgtacttacatttattcagtgcctttggataggaacgcctgtagtttttttagttctggtcagttgggtataaaatattgccatagtgtcagaagcacagtgtgtgttcagacaatgctgttgaatctgaagtcatgcttgtaataaataccataaatagtatattttgcaacttcttaaaatgtattctataggatagtaataattaagtgaaaaaagttacacataaaatgaattacagaaatgtgggattaagctaattgaaaactagaatcttttatatgcatatgtattgtataaatattaggagaggaatataacattcagtgttttccatacttatttgataacagaacccttttgggtgcaggggtgagggggattatcttctaggactgatgttttatagaacatcattgaggttaccttgccccatagctgtgtctcctcacagtctggttgaacctgaaagcatttgttaccggagaagtagattttaggtggaaataccagatgcagttggcagaatcagaagtgtctctccctttgctgaattcacaatgactttgtattcactaattctttctcctaccccctcccgcaatgtttctcacatttggcaacatatgataacatttgtacattttcccgcacttttgtattaatatatttattacgggtctgagtatttaaacatgaacttttttctcaagtcatttaaaatgactacaattcctaacccagaatgaaatgtttcttctaatataactatttttaatttcagaatacattgcaaaaatgttttttgtgtaaatgttttaaaacataagatattatcatgaaaaggtaatttcttagaaaaattggaatttatctctactacttttttttgtttagagaaaatttaggaaaagtgaatgtacatcttgaattttagttaagtaattacagttatatagtcaattataaaggctggttacatagcttattatagactgaacacattttatacaacagccctatttgaatattttccctagttattaaaataatgaaaacattaataaaaactaaaggcaatatgatattaaaagcattaataaaaatggaaggcaagttaggctaaagttactatcagagactggcttctgaaggaacaggttttggctttccaagtggcagggccttaagaatcacatccccagctctggcttagggttccagcattgctcatggcatattcagctgttgccttgcatctccaaatctatcttcagagtccttttacctcttccttttaggtcatagtggagagttggcgttccgctttgtatttatgtttttttaagtagtatttgtatttctttctttcctttctccctaacaactacaggatcacatggacctaatttgttttattgtcacaagagtcccttttcttgacaggatatgcctaattaaaaccagggtgttaaaaaaaaaaaaaaagctaagttttgcaggcaagttgacatactgtgtgactcaagggtttcaggagggacaaggagggatggtggtgtgttattgaagcaagaggaggaccaagcctgcaggagatattgttccaggacaaagtcaggctatcagcagtgctgacggtccacctccccttttccttccttcctaatggcccaagttatgcacgtcagcctctttgggttcacaaggcagtattgtatcatggaaaaagccctagaccttattatgagaacaagatttgactctgctctgccacatggaaactaagaacttattaagtaggtttacttcacccaactctgtttctgtatcttttttttgagacggagtctccctcttgtcacccaggctggagtgcaatggcatgatctcggctcgctgcaacctccacctcccgggttcaagcgattctcctgcctcagcctctcgagtagctgggattacacccgccaccatgcctggtgaatttttgtatttttagtagagatggggtttcaccacgttggccaggcttgtctgaaactcctgacctcaggtgacccgcctgcctcggcctcccaaagtgctgggattacaggtgtaagccaccgcacccggcccatttttatttcttaaaaacagagattagtaagcctgttatgtaatgatcaagttaagatcatttttgaagccataaaatggtatataaatgtcaactattattatcagacattaacagcatggttattgtgaatattatgactaataattaatatgaataattattattgtaactatcattattaccatgattgtcattattaggaatataagtagcaattcattcaacatacatttattatttagtgtctattgtatgctagatatggtggactttcaggacccatggtgtatagtacctggtagaggctcagccgagcagtttgcagaatcaacaggaatgaattgagaatgacttaatttgtttaatagaatgtgacagcattctctagaatttgttcctttctggggcaagtaaggaacaaatcttcctagattagttttatgagtacttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagttggggctactgagaagttgaaagctgctttaaagtctcctttcattttaacaccattaaaaaaaaaaaaaactcatggaaaggaaaaatctaaatgtatcctgtaaagaaaataccatttcctctggtaattatgatggtctatatcctgtttaactcattgcacggggttcctctccaagtcaatgaggattgcgtaaagagtctgaaggcaggatgtgcctcatagtgggatgagaaggagccttgtggctggtcgtcagactaaatttaaaccattatttgttgtgaatatatgattaacgtgggggttaaaaatgaaaaatacagctgcaagagtaggtttcttcctttgataaaaacagaaaaagtcaggagggacaagaagaaaacaaacacagttacgtgaggcatgcattctctttcataagaacagtcaaatatattttagcctaatctttctttctagatacaataaatgccgctcccttctggattaggcagatgacagcaataacagtattgcagctgggagtctcccaggctgacaggtgctggatataagatgccccagattgtcctgtgaagtacaggacatgctaggccctgctggatctgcccaaggagagggcagctcctgtgtctgttgacacctcgtttagattctcccgctcactcaaacagctgccagaggcagccgtaaaatattgcttaattatagaacttcccttgatcctctttatcccttccttctattgcatttttcccccttttgtgcctctctctagttcagagcacctttaggctaagcactcatgggagtattatggtggcgccttttccaactcacagttaaggcagagacaagattttcagtcctgcactatagctgtggaattattttcagaggctgtaatgagcaggtataggttcaaatgtggaatgcagcatcattttttaagcaggaaatgggttcattttggggggaggatagctttctcattttttttctgattagaaaaataatgcttattgtacaaaaagaacaaagaaatgtaaagatatgaataaagcctacttcccccttgttcatatgtgttctatttaccaaaacgggattatgttcactcccacaatatattttagcaaatacagatccatgtaatttatcatgtctgttcagtcttccactgtctgactgtaccataatttgtttaaccattctatcatcatacactaaagatagaaacaaaaccgctgtggacatccttaagcatacattctgcatacttgtattggtttggagtcatgtttgtgatttacagggatgcgaaatgagatcatttatttctctaacattaaggaaatctgaattaaggaactcaagagctggtttgctggctccgctgcacctttctgcttagttgttcttactgagtggcttccattcctcataattccagctgtctgctgcagctccagccatcacgttcatatgccaggctggagaaaagatggaagggtgggaagcagaaacgtatgtctattgcttccgtttaaaaacctttcccagaagcccacacagcacttctgttcattgtctagaacttagtctcttggcaatacttagcacctaaaaagggagagcagatattccaaagcaacaaccatctctgtcattcccatctaattgttttctgggaataaaagctttgtgcaaatggacttactggatcaaagcttttcccaggtttttgttgcatattgatatactgctcttcagaaagatggtaccaagttaagtctagtaatatgcgagaataacccgccgtaagttttcaggttcttttgtgtgcattttatgggcatttttaaagctatttttctgaagctgcattttttcttttgtttattaaatcatacattctataaagagtgaggtggagattttactatttacaattttgtcttcaaaatctatgtctgtacaagtagaatattcattccaagcactggaaggacattttaatgttattcgcacgtatttcctctactcctaagaaaacttatttggaggttgccagttgaattaatacattaatcaaagtaaggcagctctctcctgttttgaaaaacttcctgtcaattaaatacaaggcacagtgtaaaagtggctctgcccaagttagtgtttagacagaaatgtttgtattacaccgtggtgtgaccatcagcagctccataaataaaggaatcatctgccggcgcttcccaccttttgggtggggtctgttttctccttcagtggaaggacattggggtcatcatcattactgctgaaatgttattactttagattttatcaaaaaacttggtgtcaccaggtctgaagggaaaaaaaaaatcaaacttttttctttttaccctcacacaccatccaacacagcacttccgattccctagcagacaccaactgggtgtcctgtaatttcattcaattctgacactacctacccagagatagtatcagatctcacaggctaagggcttagtcccacaagactgcaccccctccagcccacctttttagatgccaattgcaagctacaggtggtgacctgtgcttctgactaactccctccttggatttgatccatttgctagaatgactcacataactcagggagacacttcacttacttttacccatttattagaaagaatgttacaagggattcagatgaacagccaggtggaagagatacataggacaaggtacttggagcttccacaccctctctggatgtgccaccctccaggagccttcacatgttcagctatccagaagctctctgaaccctatccttatggatttttatggaggctttattacataggcataattgatttcatcactggtgatcagctcatccttcagcccctcttcccttccctgaaggttgggatgtggtgtgggactgaaagttcgaatcctccagccatgtggttggttccccctggcaaccagccccttcctaaggctatgtaggagcccaccaacagtcacctcattaaaacaagagaagttcctatcacccagaaaattccaagggattagaagctctgtgtcaggagccgaagtcaaagaccaaatattaaaaccaaagattctcctagcacccctatctacaagggttataggaactctagatcggcaatggtgacagagatttatttcttaatatatcacaatatcacacatggtttcccgatttggttattcaaattggtttatattagctttttttcatctttctttatcttgcgagtgttacagaataaaactcacttctcttcaaagttagaaaagtgaccagccaaaggattactatcactgagggatcatttagaaacaagtgattattctaatgctactaacttaaataaaaaaaaaaaagttggtgaatcagtagatggccgtgccgtatatattcttgcaactttcctataagtttaaaggtatatcaaaacaaaaagttatatacgcacaaatagatgttgattttatatgatttttatctgctactttcatgaagaaggatggggtttgaagtcataattgaaacaggtacatatttttgtactttgttaagtaaaaaattaaatcaatcatgtattttttattaacatccacttgtgggtacaaagatacttactgtttggagtttgcataaacatacttgtttaaaaacaacagcattttttaggctaaatctgtttttccattagttgaagtcatagaaccttcaaggcttcctgcatttctgtacctggtatgtcccctcacattttggaactattatctccttgtaaattattagaaaaattaaattagattaaaacttcttgagcatttctttattaggaaaaatggaaatccattacatattcttttgcttgcattcaatcttactgtgctttttactgcaagctgaagtcccctttctactttaaatgggagagaaaatcttgtgctgacatgagatgctcattaccaccaaggcactcattaccaacaagggcagtaaaggaatcgcagctttggctgcctctcacactgaatctgagagttgctattattagaatgcaaaaaaaaaaaaattgtggggtgctggtgggggaactatgtgagacttgtggttagctagacctgtgttttaagaatatttttgtctctgagtcaattgttacttaactactcgactatatgaaatcaagtatatcagccaggtgcagtggctcatgcctgtaatcccagcactttgggaggccgaggcaggcagatcacctgaggtcaggagttcaagaccagcctggccaacatggtgaaaccccgtctctactaaaaatacaaaaaaattagcctggcgtagtggcgcatgcctgtagtgccagctactcaggagactgaggcaaaagaatcacttgaacctgggaagtgaaggttgcagtgagcagagatcgttctccagtctgggtgacaagagtgaaactccatcttaaacacacacacacacacacacacacacacacacacacacacacacacacgaaagaaatcaagtatatctgtagtttttgcagtaaattgatgtctaccattatttctctccattttcttgtgttcattgtactataaggtgtttattgattttttttctttttttgcatttgaattactcagatccctttaaacagtttggatagattttcacaagggaaaggaagggaactaatatttatagtgtgtcatgcatatccggcactgtgctaggtgctttacttttgttatttgatgaaattctcaaaacagcctcatgtaatggatgttcttatgcccattttacattggaggagaccaaggcttggagatgttacttacagtagtctcttagtcagttaatggcagaaacagatctcaaatccactgtaccactctgcctcatttgggtgatattttcgactgaagatgccaagaaatacacgtaaagaaacattgtaggctgggtttgaaatgtgaaccataagctgtgtttcctgataattattttcaaggtccccagtagcactctccccttcctctgaagcctaagttggtccctttcgatgcctcagtttttgtctttgatcctccaaataatttcttgcaaaatgggaacctcactctgaaaagcacctctagtctctcttgagatgccggggttcatgccagccctttttccagttcaagttgtgtcatgcctttcaaacatgtgcaaaaagaaagtggctctgatggccagagccagggtggctcatcctcttcccagaattgaaaaaaacaaaaccaacaaaaaggaattaaatctcttcacatgaatagaggagaagctagcctaacccaaaagaatttttggttttaaagaggatttgccttcttttttgggatgagtgacatttaattcacttggccccattagaaagaagagaaaggagggcagtgcagctttagcttcgacatatttcacatttggagtggcttcggagcagccaagcactgggtcagtgtcccatttaagaacaactggaaaaaacaacatgttaaaaacgtgttaggcacagagagcatggaaaaacaattgtcaaagtattttagcatttagagtagcttagtggctactctaaaatactaacttctttttaagacttattgtgagattgaagctgattcctagatgttagatgcagttgatatgggaaacatttctaacatacagctgttgagacagagtgtcaggctctggaccatttataataacaaaaacaatagagtctgtgctgtttaccaccatactgctcgttgtttcactgccactttctccctgctcatttgactgccagctccttgagggcctaggtattacaggcactcatcaccgtatgcatgttgaagtgtcgtgaattcatcactgagtgcctagcaaatcccgacatacatatttgggtacagcatcacttcatctggatcttgggtgtagaaatagcaccatattctaaccctggaagaaactggctgcattgggcttactgaaagataatataatgtacacaaagcctagtggactgtatattcaaaagtttttcagtggtaatttttaccacactccacatttgccaaaactgattttggggagcagagcaaggtggcacgcatgtgtagacccagcctcgggaggctgaggcaggaggatcacttaagcccaactgttggagtccagcctgggcagcatctctttcaaacaaaagaaaactgagtttggaactgaatccctatggaagatgtaccccactgtaaatacttgtctaatgaaaaaatggatgaatacattccacttcctattaattattctagaattcactattcatgtggctgggcgtggtggctcatgcctgtcatcctagcactttgggaggccgaagcgggtggataacatgaggtcaagagttcaggaccagcctggccaacatggtgaaaccctgcctctactaaaaatacaaaaattcgtcaggtgtggtggcacacgcctataatcctagctactcaggaggttgaggcaggagaatcgcttgaacctgaggggcggaggttgcagtgaaccaagattgtgccacttcactccagcctggttgaaagagtgaaactccatctcagaaaaaaataagagtaataataattcaccattcataaagcgtctcatcttttctctacttctgattctcatcccatgtttttgtttgtgagaaaggagaaaagtgaaataaagactctaccaagtacatattttatacttgacatctggaaataatatcgtgaaatagactctcacattgttgtggagttccaacacaataaacttaaggtgatttatacatcttttatttattttattttattattatttttgagacagagttttgctctgccgcccacactggggtgcagtggtatgatcacggctcactgcagcctcgacctcccaggctgaagtaatcttccgcttcagcctcccaagaagctgggaccacaggcatataccaccacgcccgactcatattttgatttttttttttttagagataagatctccctatgttgcccaggctggccttgaactcctatgctcaagcaatcctcctgcctcagcctcccaaagtgctaggattacaggcgtgagccactgtgtctggactatacattttttaatagcattattgatcctggcatgagaggagaaaaaaaaatgctggtactaataataaaattgtttgcaacgcagccaaagttctttaatatggctcttggcccaaatcaaacaagcaacagaaactcccagtccttttttttttttccttcttatgttttcacaaaataggaaaaatgaggttaagcaagaattttgctcagtttgcagaggcaaagtgaggcttgccagggccgggtgctgttggggtgcgtgcagcatatgacggggtgtctctaacacagtgactgaactgttcaccttctgaagtgaggctcctgagtcacacctggggctgtcttgatgagtcaccagccttccaaagtggttttctctgggaagtggcacttcacagtgccacttttttttcccaccccagggacaaaactctggtaaatgaatccctgcaggaaccacgggtattacagtcctgatttggctcatctgctctttggggctgacagcagctttgcttgactcagcttctgcctgactgagtaggttcagacagaatgagtctgcagaaaagtcggtggtgctcagtgggaaggacgtgagggagatggatcaccacagctggccagggcagaggcactaggagacctttcacatggctgctgtgcctactgctgctaacttaaacaagtggaaacttcttggcaagtctgtgagggaagtcgaggattagagcctggtagttaaaaatacaatccctgccattcattcagaattccagagaatgctgaaattttttgaattggcaagtgaatggtagagaccggaaccatacactgaaataacttctctggtcttgtatcatcttttattagaggatcctaaaaaaatcccctatttatatatcagttattatttctgtgtcatagactgcagctatgtttgatgagctgcttaagtgaaaatctgaccggaaactttcaactataaattctttgtggtttcaaagaaggatgaactttctcatctaacacatttctgctgtgtgaagagtcacctttattatatggcatgagtctttttttttttttaatagctttggggtttaaactctgaatgctttgctaatagatgtgtcagctgtgcacattggcagcttgacttttacctctttgtatcttctattctgatgcattaaaaatagcaggagatggtgccgtttaggatttgggcagaatggaagaatcattataaccaataatagtgttttaaaagctgccttgggacaaagaattattaattagggtggtagaaagaatgacaacgtgggaggaagattgattagggtttctagaaatacagtaaaacctaagctatgtatctcttcaaccatgtgaagagctattactttatttctgattgtcaacatatcgaagttcaaaagccgactccacattatgcaaatagactgataacgttaagcagaggagatcaatgtactggatggctactaatcttaatattgtcgccaggcgcggtggctcacgcctataatcccagcactttgggagcctgaggcgggtggatggcctgaggtcaagagtttagatcagcctggccaatatggtgaaaccccatctctactaaaaatacaaaagttagccaggtgtggtggcacacgcctataatcccagctacttgggaggctaaaggaggagaattgcctgaaccggaaggcagaggctgcagggagctgagatcgcaccattgcactccagcctgggtgacaagagcgaaactccgtctcaaaaacaaacaaacaaacaaaaaacctaatcttagtattacaaacatgatcaggtcgggttgctagtttagatgtgggtggtgagctgagcatccactgcgatggggcttctactgtcatgggctccctctgtgatgtggcctcccttctgtgatgagctccctggggtttctcctgcaatgggctcccactgcaatgggcttccactgtgctcagctcccattgcattgtggttttaggtgacagcagagggactacctggagaaagtgtgcatctgggcctgggagaattagtaagtgtgcataccacccctgtctttgttcttgtggttaagactcatctctggtgttggttagcagagctaagtaccgttggcaaaacaaaaggtactactaaaagaaatgtaagatatgagtaagatatatgtcatttcctaggtcttgaaatctaaataagatcacactaatagaatgtttaatttgatttaaatgcaaacagtatttatccccaacatacaacgagaaagtaaaccaccttttgcatacttgtattctaattccagttgaggaaaattttaaaagtttaatataagtcttcggcaagactccttgccatctggtacaggattaaaaattggcatagcatttgttgtctactgacagtgggtcagatttacttggcaggccctatctgggaatttatcaacctcatccaaatctgtttcagtttccatttttaacactagtgggtctaattggactgagtcacaagaagcaagttgcaaagctgtttcatttagcaaattttaagctaattgtcttcagtatgtacatttgttttaacattaagaggatggtgaattggcctagtaaatcaaaaaagttttaaaaatctgattttctgaaataagacagtttgcttatacttaaatggggattgtaaatatcataggcttggcagctttttttcttttttgttttttaagagctagggtctttttatgttgcccaagctggtctccaactctggggctcaagcagtcctcccgcctcagcctcccagagtgctaagattacaggtgtgagccaccacacctggctagcattatctgtggaacatttcttctggaagagcttgtattctactggaagagaaaaaaggaggtagtaaggacagaggctacagaggaatttcactgaggggatgaagacagggagcagtgagtatgattgagttttaaaccagtctgccttggttttatgaccccaggctgtctttaaattctcatctcattggtgtggttctctttaactgctcagctaggttgtggcaaaagaagaggcagtttggaggctgcttccaggtcccgtcctaaccactctgctgatggaggggagccctgatgtctgacactgtatgaaactctcatttattaaataaatggtgggcagaaaaaagacaaaacacttatgtttgaagacaaaatctttgcccatagaaataagcaacatgctgctaatagttttaaattctttcaaaatgaagcacttgtaatcattcctatttttatatctttgtatgcttccagcaatacaaaatacattacatgggattctctatttcagaaagtccttgttatacggcttccttcatcataaagttagtgtgggtaaattcatccaaaaacaccaggccttttcctgggtggtaagaagctggaggattctattttattttattttttttgagatggagtttcactcttgttgcccaggctggagtgcaataatggcgctctctcagctcactgcaacctccgcctccccggttcaagtgtttctcttgcctcagcctcccgagtagcaccaccatgcctgtctaattttgtatttttagtagagacagggtttctccatgttcgccaggctagtctctaactcccgacctcaggtgatccacccgcctcggcctcccaaagtgctgggattacaggccactgtgcccggcctgattattctatttttacagataagatttttatctttgcctttactatgtttgcacaatgtttttgatttttacacctaaccagtacatcacccatcatgcataataggtatacgatctatggttgttgaaaaaacttgaaccaagtgttgccaaccttggaaggccagagctgccttctctgcactcactgctgagtgagtttgggaagccaggagaactggccatgaaatctgtaagtgactttggtggtcataatattcccagaacagacctgctttatcctcacagtgaggaaccagtatattgttagcttttttacccctgtctcatgcatatgggtagtgtgactaggatatccaattagatcacacagggtcagagctaatattaaacccgggcacccaggtatatgtgactccacaactgcgtgtggtctttgcagagcccacagagtctggcagtaggctgctgtgtctgggagatgcctatgtgagttgtgctgttatttcatgggccatggtgacccagggggacttggataccaggtgtccttgggatatgtgcctggaggtgagatagtgaatggattgtcaggcagagagggtggggggagggaaggaggaagggaggaaaaccagaaagattggcagaagggaagcccagaggccattgccctcatcaaggtgaaaggtcatgaaggaggtagaaggaggtagcagtggcttgagaggaggaaactggagcaaagttaacaccccctccgcaggctgatggggaggccagtctgaggggagggtgacttggagggtgggagtgccaccccaccaatttcaaaacattttaaccccaaacacacaatttacctgttaaataaaatggctttctacatttgcgtctttctggaggaaaatattaatccatgagggaaaactgatttcacacgacatggtttttcataacctaccatttccagccaaatatcttctcagagacgtggtgacctttcttgccccttagcaaactccatgcttttgtccaacctgggcagttctctaagcagagactcataatgtaattggaggccaggaattggttggtctttctgggactgagagaaggaggctgtctgggaagtagtggtccaaggggctcttgaaggaaggggaaaaagcccactcccgcttatatttgttacaggtaccgttaaccccacataccaccagggctctccatgggaagcacttgtagaggatttttcttttttttaagtcgaggaaaaaaatgtttactgtcaagaaaagcttttcttccccgtaggaactgctattctttttctttataaacagcatgggatcaggtgattgattccatttgtcccctgatttgagccacacgaagataggagccaaaactgtagtttatcttcaggaactctttttgtttgtttgtttgtttgttctttgagactgagtttctctcttgttgcccaggctggagtgcaatggtgcgatctcggctcaccacaatctccgcctcctgggttcaagcaattctcctgcctcagcctcctgagtagctgggattacaggcatgtgccaccacagccggctaattttgtatttttagtagagacagggcttctccatgttggtcaggctggtctcgaactcccaacctcaggtgatctgcccacctcggcctcccaaagtgctgcttataccttatgacctgtgtattcatgcatcaattttcttttttgtctttttgtaccttcattagtatttttgtttttactggttgtgaaaacaatacataatcactgctaaaaatctggaaagtacaaagcagtttagataagaaaaaaaaaattaccagtgagcctgttatttgcatatatcaccataaatagtttgatatgtttctttttccttttttgttccattttcaaatatgaaacctgtacagtgtatgtatttatacaatacacatatataggcaggttaaatatatttgtatatgtgtgtgcatttccaagggaagttatacttttaaaacagcagagagtttttcttgaagtagactaagcaagggagtgaagccaggaaggaggtgggagtagcggggaagtggggattaatctagctaaattgtgggtcctggcaaacactgagattacactgtgaaatacgagaaaggaaatgactcagtaacattgagagagggagcagagatgagacagcagagtgaaagagtgaatggcgtatcctgggtttgggaagtggtgggaagtagggggagctggagcctgaggcactaagtgattagaacaataggagaatttagttttcagatgaaatcatcaaggctgtattaagtgcctcttgtgagcaatagctcactcttacttgttgcattcagcctgggagccactcttgacaccatgttagcgcagccttacagctgatgtcaggtcgactggtctgcagagccaggaatttgggctttcttctcagagttgttttggagcaatgagaactgctcacttaagaaaggctccctcttgtactccagcctttggggaatgctgtgagtgacacttttaattaacaaatccactgggaacaaaactcctttaaatgtgttggctgggtgtggagtttgaagggtgggccgtggaggctcccactgcactgcaggagtgctgggacttcaagccatgggtaagctcggtcagaactgtcaggatgaggtccacccagaaggccccacactctgtcccaggggatttaggctggcaagctgtgctggcactcctggggcaagatgagctcatctgccacttcagatgctgggcttcctatgctagatgttcctgctcttgccgcattcaggagccacagcccacttgttcagaacgggaggggagagtgggggatgagcatttaggaatgcatcattccagctcctgtattattcctagagctggtagctgaaattctgaccacggaagtgtccttgaacatcttccagcaaatgatgtatatttccacatctcaccggggcctgtgctgatgttggttctagcacagcatcaatatccatgatgtcagagagtctaagaaaggtttatgaaagagagaaggattcttttccttctggtaccagagtgaaaactatttatgtagcacatgtctgccttggaaaacatgctgctttaatagaatgagttctgaaggaataatcaaagcatttcttaggtctaattattttgctaaagggagttacttaattttgacatcctcatcaattagttcctcacttggaaggcctgtgacaagcctgaggctggctatgagtttccacctgcccagaagttgatggattttatgaaagctttaaacagaactacaattgtgaaactgaaagtgtaaactaaaactattgtttttattattatttactttatacttagggaaatgattttcatctctttacttcagtatttccccatcttttttttttgggggggatggagtctcactctgctgcctaggctggagtgcagtggcatgatcccaactcactgcaacctccacctcccgggttcaagcgattctcctgtctcagcctcccgagtagctggggttacacgcgtgcatcaccatgccggctactttttatatttttaatagagctggggtttcaccatgttggccaggctggtctcgaactcttgacctgtggtgatccacccgcctcggcctcccaaagtgctgggattagaggcgtgagccaccgcccccggcctttttttttttttttttaatcacatttattctaaaaccttagacctttagacccaagttttcacgcaaggcaatggatgagttccccttggcaataccttcaagtcttgcattaagaaatctgaataacaattttagcagaggaagcatttaaaaatgaggagacagactgaaaagaaaacaagacaaatacaacttcaatgcaaggaagtttctagactgattaaacataacgaaagtaaaagtggtttcctaccttaaagattcaaaggaggccattgttattcaaaagtgaggtgtgtttaacagaaacaacaatcatgctccttttgttgtatgtctaaggaaggtcaatggtgggggcctgactggaagagacccacctggttgtgaggcccaaaacaaagggctaacattcagtttcttctatcatgtttgttgtctttgatggatatggaaagatctctgatactgggctgggtgcggtggcttgtgcctgtaatcccagcactttgggagactgaggtgggaggatcacttgagctcaggagttcgagaccagcctgggcaacataaggagacacccacctctacaaaaaaatttttttaaaaaaaatgagccaggtgtggtcgcaggtgcctgtggtcccaggtactcagtaggccaaggtgggaagattgcttcagcccaggatgtcggggctgcaatgggccatgattatgccactgtactccagcctgggtaacagagcaagatcatgtctcgaaaaaacaaaaaagaaggagaaggaggagaaggaagatttctgatactgtttataaaacaaagtagaggaacgggatgaatctactcatcatatatatatatatatcacaaactttcactaaaggaagagtttgatggagtgggacagagtctctaaggtaccaggagtgacctgcaatgtgatttggaaggtggtaggcaaagctggaggccatgtccacctttcttagaatgtactggaaactctgagcagaagctcatgtttcatgttgggttagtttctctgtgattaagtcacagtaacaaactggaagttgtatgtgatcaaacatgtaatcatgtcttctcccttgtaaaccttcatgcctcaatatctaagtttctccataagctggcactagttgactttcctactattattttctaatactctgccttccagctaccctattgtcaccttgcttggtgacagtgagcttcttgagggttttatgtgtcacctttggggaccttgaaataccttacactcctactgtgagagctcactaatgtggtgttcagaagctggtttcatgggcccatcttttgcttgatgacagccaaagggatcctcattatgtcaattctatgagtcaggagagtatggggtactggctgggaaggtgagcatggctccccttccaggaaggagctcacactatggcactccagtgattggatggctgagaagcaactgaggtgctggggaatacaagctccacgggccgaggggaagttcactggggctcactgcatgcaagggctgtctggacagcgatgtcttgggcttgtgtttagagagctgcttgcagaatccccagtgtggcctaaccaggatgcagggaaaaataggcaagtatgtccttggatgaaaccaagcacaatctatcaaccactcaagcagatcctaagggaagaattagtgtcattaactattatgctgttgttggtgatgatgataatgatgctgacaattaaaaagataattaattgttttccttcttttagtcacatagaaaaaatcaccacatggcaagaccctaggaaggcgatgaatcagcctctgaatcatatgaacctccaccctgccgtcagttccacaccagtgcctcagaggtccatggcagtatcccagccaaatctcggtaagcctcaagcttttttaaaattaaaaaagatattttttttttgtagagttggggtctccctttgttgcccaggctggtgttgaactcgtgggctcaaacaatcctaacacctcagtctcccaaagtgctgcgataacaggcatgaaccactgtgcctggtggagccccaagctttgactccaagctgaagaaatggtgttcaatcaaggggtggcggggctcataagtggttctggctgtttctatgtctcttcatgcacccagacggtgtttgctccttcttcttggctgcaataccgtgttacccttctgccggctttttcttctttacttggtctctttaccaccaactcatgatactgctgcctcagttttaaactacagttctgaccttccctccaatggccttaattggggtagaaaaatcagttaggcctcctgtcttcatctagcctgaggcaagtaggacacatacacgctttgggtgactttggctcctggcgactgcctacaggtacaattctagtctcaaatccctatccttatttcccttttttcctttttttttcataattgctgcataacatgtgtcagatagcatgccaagtgcttccatgccttaccttatgaaagccttccaaaacccctgcaaaaagtagcaggctctccagtttatacatgaagaaactttccgaaagtcttgcagcttgtggagagcagagctggagagcaggctagtctgattttagaagggagttaaccattacataacctgcaggtggcttctccccatacctgccgtgggataatatggctcactttttacttcatttacaatacttaataagtgcgattttagacttgagaagagaatattttctgctaaaattatccccactagagataatcaccagtgaattaatacactgcagcaacggaaccagtcagcttttttggtaatcattcccttccttctcccccagggctaaaaataaaaaagggccaattttaaagttttagaaaagttggtgccattttcagataacatttccatttaagatcagatatccagatatgctttatacacagaacagttaattttagggagtgaaaagaatctcctgttggattttcaggaatgaacaagataaaaatggaagcgttattcctggacacccttccctcatactgtggcttagccaaagtgagtatgaactcaagtagaccctagtcagcttcaagtgtcagttcttccaggaagtctgaacctactgctttaaagcttgcagatgtacagtttccaaaaagcaaatgacatggaacaacctctgtggagttccttatctaaagggcagatcaaagaaaatgcaaccagttctggtaccagcagtggtaaaccaaagcctccagtgagttattttgtcccaaatatacaggagctcgtgtagaaatcagatgccactgtagtaaagagaccccaaattaggtggcattagactggtttttacagtttgtttaaccatttaattttcatcgaaaattctaaaaactgattattaaagttttaactttaactttgtaatcaattataatcggaaaaaaatctttcatgaacccagtttacaaaaaaaaaaagaaaagaaaaaaaaattcaaacacttcctccaatctccctttcctcagtccccaagtttgtttcctggagccaaccagtgtttctagttgtgtgtgtgtgtatgtttaatcatactaaggttagcatatcataaccactgttctgtatcttgcttttttcacctgcctgtccatacatatagagctgcttcattcttttaaaaatttgcctattagtctactatattaatatgctataattagtttatttaactaactcctatctggtagatatttaggttgttactagtgtgttgctagcatacaaatactggagtggatatcctttgtcatgttcttttatgcattctccttaatttttaaaatttgtgcgatatgtaggaagtggactaattaaaagaagcttgaatgcttggaactagatattgaaggcacatgtgagtctgcctgtatgtgcatacatgcatgcatatgcacacacacacacaaagtccaattgcactagtaaagtatatctaaagaagttgtaatctgaacattctgaaacaaatttacctgtagctcagtaaaataccttagtttccagatttctatttttatttaatttttgttattattattattattattattattattattattttgagaaagaggctcaccctgtcatccgggctggagtgcagtggcacgatctcagctcactgcaacctctgcctcctggttcaagcaattctcatgcctcagcttccccagtagctgggactatgtgcatgtatcatcacgcccagctaatttttgtatttttagtagagacgggatttcaccatgttggccaagttggtcccgaactcctgacccctggcgatccgcttgcctcagcctcccaaagcgctgggactacaggcgtgagacccggcacccagcagtttccagatttctaataaggcagtgaatttctcaagacgcacattctggggtttttccaacaatatttgtgtatttgcccattgcaaagtgtgtttctagcttatggagaatcacagatgtgtctgaaggatggaaatacaacttggaatgccaagtaagttccaaagaccaggacttaatttagagagtctcaatacagtcagaataataaatgatttactcagactatttcatttcaagccataactctgcctgtggttcatagtctttattatatatctttaaacatataaaaataaaaagagcagagctgggtgtagaggtgcatccctgtagtcccagctacttggaaggctctgaggtgggaggatctcttgggcataggagtttgaggccagcctgggcaacatagtgagacccccaactcttaaaaactagaaaaagaaaagagcagattcttctcctcccactcttccttcttcttaaatctagaactttggtacttttcaatggaatgtagctgtcaaataagtgaactaaagtgataggtcttctttaatgcaaggcatttatatacatgtgaaaaggatgtcaaaatacagttaatagcattactatcagatgatagaatagtaccttttataactaattttatttatttctagagccgtgatataatcagtggcatagttaactacattcagaaacaaatcttgtatttggtccctgtatgtttctgtaggttaggtacatggacttgggtgtctgactgccagaatttgaatcctggctctgtagttactagtttggtgacccttaagttatttgtctgtgctttgatttcatcatatgtacaatggggattattaatatatgaggaacttacgagtttatatatgcaaagtgcttagaactatgattgccacatagtaagctaaaatatatgtttattatcattatttttatggcaaaaaatattttatattttatttaactatagcatgttatattttaagacaatttaactgttctttataagtgctttctagaataaaaatgatttattttgggctggttagattgcaaagtgttttaaattaggaacaatgtattcattaccttcagtgaggatagtgccctctggtggaaatgtttaagttacctctcccaggagaaacttcttatcactagacaccttatttttcataagagctttagatgccgggcgcggtggctcacacctgtaatcccagcactttgggagaccgaggtgggaggatcacgaggtcaggagatcgagaccatgatggctaacacggtgaaaccccgtctctactaaaaatgcaaaaaattagctgggtgtggtggcgggcgcctgtagtcccagctgctcgggaggctgaggcaggagaatggcgtgaacccgggaggcggagcttgcagtgagccgagattgcgccactgcactccagcctgggcgacagagcgagactccgtctcaacaacaaaaacaacaacaaaaagagctttagatgtattcctgtaatgcgacttgtaaatcaaaccatatttttattgcaagaggaaagacccattacttagtcatcctggagtgagtgactttgtaaaaacagaggattctttctgcaggttggcagatttgttgaacactgagtctaagtaaaatgaaataagctctgaaggggaaaattgcaaaaatatggtttttttttgttttttttttttttttttttttttttgcactttaattcaaatagccatctccagtttggtctagcttaaaactaaaattttagtttttgtatttgccaaatcaggctttaccaatttggattctgtctgagcagagtaatggcctttaagcctgaattcccagacatatgcaataaatggaagaagaaaagacgaccttgggggactttagacttggctcactgcaacctccacctcccaggttcaagcaattatcctgcctcagcctctggagtagctgggattacaggcgcccgccaccacacccagctaatttttgtatttttagtagagatggggtttcaccatgttggccagggtggtctcgaactcctgacctcaggcaatccgcccatctcagcctcccaaagtgctgggattacaggcgtgagccactacacccagccagaagtttgtatgttttaagtaggttgtgggccttccttactattaatacttactaaaattttaaaaaagagaataagagggaaacaaaagagggaaaaaaatagactgcctacacaggctctgttataatgtataaaacaatgggcttgagaaaatgaagcctgctgcagatcttagtccttggttagagtggtggcgaagtgggcatggaagtgggatggagggtggggactgttttggaagaacttgaagtcagaactgagtttctcttaatttagacgtttatgtattgggttatttaacctctgagtctcattttccttatctgtaaaatggtgataatgatagtacctatctggtaacgttgttttgagtatttaggtagtccatgtcttggtacctgatgtatagtaagctgccagcacttgtattgttatagctattattgttagccagttgcctcatttttcctcccctttctggctcctgtgtaatcagaggaagatcctttgatatgctctgttagaaagccattccattcctccttcaggaagacccaaccatggttactgcaacttatatttgtttgggcacttttgcttacaaattgtgaaactagctggtgtggtaccaaaaaataacatttaacctcggacagcaattgtgagaagatgaagaggagcaagcttgtgactgtcaggtcattcacagagggagtttgtgaagagcagtcacacttctgagttctaagtgaagaacattttcccctctgcaagtagtgaagtgttagattttcccattcctcagcagacaaatactgaaaacatgcaacaacttaaagtagctccatattttaaaatgtttttaccaaaagaaagtgtcatgcttttttcctttctttttttttttgcctttttggtgataatcctagtgatcataaaccatggtgtgctgagctgctgtcacacactaatgaggctttttgttggaatgagaccctgacctgagatgctagtatccttcctgacagtacaggaaaaaataaagactataacaacttcaccagcctgcgaaccctagccaattcagaaacttttggtaaagtgcaactagagtgtattttcaatactataggaaatttttaaagttacatatacacacatgcacacacacgcacttacttacccctttgaagatgtgccatccaccagcccagagtctaagtcctccaggtctgtgtctcgagctgtacttcaaattataaacacatgtgtgtttttttttttttttcttttcagggcatacttttcaagacaagatggaaaatcttgtctgtgctcagtttgctaagttggcttgctgttctctctaggaagtatacaaagaggcttagcattgtatcaagagcaaataaaatagctaagggatatcgaagccctgggttgcttaaagcacttagaaagacatgctgaaagttcactagaagtcagatttctacttaggcatcttatgttttcctttttttccattagtttttttcttaatcaaatttacatggtgagttcacggcagacacatctggctactgtgatttttccagctctgatgttctcactgcttttggaactttgtggtttatgcagcatagattagcctaaagtgcaccggcacatacacgcacaaacccagagacaaacaaacaaaaaaatacccatacactttttgggagatggtggaagtgaagtgttgggtgttgtgggtgttgtaggtgttgtaggattgttgtggtggaaagtttgtgtttatggaagaaaaggaacactggtgggcacaggacagggggaaaggtttctatttaaaaatgattttcttgattaaaaaaaagaaggaaaagttttctaaacactgtagaaaatcaattttctttttattttgtagagattggggcgtctcaccatgttgcttaggctggtctcgaactcttagtctcaagtgatcctcccaccttggcctcccaaaatgctgggattacaggtgtgagccactgtgccctcaattttcttagattttgaggaagctatctattgtcaaatacactctagttaatcagcattattgaaggctaccttctttggggtttcgaagaggagattcttttttttttttttttttttgagacagagtttcgctcttgttgctcaggctggagtgcaatggcacaatctcagctcaccgcaacctccacctccccacaacctccacctcccgggttcaagcaattctcctgcctcagcctcccaagtagctgggattacaggcatgtgccaccatgcctggctaattttgtatttttagtagagacggggtttctctgtgttggtcaggctggtctcaaactcctgacctcaggtgatccgcccacctcagcctcccaaagtgctgggattacaggcacgagcacccggcctgaaaaggacattctttatagttcctttcttttacggtttttaaggaatatgtgaaatgagactgaaaaaaattaccaaatcaacggattgagttccttttatgtaataaagcaggacataatagcatataaaaaataaatcttatgttttcatggctatgttccacttatcttaatgtggatgagtctttattaagattaggtgatggagacttataggttttattatatgaaatttagaaatttaggtagaaaatttcttctttgataagaaataataaaagccatgaaaaatgtctgatgccacaattttccttaaaaaaaaaaagtagtatgctaggtgaatattttgggaaccatacacaaagatgtgttagttataatagccagtaaataaacaaatgcctgaaatatgaaaataaataaatttatttatttatttattttctgagatgcaatcttggtccgttgccctggctggagcgcagtggtgtgatctcggctcactgcaacctctgcctcccaggttcaagccatcctcccagctcagcccccgagtatctgggattataggtgcccaccaccacacccagccaatttttgtactttttagtagaggtaggttttcaccacgttggccaggtgagtctcaaacacctaacctcaagtgacccacctgcctcagcttcccaaagtaagtgctgggattacaggcttgagccactgcgcctagccacaaatatatttataagcagtgaaataatggatatagaccatgtagacacatggaaaactttgttgtaacattctaattttacacagcatgacaaattgtttatgctataattatacttctatttttttgaaaaacacattgcttagattctttccattttttcacaagactaagcttcttgaggacaggaacttgatctccatctgtgtatttctagccccaagcaaagctcattaggcatcataggtgtactcttctgtagaataaatgtgttgagtaagtcagttatgtatttttaaatgttaatagtgattatagttaagcctttgagttaagggtgattccctctattttctctgtaatgcggttatattacttttgtaatagccaaaaggagaaaaaaaaaaaaaaagagtgagaacaacaggggagaaccttgagctttttgtggtggaagaggagaacagtgtgttggaaaaaaggctccaggccccatgtgtattaaagacaaaaccaagaatgctcaggcctctgcagttgagcaagtctgcctgtggcaaatagattattcactagtctctaagatcagtgtttatccaagcgtggtccagatctaccactagctggatcacttgggggcatttgttaaacatacatttttagaatacagtggtttgtttgctcccaaaagaattatcctgggctgctgctaggaggaatatgccctggaaatttctgtgtcagtaaatgtagggtggaatctggaaaggtatgctgttttcgagtgctcagatgactctgatcatcagccaggtgtgggagccacaatcaaattgtgtatgttaaggccaagtgcagtgtctcacacctgtaatcccagcgctttgggaggccaaggcgggcagatcacctgaggtcaggagtttgagaccagcctggccaacatggcgaaaccccgtctccaccaaaaacacaaaaaaattagccaggtgtggtggcacacacctgtagtcccagctacttgggaggctcaggaaggagaatcgcttgaacccaggaggtggaggttgcagtgagccaagatggagctgctgcactgcagcctgggtgacagagccagactccgcctcaaagcaaagcaaaacaaaacaaaacaaaaaaagaattgtgtacgttagcacagtgatgggaaaatgccagtataataaaaatacaagaacctactcaatcgttcagtctttaatttatctgaaaaggacttggagtatgcccaccaactttttaactgattctttgtctgaaatagacatttactagggcattgacttttgtcattttggtgcttggtgttagtgcgcacatgagcattgggtaagtgaatgctgaagcggcttcccagagcatcttgaccccaaatattccaagtaaacttcaaaaatgaggaggaaaattatagcttgggatccagattcttgaaatgtattgtttaatccactgggtaaatgtacaagtctgcttcagttttgcttgcagagagtgggcctgagaatccatcaggccttcgtaagcctaaaccgtgacgaattccagagaagcacccccacacctggggaagagggaggccttttaggaaggtgaaggctaggtcaaacttgttttcttttttagtcctttctttgtttgcaccacattaattaattagttaattaattaatttgtaatggagtctaatttcttcaccgagctgtagacctctgttgagagttttaaaaataattttgacaattttcatcctgtttgctggctgacttccaaaagtttgccctcaggagcttccttgctatggagaatttcacccagttaagggtgaaaggcaggcagtgggattcgaggtggtttgtcattcagccacttgttccaaattgataagtgctgagtgatattttgacacttctctttgatctcctctttggcgtccctggtaatattgctcccgcctgtgtgtgatcatcacctctcccacccaggtaccaactgattgatttcttcttcctttctggaagtctaaatttattccctgggtgttttgcagttgctggtggtcaagaacagctgttcttccatgctttattctgaatagttctccaggatgaagtcagcaaaacaatatcatttaagtgaagcctcaggaaaacaaaagccttgattgtctttctccttaagtgctaaaaagaagatcacccctccccctttgtgtgtgtgtgtgtgtgtgtgtgtgtgtgtgtgtgtgtgtctgtattttaaggcagaaaaaaaaaaggttctaaacatttttgaagcagcaagattcaagaatgttatttttttccatattacataattgctatttggtcactgtagaaaatgctgattggcaaaacatgagaaaataaaaagccatggtaccattcaaaatgacactagtgtgttttcatatattttcttgactttcttcaatgcaaacataaaaatagttggaaactcctctatattcttttttgtagcttgtttttaatataccatgagcatcttcccatttcagtaatttttttttttttttgagacagaatctcgttctgtcgcccaggctggagtgcagtggcaagacctcggctcactgcaacctctgcctcccaggttcaagccattctcctgcttcagcctcctgagtagctgggactacaggcacacgccaccatgcccggctaatttttgtatttttagtagagacagggtttcaccatgttggcgaggccggtcttgaactcctgacctcaggtgatccgcccgcctcggcccccaaagtgttgggattacaggtgtaagcaactgcgcctggccagtaaatatttttctataatattttttgatgagttgttttaattagaaaagtaacacacgcatatggcaaaaaatccaaatagttccaaagggtatttatgaaaaattaggtctccttcccaccatgacccccagcccttttctcctttccagggaaacactactaccagcttcctgagcattattctagacatgctctacatacacatgcatgcttgggcatatacagtatgtctttttaaaacttaacatatcttagagagccttccaaattagtacttactgatttgttcattgtttgtcagcaatatgtaatgttccactccgttgagataccgtacttggtttaaccagtcctgtgtgctggatatttagtttattttctggttggtcactattactaaacaatgccacagtgtgcagccttggacataaatccttgtgccatatgctgtttatgtataggataattttgcagaagtggaattcctggatcaaagagtatgtacatttaaagtttttaaaactgttgttccatttctttccaaaaaggtataccaattgacacccctaccaataaagtgtgttttcttccccgtaccctggccaataatatctatgattaaacttatagcctttactattctgatagctacaaactagattctcagtatgttctttttttttaacttatgaatagacttggacatacttcttttgttcataaaccatcacatcatgttaatggctgcacagtagtccttttgtgaatttatttaaccaataatgccataatttatttaaccaattcttctattgagagacatataggttgattctattttttatcattataaatgatgtttcaatacattttcttgcacacacatacatttttgtgcccacctttaatttcctcacttttccagtttctttggaatgtttctgaataaaatataaacatttcttaaaaaatacaattttgacatggtttgcttttatcaaactaaggaattgtctaaagatcctggagcaggggattttttgcgggggggggtgttactttcttttaaaaaataatgtaacattaccacaaaaagtgtatttttaaccagccacctagctttcccactaactctgtttttcagcttgtatatccatatgtttttgactaagccataaatggaagtttcgttggaagttattttgcttcccagtacatgtcatgcatttcattccatattattttcgtccttttccttttcagtattatatttctcagataccagtgaagagtgagttgtgagttttgaattttgccaagacttaaatatttgcagcgctggaaagaaagaaagttaaaaaaaaattaatgtggctgatttagtcttggttcacaaggccttcatttagctgcttcaaagctcacacttcaaatgtcaagaaaaatattctcttaatttctgccgtatcaactgctgtaatgcctgaattaattagaatggaactataatttctctccaaatggaattggatcatcccatcctaacaaaacaaatgctcagggcggctccatgctggaggtttctggacaccttccctatatcatttctgcctgggtcactgcagcctagggctgccccttgggagacttctcttctgggatcctcagcatgtcttctttgcttgtgctttctcctctcctctgtgtctcctctagttttaagtacacattatatttttcctgcaatttgagggaatctcagtgtcgaaactacgatatattaaaatcagatggctttcgcctgaggcattccctatttcatatgtttgcattcactggtgccttctccatcctccactcttagcttgctcatttttcctcctatcaagaagacctaaatggagcaatgtctcagctctgaccctgggatgtaaggacctttcacaacagatctcaagcttgacagtcaactctcttggtgtcccaggtccttcccaagaaaacctgcaatttcctattctgggtgtctggtcctcaggggcagctatccagtggcgtttcttctgaaagacctccaaccggtctgttggggtagctctttgtcctgtcttcctaggctgtctatgttttaaaattagaatcatttaacagttggggttggggatagaggtgggaggctggaaggaactatgagtatgaggtatcagaattatgtagcacagattgcagctgggattctgttccatccaaattccaatcagttatcaaaagcattgtttaataggagtttcctcaaagttcaacagtgccacagaacaatggcccatacataacacagtttctctggtccctgccggactgagaattctgtctccaggaggtttgaggtatgtgtagagaggttttatttttttaaatgtcactatttattttgaaagaattgtaaacttacagaagagtttcaagtttagtctaaggaattcccatataccttttccccagatctgcctttgttaattgtttgcttataaacatagccacggttgcatctatccatctatccatctatctatctatctacatatttttttttctgaaccatttgagacaaagttggagacatcattctcctttacccagaaatacttatattttctcaaaagactttttctttttttcttttttcttttcttttctttttttttttttttttttttgagatggagtcttgctctgttgcccaggctggagtgcagtggcatgatctcgtctcattgaaacctccatctcctgggttcaagcaattcccctgctgcagcctcccaagtagctgggactacaggtgtgtgccactacgcctggcaaatttttgtatttttagtagagatggggtttccccatgttggccaggctggtctggaactcctaacctcaggtgatctgcctgccttggcctcccaaagtgctgggaatacaggcgtgagccaccgtgcccagctggacattttcttatataagcacagtgtaggtatcaaaatcaggaaatttaacattgatacaatactcttatctaatagcccagattcgaaatgtcttcagttgtcccggtgatgtcctttgtggctatttttgtttctggcccaggatgtgattgaggatctcacattgcatttagttgtcctgtttccataatctcttctaatttggaacaagtcttcggtccttgtgttctggaccttgacatttttgaggaatatataggccagttattttgtgaatcatttttaaatttggatttgtccggcatttcttcgtgattttggtttaggttataaatttttggcaggaataccatggaagtgatgttgtgttcttctcattgaatcctatcaggaggcacacgatttgttccactataggtgacattagctttgatcacttgatgaaggtagtgtctatggaaggtggggtgggggcagcagagcatgcttgtgccaaatggctcctctaatgaatatgttctgtaaagctaatgaaatatgtggaaaggctttttggtctaccaggtctctataaggtatggcctaaaatcatgtaaactcttcccctcgggatgactaacaagtaaaatttccaacctgctcagttaagcttcacagaacattatttatttgacacataatatatctgtgcagctatatacacacaggtaggttttttttttaatttatttacaaaaggtaggctatgtttattagagtcacaagcagttgactgtctcagtgtgactcaagaccacaaaaaacccatttctccttcacttcattctgagtcctagactggcaggtgtactgcttggggcccattcacaggtttacaagtttctcattgagggcaatctgtgactgacacacgagtagttttaaaatgaaattatgatgcttccattcatttgttccctactcttgcatcttaaaaaacatataattcttttttttttttttttttgagatggagccttgctctgtcacccaggttggagtgcaatggcgtgatctccgctcactgcaacatccacctccctggtccaagtgattctcgtgcctcagcctccccagtagcagagactacaggcacacaccgccacgcttgtctaatttttgtatttttagtagagatggggtttcaccatgttggccaggctggtcttgaactcctgacctcaggtgatcctcccgcctcagcctcccaaagtgttgggattacaggggtgagccactgtgcctggccaaaacatgtaattcaaaaggataaaaataaataattgaattaagttggggtaaaggactgtggctgagaaaaaaagccagggaaaaaatgcataccatggggccttgtgtggttgctagaggtacctacagatttggctgtgagattcctgggggatcttgtaaagaagataatatgctctgttataggagtcagatcactcaagagataaaggctttcatggtgttgaagagaaatgtagtttttctagacacagagatgtaagagggagttctcctgtacttccccgtaagtcatctagactctgtgatcgatgggactttgtccttaaaaaagaaattacagtagtggcctggcacagtggctcacgcctgtaatcccagcactttgggaggcccaggcgggcggatcagctgaggtcaggcgttcgagatcagcctggccaatatggtgaaatcccatctctattaaaaaatacaaaaattagctgggcgtggtggtgggcgcctgtaatctcaactacttgggaggctgaggtaagagaatcgcttgaatcagggaggcggaggttgcagtgagctgagaccgtgccattgcactccagcctgggtgacagagtgaaactctgtctcaaaaaaaaaaaaaaaaaaaaaaaaaaggaagattccagtagggaacactaggagttttatggggaagttttctatagtctttttaaatactgggtagtggcatgatctcagagcaccagccagtgttcacagaagaccaaaatgagtgtatactacatatgcattttgattcaaggataacatttagaaaatccagaactgtagtttttttgttgtatgttttgttttcatttttaagaaggaagctccttttgacacaccttctcaaataaaatttagagctacaggcttttattttgttttgcttgggatcagaatctcctctttgtaagtgtttaaaagcagagctgctttggtttctgtctgttcccccatccttgccccaaaccttattcctttccttcccaaagatcctgaaccactttacagggctgagagacaacaaaccgagaggcattgatcccaaggagtggcctctttccttcatggtttgtttgtttgtttgtttttgagacggcatctcactctgtctcccaggctggagtgcagtggcgcgatctcggctcactgcaacctccaccttccgggttcaagcaattctcccgcctcagcttcccaagtagctgggactacaggcgcgtgccaccatacccagctaatttttgtaattttagtagagacggggtttcactatgttggcaaggctggtctggaactcctgaccttgtgatctgcccacctcggcctcccaaagtgctgggattacaggcatgagcccctgcacccggcctgcttcacactttttgactcacttcactgtgtgcccccagagtctctggatttcttcagaattttaaattttaccatagagtgtgaaataatctggcagtttcccatgcagtccaggcagtcagctggaaggagatttctatcagtctggaatagaggccaaccacagtgctcaccacaggcaagaggcctcaagggacctggtcccggcccctcaccctctgctcctcagccacatgggctgctctgattttgcacaagtactccaagctcacagtttccaccttaggatctttgtacttgtcccccaccctgatttccatacttcattcagatttagagcacacatcactgcttcacagaggcctttcttaacttccctgcctaaaatagctccacatttctttgttcaaatcccttatcactaaaattattctgtacatttgttatagcctgtcttttcgttagacgataatctcctacagggcagggaccttgctgtcttgttcatcattgtatctctacttcctagaaacaggggaaatgaatagctaggtgaaccgtagatcattggaaagaaaaaaaatcatctatagttctataagcgaaacaccaccactgttaatattctaatactttttcatttcaaaggtaattaactttttgggggtcactagaaatcctataagatatatgggtacagtcctcaatgaaatgcatatttatacaggtttccaaaatttggcatatacttctaccagatttcctaatcctgttacccctggttacattcttctttcgttttttttttttttcctgagtggtcctggcccaatgcaaagcacctaaaccacactattgtttttgcttatttgattgctgaaaaaggctgtttctttaatttgcattagtgtgattccttacgaagctgataatttgccatattttattactaattgcatgttctcttttatgaatcgttcaagtcttttgactacctcttggaatcttagtatctgttacatgatctccataataaagatgtttactaaaagggcatgctattaaaaaacacatgcacacattaaaaactagcaactcacgctggcaacttttcttccattccgtgtggaacacagctgtagattcgttttctcttagcttgggcaactgccatacttcgcacctggagtagttttaaaatgattcaggaaagctaaccaataaaaagctacaataaactctctactgactaaagaaaaataaatgcatgaatcagagtttccatttcctgctggataaaagtatacctattgtctgaagataacaaaacagttgtagttgtactgctattgcccaaccatggaattatattcaaaatcacaaggacaactttgtgaagcagcaaagtgaataactaaatttcctctttttcacaggctagataattgtttttctaaattcactaactccatagaggtgcttcctgccacgggccacttgtgataaatcttgagatatccctgcaatcaaatggagtcagagtagcacattctgatgctgctttaggtggaagaaagagttctttctttacaggaaaaaggatccagaagaaatcagcctgccagaaagatgtgatttttttttttccctagacttccctggatatattataatgatgagaactaatgtctgaatcctttaaatgccaataaaatatacatttggggtaatgcagttattatgaaaatataaaagccagtgttacaggcatttctattttacacctgaaaaaggagagttgcctagatacttgcacactggtgtgtggactacattattgtttggatgggcaggcaggatagcaagtaggaaaatcatttcctggtgctaaaaattcagggtttcctgtgaagtaaacgaagcttgggttacaagtctaaaactagacaggcttggggcatctggaggaccggaggcccatctggcaagctttggggcacctggaagtggttttaaggcttgaaacagtgaagctgggaaagtgtggctgaatcaacatatattccagagctctgtgccttatcaactgagccggctgagaaatttccttgcagttattctcacccagaattggaataaagggctcagtgtgaagttgggatagtacaacttctcggtttaatactttacagatttttggaaccaaatgcaccctgaagtgaaaagctgctttttttttgctgaccttgttggatggctaatactgtttctgggaaataagagaaacaagcggctcattgttggcaggagctgagagagacacaaggagggcgagagacgcgtctgcagccctttttttcccttcattgtatcgtgactgagtcaaggctggattgtggctgggtttttcttcctacctctgtagacatatgttttccatcagacagggctgcgtgacacctgacgttggccagttcacatgagttaagccatggacggcgcataaacagaggaaaagacccgcagctgcacccagacactcttgatgctgaaatatttttcaaagcttgatgtggctgggtctgcacataagtcagaaacgatttacacctgtatgttttggcttgcttctttcagttgcatatcattattcccacaaagcctctatggccagaaggtctaccattggctgatggcagcacctctccttcccatatataagcctttctaaattatgaaatgtgagttttcaaagtttatttgatttttgtcttttttttttggaggattgaagaacaaaatgctctaccatttctataaagtgaggtcacacaaatggtgtcatcaaaacatgcgattcacgttgatcccatcattttaaagtaaataagttaattaaaatagtctgttagactttttcatgaaatagggaaaaggaaacactacttggcctcatcaccaaatttaacttatcacgtatattttgatgactacgaaaaaggattgggcagtgattggtgatccgttggtgatcattgggcagtaattggtgatccatgcagctgatgccagctgtagtattctagcaggcgttccgggtttcctaggtttgtcgcagcctgttcctgagatctgggctgaggcatttaatcttccaatattcttcatctctaaaataagtgaattagtctaaatcattggttttaaagtctgtcccaaagtcccatgctagaatctcagggggatgtgagcagaagctaaccttagtgttcagtttccaaaagctgggccctgttcaatgtgttttaaacatttgtttaaagtttcagcatgacacttgagaaatgcctgaagggaaagcagagtgaaagcaagaccaagatgatttagagaagacagtcaaaggtgctgactttaagtgctaatttcctcagctgatgaaagaaccctgggacataaggatagcctctgcttcaagccgtacacttggctctggagaaggattctactactaaagaaaagtttgagaaccattgctctaaatggactaagacccttctatcctgaatttctatggtgatagcacaaactcgggtaaatacatggccctcacctataatgagtgctgtgggggaaagtgatgagtttgtaaatcatgtgtgaaactcagaatgaaatggggctaagcaggcaactatgctctggaagtaagaggaagcagcaactagaatgtggtaccctttggatattcccctatgaaactctagaggtaagggttaaaatgcatcctctagagaagatgagttatgggnnnnnnnnnnnnnnnnnnnnctgggacataaggatagcctctgcttcaagccgtacacttggctctggagaaggattctactactaaagaaaagtttgagaaccattgctctaaatggactaagacccttctatcctgaatttctatggtgatagcacaaactcgggtaaatacatggccctcacctataatgagtgctgtggggaaagtgatgagtttgtaaatcatgtgtgaaactcagaatgaaatggggctaagcaggcaactatgctctggaagtaagaggaagcagcaactagaatgtggtaccctttggatattcccctatgaaactctagaggtaagggttaaaatgcatcctctagagaagatgagttatgggtgaggcgttgccagtttttttctcagttctcatcttgattatgtttctatttgaaatttaaaaagcctatgatgatcatcttgctataaatggaactgatattttgttaccaatttctaacctccctcattctaggcacatgaaactgctttgttcaacattccctgtccgcttttttcccttctctggctccgtgtcctaaacagcttctttaattaattttaaagagctaagcacacagtagggacttaatataatattcattcatatttaatttataattcagtactctgccaagacatccactgagttacagtggaccagcatttcctagtattcctatccagaagaatatcagccttgcaagtttgagaaacgagttgttgaattcatatatctctttcagaaagtcttggtaccccctattactctaaagactgacaaatcttccaataaaataaattattttaactttctttagcccaacatttcccagtcttattagaccagggaacacttctagaagcaatttaaaaagttttagcttaatatctatttattcccctgggacacattatagaccagattttctcttaaagattgtgtccatttgtacataccccaaccattgactattaaattaatattgactattaaaaagagagtagccagcaaagttcctggtattcactgggcacgttaaaatttgctgtttttcaaaccagttttagttttatattaaaattgagaagagagttcctatacactcactcacccagtttcccctgttgttagtgtattacattaatatgctacatttgttataattagtgagccagttattattaaatccatactttattcagatttctttagtttttatctaatatctttttctgttccagagtcccatacagaataccaaattacctttttgttttgttttgttttgttttttgttttttgtttttttgagacaaggtttcactctgttgcccaggctggagtgcaatagtatgattatggctcattgtagtctcttcctcctgggctcaagtgatcctcctgccccagcctcccaagtagctgggaccacgaatgcatgccaccatgcccagctaatttttaaaattttttgtagagacagggtctcactatgttgcctaggttggtcttgaactcctggcttccagtgattctcctgcctcggcctcccaaagtgctggcattacaggcgtgagccatggcgctcagcccccattacctttactcatcatatctccttaggctccttttggctgtgacagtttcttaaactttccttgtttttgatgacctcaatagttttaaggagtgttgctttcgtattttgtaagatgcctttctattgaaatttgtctgatatttttctcttaggtagactggagttataggtttttggaggaagactacagatataaagtgttattctaattacatcacatcaagggtgcacaccattatcatgacttgtcactgttaatgttgaccttgatcacctggccaaggtagtatcttccaagtttttgcacagtaatgttgccccccaactcccatcagccaccactcattcaatcctgtgttctttggaatgaactcactatttgcagttatgttgcctcccatccccccggcctttgagcatggtgtgtctacataaatgattttgaattcctctgtaagggagatttgtctctccttcatccatttatttgtttaattatctgttcatatgaatatggatttgtggaaattacatttttagtaaactaatgaaccacagtctacagcctgtgaaaactccctattattgttggaaccgaagtactgttaggaaataggtgctggggatggaaaaagtcatggagggcttggggaggccttacccattcacttaaatggaattgtgcctctgacacattaacaaaaccacatattctaaaaaattcacctcaaagtgccaagagtagagatacctccactgagaagtttgttgtcgaaaggagagaggagggagatacaacaagaaacgcatactagccgaagatattcttcttcaccttccaagactcacatgtgaactgaggagaaggatttgaagggagccaagtaatttctgtgtcttcctagcacttaggtgtgacttctagccactgggcgccagctgttctttccatgatctactcagagccagccccttgcaggcctgtccgctatggttttcgtagttgagcctacccttatggttttgttttcttcacttggcattgtatatgtgtatgtgtgtaactaaaacctattttaaaaatgagggaagcaagcccaggacatagaagagcaagccactgaaacctgccgaggccaaaaagacgtttgtgaaacattccaggaggtgctctgggcagcctctgattcactggcctccctcatcgtctgcagctcctggcttagggaagctgccaaaagcactttctctacgagctgtggctctctgtttcctggtgttgcaaaaggcaaaagttcaggattgaagcctttaccttttccatgtttgcttcttatatagcaaatcttgtgctggcttagaattgagtccgggcgactttcttgccttgagcatacacttagagctttgtagaaatgaccaagtgtatattgccccaggcagcactaaccagagggtcatgtcctacgtaaataaccccaccccccgccccattcccgtgttgactgtttgcttcaccaaggacacagtcattgaatcaaaagtgtgtttgtatctcagatgccttggcactggcggttttgtgtgtgtgtgtgtgtgtgtgattttttcctttatattgaataatgccaattaaatgtttctggtcacacatctgcagagcatggttttatcaatttccaaacacagaagagaaagccaattattaaaaaaaaaaaaaagaaaaagggaaaaggagatgaaaacaatgaaaaagaaaaagataaatgggaatctaaatttaaattctgactctcttggaaggaaaaacaaaaaagatgtccctgctttagctttgatgcattcctgcttctatggagaaatcttctgtttgggttattcctttctggggggactggcaacggtctagagctgacgaggtctttagcctttttgaggcagtttgtggcagtctgcccttaatccggcttggcctcagatactgcatttggaatactctgccttttcttttctttttttttaagctggagtttcgctcttgttgctcaggctggagtgcaatggcgtgatctcgggtgactgcaacctccacgtcccgggttcaagccattctccctcctcagccttccgagtagctgggattataggcacctgccaacaagcccagataattttttgtatttttagtagagacggggttttactgtgttggccaggctggtctcgaactcctgacctcaggcaatccatctgcctcgacctcccaaagtgctgggattacagacgtaagccacctcgcctagctctttttttttttttttttaatggaactattgttctctccctaaaatgttctggaatattatcccaaggagtattttgttcatcacaaatttagatgttttgccttcccatgctctgctgaggactttgtttctctttttctctgccttaggcctcctctgccctcagtgtcaaaagcggtggttttaaggaacctcaaccacaagtgaagctcatgagctccagtgtcaatgatggttcagtatggtttgaaattaaacaactagagggagcatagtggcaaggtgaatggtgggttcctgggttgagacaagtcacctggcttctaggataccgaccggttttatgaccttgataaaattcactttctctgagttttggtttcctcatctccataaggagaggttgcaccaagcagactctcagctttgacagtcttgattatatcctaagctgtatttgttgtttttcagataatttggggcttctttctttcactctaccaacaaaatattgagtttgaagcttacatggccatgtttttgttttatgctttaaaatttttattttcacttatgttttacattaaatgataaattcatgtgggaaaacttaaaatagtacagaaaaggaaaaggaagatctcccatccctgatacccagtttcttctgccgaggtgctcgctgttgccggtctcaggtgtgcccttctgtggagatttgctgcacatgcataacatgccccaccttttctaaccacaactagtaacatgctcataatacagttctgtcctttgggtttttccccttctggacgatctctaagaaacattggaatcatcatacagaatttctctaaatgggtggaccatatctcccactgatggacattaagatcatttttaatcttttgcaattataaacaatactgttttgaatatccttgtacaaactgctctgttgatatgtgctttactttgaaaacaaagctatcatctaagttccacccttttccagactctacagttaataatgagagatgtttagtctgaaagatcaaatctaaattaaatggaagaaaccagtgtttccaccattacctcctgtgaatgtctcaagtaggggcaagtgttttaaagactcacatagatgtggcttgggaagagctcctctccaagtctgaaactcctccagattaggattcaggtattaataaaatctgctgagcaatatctggttgctatgtggctttcagtaatacagtacactgcttgagagtacgcccaatgcagcattttgtacaccgacaagggcagtctacctaagtgactgatgatagtcctactagaatttgttatgtcagtaagtcacctgagtcagttataaaattttccaaagtatctaagttataaaaattaacatagggctgggcgcggtggctcatgcctgtaatcccagcactttgggaggctgaggcaggtggatcactcgaggccaggagttggagaccagcctgccaacatggcaaaatcctgtctctactaaaaatacaaaaattagcggggcagggtggcacacgactgtaatcctagctactcgggaggctaagacaggagaatctcttgaaaccgggaggcagaggttgcagtgagccaagatggcaccactgcactccagcctgggtgatagagtgacactctgtctcaaaacaacaataacaacaacaacatagggttaacaacctgtgcctttgaagccttgttttcctaacctgggtatttctgatatcagaactattgggcatcttttttgtctctagtagttgtgtcagatactaccatattaaatataactactagtaagaacatacttttatagaaggttcagaaatgcctgttccttgaaataattatcattcttccatctgcgcctctcttccctggcttgaaataggtttcatgaattaaacccttctggatgtctggattttgtcttacttgaatctgtacttaagggaacttttcccctgcgacaccatctgtgcaaaaccctttacctcccaccccaggccttcaagtagaagttgtaattatactataacaagctctagaagtgaaatactcatttcaggttttttggcatcaatcatgactgtgctttttctcttgttcttaatctaagagtgtaagaaatgcccaactgattttattcattcatcagatcgtttcctgagctttccctgtgtacctgggattgtgccaggaggtgagagtccttggtggcaggcttaattctaagggggaaacctaaactgtctaggcaatatacactgatatcttcccttttactagcatgttattgggcccagagttgtaaatctatccaggctttcctcgagcccttcctcttagtaacgcaagcaacatttgggtccctattttgatgacctgctgtgtgtgtggtactttcttgcaaacaattgaaggcagattgtctttacagggttgctctgaggcttcagcagttgttcctcttcttcagtctaagatgtgacagaaggtggctagggacagttggacggggtacaagaggatctcgattttggtcttggctctacttgccactaaccagggcacatcccttaacctttctgggttacagtccctattccataaaataaggggatggactagataatctcccaggttccttatgtagcctaacagtttcatgttccataagccactcataaaaatccatctcatttcttcacacctctcttccaccagtccgttagttctcatgaaggcaggagctatttttccaagtttaagcccagtgcatgacacgcagcaggaattgcaataacaatttcagtgagcgtatggacaaaaaagaacatttttatcccaccctcacctccatcctggagaaatctttgccattgaattcttcctcaaagaaatctattcttctctagaaaagcttcagtgttggtattgtctttcaaatgtacatatatgtcgttcaaatatacacatatattatacatttaatacatatatttaatatatggagatttgggctacttaaattcatttaaggagatttacttgtaaatcatatttctacataatatgcatagcaaactgaagatgaaaagtatttaacttaagccaccaggcgtggtggcttccacctgcaatcccagcactttgggaggccaaggtaagaggattgcttgagcccaggaattcaagaccagcctaggcaacatagtgaaacctcgtctctatgtttaaaatatatacatatatatgaaatattataaaaaatatacatatattataaaatgttttaaagttaatgataccaaatatagcaaaaattgagaatttttttctcagaaatgaagtgagtatataaaattataccttgttttctttgaccctgacctaggaggaaatagactgaaaagcatggttttctttattacatgacattgcccagcagaagttaagcaaatttgactggtaaacaattttgagaaaaactagcacttttataaatgcatttttgcagaaataccaattataaaatttatttaaggattttaaaattatttttgtaaagtgaagttcttttttttttttttttttttttttttttgagacagagtctttctttgtcaccaggctggagtgtagtggcgcgatctcggctcactgcaacctccgcctcccgggttcaagcgagtccctgacctttgcctcctgagtagctgggactacacgcatgcaccatcatgcccggctaattattttgtattttaatagagatggggtttcaccatgttggccaggatggtctcgatctcctgacctcatgatccgttcgccttggccttccaaagtgctgggattacaggcgtgagccactgctcctggccgtaaagtgaagttctatatgctgaaatttcactggttgttaaatgcagataaatagagcattttaaaaaaattgaaaatatttctcatgcgtttatccaggcacaacatgtttagcatttctgcataatttctttctcactaatttctccctttgaagaaacaaacatttttttctcagtcagatatttgttcctgagtttagctcatagctcaggcttccttgcagcatgcttttcaaacaaaggattaatggagtcctccttatatgtcggctcctgatctaggtgctttgtgttacatgttgtttgtcaattcactggtttgtgtaccaaagatcacatgccctccttacctctgccataaacacacaaattaactgagaaagtatacacatgcacacacacacacacacacaaatgatctggtgaaattatctcataacttgtgataacctttgtggaatttgctttagaccactatgttctatgtaaggcttaaaatgtactctagacagggaggtgtgaaatgagattttaacagaaacaaaagccgaggctagatgagtcaggattggggccagtattcgagcctccgtgaattgaattaaggtaataattacttaaacagtaatggttaacaggaaagtactttggaaggaatctcaggaatctatactccaaagcagaaaacattctgatggtctatttttgataaggtattgtgggccctggtcattaatctgtatgttcttccctcttgcagtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggtatggctttccatggtgtctggtggaggctccctggccttggtgccaaagctgatgggtaggtagctgcttaccttcagggtaattcttctagagaagaagagacaatagggctcaaagccctactccaagcctcttgattaaaatccagtttcttctctcagtgttctgcctgccttttcagaacgaagcttaagggtacaaggacgagctgtattagcatggctgcctttggcttccactgctagtctttagaaggagagaaaggagaaagtagagagacaagagtctgttgttgtgtaacaaattatcccaaaatgtagttgcttaaatagccatttcattatatcgcacaattttgtgggtcagaatttagaaggggctcacctgggatattcttctgctctacatggcattgactgaggtcatttagtggtattcaactggtaggtgggttggtctggatagttcacaatggctttacctaagtgggtggcatgatggtgaggattgctggaagactgggctaagctggaacaaaagcctgggatctatggtgtggcgatctcagagtagtggtactcattccatagcagctgggttttcaagaaaaagcattctaagagacagaaagtagaagttgccaatttcttggggcctagctctggaaacggtcgtggagtcgcttttgccacactctcttggtcaaagtagtcacagagaaccccccgagattcaagcagatagtggagtggatgttcctcagaagaaatgacaaaggatcttggtccaccacagagcatgaaaaagagggaagctgaagggagaatgagaagggaaagtggtttgtatatggactccaacagagtgctctgcaaaactgcctgggcatcaatcaggcacttttgtaccatactccattcattcagttttcattccgtcagtcaggagtatgttgccgtgtgccctctgtgggtcaggctcagtgctgtacttcaaaaacgaatacaagagaattcctaaaagaacccacagtgctctccctgtttcagtggcttggtctatggaagagcagaattctttcttctgtgttgctaaactaatataacccatgttttcaggtctcatgctttttttctggctacattttggggagaaaagcttcagtttattgttttaacttttcagactttgttttgtgactcacatgaagcaagatacatgaataacttccttttgctactttagagaaattagagaaataagtagttttaacattccagagaactttcttggaggaaaggaccgagcatgttagggtaaatgctgtttttttaaagctacatttgatactttcaaaaatacacattgacttccatgaatgaataatgtatttctcatcaaatacattccaggatataagaaatctatattgtgtgaggtttaaaatgcatggtaaattaaaatcatttctcagatatagtctttgaaaataaggaaaatgaatataaattgtgctttgttgctcagctgaactttcctccaaatttgaggaatacaacttaataattaggtaactacagttgtgtcttttaccctgaggatttatgtttgaactttcacggttatttcaggctaacggttgtttatactgattttagatatatagtgtcatgtttcttgatgggaagtaattgtattgttaattgttttctgtctttgaataataattttatttggaataatttttctgttttataatgtaaggtaaattaaacagtatcccaacagcattttatacattctcagttttatacttaaatgagctttagtgagttttttctttacacaaagttgtgaccattctgcaaagaatgacttgcttctctgtttttgcgggtgtgtttctctttctcttgcttctcctccttctttcccacagaaagtatttctgaaaaggggtgggaaaagtgccccaaattgtttcctttattccagctgtaggtgcctttgaaccaggatgtagtactgatggttcatattacagaaatgccaaccaagttccttaaatgctgatccttggaggctgtggaacgtggggcgttgtgctgcatcatagtgagcaattgcattgttgcattgtatatgaagcaggagaaaagattgtccagatttgctcacagggactcatgtagttcagccttgactctgtgtgtgtgtgtgtgtgtgtgtgtgtgtgtgtgtgtgtgtgtgtagttaggaggagatggaatggtggagtggttggttctggtgttctgatgcctttttatttttgttagggagtacaggaaaaggtctaaatagactttttaatcatggcagattttttccccatgcagaagcagcatgctcctgattgtcaaagatatgatttaagaccatataataaatggcattggagtgttctataatagttttctggggcatttgccaggacacctgattattcagtattcaggtgtgggctctgtgtttcatcttggtggattttttgaactcttttggtgattttctgcttcactttttgaacctaagccatggcagcagcagggaaatggactggaattaaaagtgatctttggctcacttgtttagttgccttccagcatctggtaggaatttggagagatgggggaagtggtggttctggtgaaatttaaagattatctgtacacttctgtttgttctctctgtcctacccctatgtcctgggtagtcaacaactgcctgaatatcccttgctcagtggacagtttgtaattacactggctctcctcttgcttgtaggcggccttaattgtacagcctgtcttcttggggcccaggccctgcaggtaggcctagacctacctgcccttctaccaactgagcctgtctgggagcaaggccccaggctatgctctctttctgtagtagaaagggaggttggcaaaatttaataagtagatgaatttatcccctaattactaataaattatcacgctgtctatagttttatcattcttgaatgatacgacgaatctgaaagatccctgtggagaatatgctatataaatattgtttcatttttcttcctgttccttctgctatgccgttgttccactaggcatatagtttgatgatgttgtgccatgaaaaaaacaactccttggtccttgttgcatgatttgatgtataccacaatgccaaagggtcacctattaactcattggcattgaaatcatgcgagaacattaacaaaatggatctgaggaaactttgattacaaatctaaagtgagccttcattatttcagtatggaagctcatattttttttccttccttcattcctttatctcttcattcattcaatcaatatttatttagtagaaaataacagacaggtaaatgggatgtgactgccttcagataacttgtatttttgcagaaaaggaaaaataattaactttaatccaagttaaagaccagaagagtaaattaaaaccattccctgcttcacaggggcccagtggctaccatctttgactttcattactggaactgagaccagatgcacctgagcagagttctgtgaaagtgagcatcagatactcctttttctttccagtgacccctcaggttactggctacagaattaggatcaaaagagccagtaaggtttggtatctctgctgataaggaatcttctgaagcaggagaatttccttaaatgcagtccctccaatctagcattggctggtgtagcaacagagctgagctacttgtatctgataattgatgaattatcttggaatgcggcagacacttcaagtggaggggtaccaggaatctaacatggaagacataaagagtgcatttctgtgaaaggaagtcttttgtccgtgatagagttttcttttatttttactgaatttcccaaaggctgtgaggctacttcaggttcaccaaagaaatggcaactctagaaaaaaaaagcaattcttattgaagttttgctttctcttcatttttttaaggaaattaaaatttggtttgttgagtttttttaagtagaaaaaaattttaatttttgactaagcgtggtggctgacgcgtgtaatcccagcacttcgggaagccaaggcgggcagatcacttgaggtcaggagttcgagaccagcctggccgacatggtgaaaccctgtctctactaaaaatacaaaaattagccagacataatggcgggtgccggtagtctcagctactcaggaggctgaggcaggagaatctcttggacctgggaggtggaggttgcagtgagctgagatcgagccactgcactccagcctgggcaacagagtgagactctgtctcaaaaaaaaaaaattaaaaatataatttactgagttactttagtgattagcatttaaaaaagtgtttttgctaagtgcaagaaaccagacttccccccaaaactacatcctgtatgattccatttatgtgacgttctggaaaagcaaaactatggggacagagaagagatgagcacttgccagggttgacagtacagaaagagtagactccaaaggggcagcactgaggaattgtggggcagatggcacagttccgtgtcttggttgtggtggctatttcacagctctgcatttgtcaaaactcagacatgtataccacaaagagtgaattttactgtatgtaaacaaaaagaataataaaagaaaacgaattgctacacacaaaaagacaaaacgtatgtttatggtacggaatgtataaaatactaaacaacaaagaaggaaattataatcacctatactcttacctagaaagagtggctgtaaatatgctgatgatttctttctagtctttttgtatgtatcatgtgtatcaatgtgtctactttgttttttaaaacacaaaagtggtagcatactttaatactgctttgttgcctcttcttaatatattgggaagtcatttttttattctgtgtcagccatgaagttgtgctgtgactttgtatgtacccattccaaagcgcctagaatcctttctacaacaggccgtacataaatttttaaatgtcatgagccacacacacccacaatgactacagagtattctgttgttacacctgaaaaattcaacgcaatatttgctcagtatcctaaaaggcataattgcaactttaccaaatgaagtgggaaatcgtagtcacaggtcagacattgagaaacaggcttctcaatgcctgtttatctaaaagaacaattccttgacatgaaaacaggcatatggctttacctgaagagagtatttcttttcatgtgtgttattcatttaaatataacggtttggggccatctttctggaagattttaacctcgaggaccaggacctggaagacgagtaagtggcaaagccttggctcccccttgtcccttcacgggggctgccttgtagagaaatcattattcccaaagcaaattcagccctgcttttaccctcaaccttttctttctttctttttttttttttaatttgggggttgggggacaggagaatgcagtttgtcaaacaaaaatgctgactaagcctggcctcgggtcgccgaggcaacagggacgagaaaagagggaggcctcggaattcttttggcaggtctgtgggatttctgccaggcttgacagccaccaggcgcggcgggccagctggctgacctcgcacagccatcctgacagagggctcctggagggggacacacctggctgtgagcagcactggcctggggaaggttctgaggcccccccctttttttttttgtcatgcaaagaatagctatttagcgagctaggagagtgtcgtattggagcagatcatgaagcataaatgtaggctatttcatagcctttgcttcagaacaggggactatttaacttttagaaaagcatttcatagcattaggtttcagagttgactgggttaacagaggtcacgtagtctaatattttgtgaatctataaatccctccatataagcttggctatttaagttcattcgttcatatatttgttttacaaatgctctaggcattaaaagtacagctgtgaacaacagaccccagccccttccctcacagagcttccattctagcttgtgtcaagcgttttatttgcttacatgtcccagaaataatccattttccaaaatgtcccagtgtgcccttgttgttgaacaatagtatcaattcaagtctttttttttctttttcttctctttttgagacacagtctcacttcatcacctaggctggagtgctgtggcacaatcttggctcactgcaaccttcacctcccaggttcaagtgattctcatgcctcagcctcctgagtagctgggattacaggtgcgcatcatcacgcctggctaattttttgtgttttagtagagacggggttttgccatgttggccaggctggtctcgaactcctggcctcaagtgatctgcccaccctggcctcccaaagtgctgggattacaggtgtgagccactgcaccaggcctcagccttttttttttttttttaagtgaagacagacgagtatctaaattataatgttttctttaatgtgatttgaaaggacaacagaaaccagttgtggaataatacaaatttgctttatgcactctgagtaaaaagagcaacaaatagaccatagataataatgacaaacttagtaaatggcttcctaaaagtatcgcagtttcgattgttcttttgtagggacagtctggcagctgagcattagtgatgagttgtttcaaaaaggcagtctccgggaagtgtgacagtgcattttagaatcccttggcaccgaattaaaaagaaatatacatcagtaatttttttttgttccccccgccgtcccccgtaaagaaggtaaataattcggcattctctctctgaagtccctcagggttttggcagagaaagcaatttctctgcatccagaataactattttaatgttaggatttcaaaatactgtctttttttttttcattttctttctactcaccccaccctttataattaaaacaatccaatcttccatgtttgtagagtccctggccacacacacttaaatcaagcagagcagcctctgaagagctgattgtcatttgtttcccttttgaagtgcattctggtgagggcaggagctggctggcagagtgttccctcagccaaggcgggacagagctgcagatgctttcagctgctgtttactttctcacctcctctgttggtttattccacaggcaagctgcaggccaaggacctagaaggagaggaggtttgaggtttgcttcctgggacaccttcagctcacaaataatcatttgtctttcacatccttacttctccagctattttacacatcacccgtcctccagctgctaggaaagggtattttttagcccataaataattactcacttcagagagctagatagttgaccacaaactcaccaagagattcttgagcccttattttgcaagtctttccaccccaagcttggacatagacaaaaataaatttgttggaggagggttgggtcagggtcagcagggagagctttccttctgaaaagtgcccttgaaattggaacttgtaactttgcttgatgggttgtgaattcctaggacatgagctccactcatatacgttgaaaactatcattgaatacatccagttcattctgttgccctgttcagggaggaaaactatgttcaggaaagttaaatcggctgtttcattaaatttcctctgaactgtctgaggtagaggggttggtctttctattttattgctgggaaaacaggctcggaaaagtgaagtaacttgcccagttctcacagccagcaggtgaaagggttgacaatttgaggtctgtcaacctcaaccctcaacttttctttctctgccacactgagactttgccacactcttaactctgagcctcagtttcctcatctgtaaaatggagacaattgggttgtcacgaggaagagatgaaataacacgtttttcttttcttttcttttctttttctttctttttttttagacagagtctcattctgttacccacactggagtgcagtggcactatcttggctcactgcaacctccgcctcctgggttcaagcaattctcctgcctcagcctcccaagtagctgggactacaggcacatgccaccatgcccggctaatttttttgtatctttagtagaaacaaggtttcaccatgttagccaggatgggaaataacatgttaaagggcttagaacagtgtttcacacacagtaagcaatatgcaatttttagctagtatctctgcctcccacaccatttaacactatcagcagcttgttctgttaactgcgtcaatgtgccaggtccattataagtacgctttctaatctttatagcatcccagcaagatcagtcttataaaccaccttttttttttcaggtgaacaaactgtcaagaaaggttaagaatttagttcaagatgccacaacatgtagtaactgaactgggatttgaactccaatctttctggttccaaagacagttttgctcttgtgccatgctgccttttcggtgccaagctctggaccccaacttaaaccccaactactgtttcagaaatccggtggctaatagcctggagaattgagaagaaggcagttcctgccctgaactgataagtaactagaaagcccttcatcgtatctgcctcaaatctaggctagaagagatcttccttctttcctgtgacagttcattaataatttgagagccactgtgtgcccttctagtcttcccctgtggttaaatagccccactcttcttcataggatatgatgccctgacccctctctatcctgattggtctctggtcactctttgaaaagatttcagtaagataaagtgttgggtagggacctggatgcagccttgcacttgaaggttgattggaggaagaggtcagttggactagctagagaagcaatgatgacctgcttcttgagacagaaagcaggttttgagcttggtctaggaaactgaaggtttgtttggagggcagggtggacacagaggggaccctggaagggatctgtgaatatacatgtttaactggagcacagtgggaaatgagtgacaagccagcttagcgtttgttttcctgcctcgactagagggagcagaggaaggaaggggtgctgagtgaaggcagctgcaccaccgatgctcagcggcagaggccttgagttatgccctcagccagccttgaccaactgtcacccctctgtttccatggaagcttacttcatccagtgcctgtctttgtctttgcttcagctgctttagtttcatccattttgactgctgctgtttggtctaagtcagacgtttgcctttcatttttacccacgcaagggtagtggatgtcatgtggcagtccaaatcctactgggtctgggctttaattttatacctaaatttagtttaaaacaaaaccctcccctgtttggatggcaacatgttggtgaggttagcccttttattttcagacctcgggttttgtacagtttctttttctctttcagttcatgagttggaatagggaagtattttcattcaaaaaaaggctagaatttttaaagttctaaatatagaactcgtattataaaatttaagtgaagtaaaacatctcactactttccagttatattcgaacaaattttatgttatataaaaatggtttataaacctctccttgtttaaaaaaaattgttttcttagccttggtgaccattatgatgaatttcacactttggtttaatccctccaaggtgaaagttgaccaggaagaaacctctcaccacttaaagtggatcagttccacatgacagtgtgacttttaaaattgtttattttgttttttttgagattggaattcagaaaatgaaataataataattccttcagtatttattatgtgatcttgagtgcctggcactgttctaagcaccttgtagtgttatcccgttttatcatcacagcagccttcttgggtgggtgctcttattatccccactttacaaatgaagaacagagggttaaataactttctgttagatagcaggaccaggtttccaattcaagcatctagctcctggccactcggccctcctgttcatcctatgtgaggagcaggaaagagtgcagcaggaccatttcttgaggatggagcctgcacctggctagttgggttgtatacaataggctattatttctctcatatttgtggctgaggtgagattgcatgttcttagtttatatttccaagtacccactgtatgcctagcactgttaaggtagttgggtacaggagtgaacatgacaaacaaggccccttccctcgtggagcttacattctagtaggaaagacagagaatgaaaacttaagttgcactgaagaaaattaatgcagattaagagacagaaaatgacaggggtgaggccattttagacaggggtgaggtaggagcatctctgaagagatggcgtctgtaggaggcaggcgttaagtgagggaataagctttaggaagactcgaggaacaccttgcaagcagatagaacagttggcgcaggtgcaggaggtgggaggagcagcagagaaaccaggagactggaagggggtgaaggaggggagcacatcagagacatgggaggaaagggtggccagggctgttatgcagggtgtggtggtctgcagtgaggacctgcctctatttaccatccaggtggaacaagaagcaggtcgctttagagcagggggtcacgtgagcttcactttggctgctatgtggaataacttgtgacctaagaatgattttggaataatcttagacaaagtgtcctattataaataataactttctaactcagactggcctaatttatatttcaaagctattattcaggccgggtgcagtggctcacgcctgtaatcccagcactttgggaggccaaggtgggcagatcatttgaggccaggagttcgagaccagcatgggcaacatggcgcaaccatatctccactaaaaatacaaaaattagctgggcgtggtggcacatgcctgtagtcccagctactcgggaggctgaggcacaagacttgcttgaacccggtaggtgaaggttacagtgagctgagatcacgccactgcactccagcctggctgagagagtgagactccatctcaaaaaaaaaaaaaagcaatcattccgggtacattcaacaccctttctgatttttctcttatttgttagtcagttgaaggtagaaaatgatactgtgagccccctacagacagaaggcggcatttgcccttaggatgacttggtgattaagtcttcagggtagttagggaaacatcagtgctggagactagagcttctgttctctttgatttagaatagatggaacaaatgtgaaatggcacagtgaaacatttcctccaatatagtataggtttttcagctttggttatcataaataatcctttaaattttatttatatattttatttatatatttagacacacacaagcattattttatgttttatttactggaaatagctaggagtaatttaaattaataggaaagtttagaactatttattttatatctaatttttgatatttgttcttataattttatatattattacagataacaattcatgtgtgttatatatagtgtatttttttatcccatgaagttccagaaatgattcttaccatatataaatttagaactcctggaaattgcagattcaacttgtatttttttttttctttttttgagacagagtctcgctttgtcgcccaggctggagtatggtggtgcaatctcggctcaatgcaacctccgcctccccaaattcaagtgattttcctgcctcagcctcctgagtatctgggaccacaggtgcatgccaccacacccggctaattttttgtatttttagtagagacagggtttcaccttgttagccagggtggtcttgatctcctgacctcgtgatccacccgcctcagcctcccaaagtgctgggattacaggtgtgagccaccgcccggcctcaacttgtattcttaagacatatgttgataaagttttttcaatacaaaggaatgcagccatctcatcaacttttaaattaaaagtgtatttgtttagaggtaaactcccacatttattcagaatggttgaaaaatggaatattctagtaaagttcatgtttttggataatgagggttatgagtcaaaagattcttgcatttatggttaataaagcattagaaatttaccattgatgagatacattttttcaaactgtggctcagggtgtatgagtgtgcttgagggatggggactggtgggactcaggctttttatgccagattcaatccctgttgttccttctgaggctttcaggaaaactttggttggataataaggtttctaatgcaccctgcctgccatgttaaaaacaactatcagaaaataatttgatttttctaggtttattcagaaggcacttccaagatttagatgatgaaaatcactttttaccaaaaaaatctccagtttttggtttgctttttgtagattcctgaataaaatttgttagttaagtatttgattatttgcaatctagatgaacagaagtgagccaaagaccctttccagctagatttatttcagtataagttaacaatacagtttttttttaaatcaatcaggtctctcatggtttgtaacagtgcaaccaactctagtaactgaaaatttttatagccgatgacttcactaggacttgtctagacagcagctaccctctaaagtcacatcatgttagggctggaagagatctaacgaagatactgtaatttagaagtcctaaatgttctgtttgccattgtagccatggttttagggtttgagggacagtgagaccaatgacttcagcatggaaagtgggaaactgataggcataaatatggggaaaggcctaaccttggtttgggatgcaaatgtaaacatacaaaagtattctctggaaacatcagcaaatttgaaaggaatttgatgtctggttatgtttgtcaagatggagagactcctggagattatacctagagaaagtagttgcagtcagtaaatttgtagccttttggatagactcttcttagcaatgtaatgctagcttttataaaataatgcttgtattatttgtttctgctaatgaaatccatatgctgtgaaacagttacttgtctgtgggatttggattggatctacatggttccccaaccttcagcattttagtcaacaaagtagtcaaatagattgacttttttgtttttttgttttttttgagacagcgtctcactctgtcacccaggctggagtacagtgtcgtgatctctgctcactttagtctcaacctcccaggcacagggctcctcctgcctcagcctcccaagtagcaccacacccaactaatttttgtattttttgtagagacagggtttcaccatgttgcaggctggtctcgaacttgtgggctccagtgatccgcccacctcgacctcccaaagtgctgggattatggacgtgagccaccacccctggccactgattgactttttaaagtaaactttcaactcattgttttgctttcctgtctgtaaacataaaactgccagatgcaatttaatgtagagcctggactctgtaattccacagttttactggcctgtaagtggcaaagaccagaatgtactttatagtccagaggagtctgattgctttgattgatgtagatttggtttgagaacctgagatagaaaaagccttgtctctgacaaagtgttttgagagggctttctatgatttgggtgtttaaataattgcatgggtgggatgattgcaacattaagtgcccttagatcaaataatagctgagcttcccattaactttgtgaatgtgaagtgacttatgtctgtaagactttcttcggagaaagaatactaatggttgcctggtgattttgacttgctgggagtaaatacacagtgctttgtatttggtgaaaagttttgatgtgaagtacactttgctccatgccttgtgacaatgagtgcatgactcttgcttcccattctgactgtaggaagctgccctctgtcgacagctccccatggaagctgagactcttgccccagttcaggctgctgtcaacccacccacgatgaccccagacatgagatccatcactaataatagctcagatcctttcctcaatgggtaagttaatatttgggggccacttatttttattctctttattatgtgatctagactataataggatctttgtttacattgggaagaggtggggagcttgagggttgagggtgagaataaagggaggaagtgggaggagctggcagaaaaaagaaaagcaggggaaatcatctgcctgttaaaaaatttccaaattaaaaaattggtgataggacgtagagtaaacccctagtcaagaatttgaaaatgggcatgaacttatatttttaaacatgatggtgtcgtctagtacttatacttggaagaatcttctggttttatgtaaccaacaggggataaaagcatgccatatggcaaattgagaacagaacaattaagagattatgttcggccaggcatggtggctcatgcctgtaatcccagcactttgggaggccgaggtgggcagatcacctgaggttgggagttcgagaccagcctgaccaacatggagaaaccctgtctcttctaaaaatacaaaattagcagggcatggtggtgcatgcctgtaatcccagctactcgggaggctgagaattgcttgaacctgggaggcggaggttgcagtgagccgagattgcaccattgcactccagcctcggcaacaagagtgaaactccatctcaaaaaaaaaaaaaagaaagaaaagaaaagagatgatgttcagggtgaaatgtgaataagatctatagtttagtaaataatattctacagtgtcagatttctgattttggtaattgcactatggttatgtaagatgttatcactggggaagctggtgaagggtacatgggaactctctgtactcttgttgcgtcttctatgtgagtttaaaataatttcacaatttaaaaagtaattaaaacaaaggagcaaaagggaaagagaatttagccagaaatatcttcatgagcagaagtagtttttaaatcaaataaaaagggcaattctgtatttcctgtgccttttattctgcccttgcagagacgtctggcaaacaaacaatacaattatgaacattattaaagatagagataaaaacaaatagtagctgaaataataattaatggaggttttaaattgttgattttaaagtatttgaaacacagagaagtacaaagaataacatgaattacccatgtacccactacccagatttgccatagttttatttaatcttactttttaacaaataaaatattacaattaatatttgaagccatccccccaccactgaaatctcgtttcttttcccttctgtccccagtggtagccactattcagaaactggcgtgtgtccatcacacagacttttataccccttactgcccgttagtgtatgtatccataagcaatattcaacatagtttttgttttttttttttaaagttttacataaatggtgtcatactctgtatgttgaagaatgttcaaatggttattttgaggtgaaaaggaaatcaatgtcaatttactgtgaatggccacacatgattattttcattttcatgagggtatgtatttcaaaattaaaactttccttcctccctaacctggaaagttgggcagcatggcacaactgcactagtttagagcttttgtgactgtgttttaattttgagatttatttagtgggctcatattgaagtttcttcatcttttgctttgcagagggccatatcattcgagggagcagagcactgacagtggcctggggttagggtgctacagtgtccccacaactccggaggacttcctcagcaatgtggatgagatggatacaggtaggagcaaagcctgcaagcacttacaatgggtttgtgttttttaaatgatctcttcggttatctcaattttatttttcttttattttatttttataatttcaagttttattttatatttgggggtacatgtgcaggtttgctacatggttatgtgatgccggggtttgggatacgattgctctcgtcacccaggtagtgagcatagtacccaatagtttgtttttcaccccttgttcctccccactcccagtagtcccgagtgtctgtaaaaatgttgaaaaaaaaaaaaatggaatgcttcatgaatttacatgtcattctcatgcaggggccatgctaatcattccagttttagtataggtgctgccagagcgagtacggtcatctcaattttaaaatccaaccagaaacactcaatctcaacgacaacataaaataacagctgaaaagccactgaacccccaggcactattaataaactgtagccccttcctcatagattatacaagtatagttttacatctgggcgcaggattttaaattctgttgttttttttttttaattcatctttgctccatatagtcccttcctcacaattgcatcaagacaccactgtttgtttgccatgtttccacattggggtatttatgctgttctagtttttagttgtaatatatgggccaccctttctcctggaaagtgacactggtttatagttctagtatccaatttttttcatgtcattcactgcatttgaaaagcaattggcagtgggtatttggaatgctgagcaactcagaggattcaaaattgtcacttccaagttccaacatggtaatgacatcctccctcaggaattaaagagaagagagtcagggttactcttaccttgtccccagcctgtgcatccttcaggtccagcctcaccaggcttcccgattacctttctttttctccttttctcaaggagtgagacttccaattgcagaaactgaagttagtcttattagccttacctagacttaattatgaaagtcataaactctaagaagatattctagaaccaaaaataaatgacagccagggtgtccactatttggagttattcatgaaagttccttctccattatcattgacgaaagtaattgttttgtgttgaaaataaaaaattccttcccccaaagtgtttgccatagtgcctgtagttttttacactctactctttgatggcttctctttgtgttgtgagtctaaattgttggaaagatcaagagtcaaactcatagccaggtgtcttacaaatgcagtacattaaagctgctcccctggcgtctttcgtgtaggttgtcatctttgcattgagaagattgcaaagactatcttgtgaggagtgacacaggaatagtttgcactgattgttttactgttcttcagtttattacttcagttcttcccccaccaccaccccctgccacctttatctctctctctgctttttgagtgtgagatttattttgctatctttggaatagccttaggaagtggctccttcctatgtttaataattctttactttcatcttctaaacactgggaagccagtaaggataaaaagcaaagttaaggaaaaaagctcaggagatctaaatctaagtttgacattcaaaaaaaaaaaaaaaaaaccataaaagaggatggattctactctatgtctctttaaaataacctcaagtgggtaagtagggagtgttttattttgaagccgtaatgtggaattaaatgacgtcctgaaaagaacatagttttagccaacaggcagcctgatttgaatccttgcttctccattcctagtagcgcctttgggtaagttgcataacctccgtgagcctcagatttctcacccataaagtgggagtgatatgctcacggcagagttgtgaggagtcatgagatcacagagaccagctcaaagtgctcttctccagtaagaagactgatgtcatgcatacaatggacttgataatgtcagagtgccacgttaacctggttaagtgagaatcagctcattgagtgtgggaatgtgagtgccaagttaacctggttaagttagagtcagctcattgagtgtggggccacctctgtgaagtctttgtaggaactggacatacatcttctcaaggggagaaatgttaattatacagtagcaaaatgagggaagctgtgggggcaggcagagctcaagtgtggctagaaaagatctatcaggcctgtggaccacgcgctggccacatgctgaagggaaacgagccagctgagcactccatttgcaaaacatacatggaagcaacagctgggcttggtgcgaagatccagtaaagggaataacatgagcaaaggctgggaaatcatccatccttccagaatattctgcagtaatcacacccttttaagaattgccttgtggctgggcacggtggttcacacctgtaatcccagcactttggtaggccgaggtgggtggatcacctgaggttgggagttcaagaccagcctgaccaacatggagaaatcttgtgtctactaagaatacaaaattagctgggcgtggtggcacatgcctgtgatcccagccactcgggaagctgaggcaggagaatcacttgaacccaggaggcggaggttgcagtgagccgagattgtgccattgcactctagcttgggcagcaagagcgaaactccatctcaaaaaaaaaaaaaagaattgccttgtgtttgtctcttccactttttaagtggataaactgcaaagaccaaaaagattactatgagattgcagagctgcttctattttaagattgttaactttaatgaagaagcttagccagtatcctcatgccttccatcctgagaagaaaggataagagtaattttttttttttttttttaatacggggtctcattctgtcacccaggctggagtgcagtggtgtgatctcagctcattgcaacctctacctcctggattcaaacgagtctcgggcctcagcctcctgagtagctgggattacaggggtgcgccaccatgcctggcactgtttttttggggtttttttgtttgtttgtttgttgtatttttagtagagacagggtttcaccatgttggcaaggctgttcttgaactcctgacctcaggtgatccacccacctcggcctcccaaagtgctgggattacaggcatgagccaccacacccggcctaggaattctttaaaacagagattttgcttggctaaaaattatattcttgagtatttgaaagttaaaatgggaaattagtaaaaatgaatgattctaactggagatgaagagaaaaaaaggcatccagcacattagatcagattgttttttagacactttttaaagcctcatttttatctgttacactctagtaagtagaagaaagttattttggattttgttttttcgtttaacgttatttttcaatatcagtaacactatattgaggtcatattgttgaatttgatttaatttttcagtttactaccctttgcaatgaaaatactgtaaaatgttacccaggagtcatttatattttgtgacttctagaaaagccattgtgttttgctatcaccaaaatccaaattggatgatggttccttcatcatttggaaggatataatttttctccctggaaaacacagattgctaaagtgaactttcggcaattttgcttaaaatagtgaaacttccctacacacgtttcaggaaggctactgcacttgtaacacacaaaagataatttaacaagtttttaaaaaatgacgttatggtggaagctggccttagttatcaatgcttctcaatttttgaagtagatattatctcttcagaaaattgtttgggactttttgaattaacctgttgttttgatattgtgtaattaatagtggctgaagacctgggtttttctttctctcaggacaatgaacatttattatatttttgtatgtatataactttgtatatatcaatgacacccagagccatggatatgtggcagacactatatggcactttactctaacttttgtaaaaggagcatatgatcccaatttctagatgggtaaactgagaatcaggcaggttaagtgtgtctaagcttacacagccacaaagctcgatctaatgacaccaaagtcagtagtgcattctgtcccatactatgacacataaagaacctatattcttcatgtcatatcccagacacctacttttcctctagtacagcattttctcacctgtgttctgtagaacttcagttttatttgaatacacatactgccaaaataggtttaggtgattaaatgggtttaggaaatagtgtcttaaagaaaacaaaagatttctttactctaagacttaaagccttaacatgctcatatgcactgtgctcatatgcttgtgagaaaggcagatagttgtagggtgtaggtattacagaaagagggaaaacgtctgcagaactgcctttataaatgatgcctaaagtcatcaatgaagacaactttttaatagcctggttaaaagaagcttcacaccattctctttgaacataaagaaggatggtatgggtaaacctaagcttacaatgaaacctgtagattatagttctgtaataagctgtttattacagacaaggcctctctactcttttgtaaaacagttcttcacacctttgtcatgggaaggcacagatcatagatcagatccacagtgcctttcacatgctcctttcttatctccttggccttttccattctggaccacacctatccagaaataattttcgatttcttccacatctctgtacctcttatgagtaagggtcaataatgtggtagttgaagacatgaaggtgagggttatgtaaatacttgaactgttcctccttcaagagcctaaaagaaggaattaaaatggtttcttttcattttgttataggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacagttcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcgaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactc

SEQ ID NO: 13267 - DNA, 46323 bp, Human
ccaaacttgccaattttttttttttttttttgagacagagtcttgctctcaccaggctggagtgcagtggcacgatctctgtcactgcaacctctgcttcccgggttcaagcgattctcctgcctcagcttcctgagtggctgggattacaggcgcgtgccaacacgcccagctaatttttgtatttttagtagagacggggttttgccatgttggtcagccttgtcttgaactcctgatctcaggtgatttgccctccttggcctccccaagtgctgggattacaggcgtgagccaccgcgcccggaataatgttctttctttaaaaatacaaattagcaatccccttaattccacaaagaggaaaagtaaaagaacacagaaatgcttgagttcaatttgctgagaccaataaaatgcactttcaagaaaactgcacagcactagcattggaggccacaaaaataagatacggactctatactcaaggaatttatgaacaaataaatttttctgctggctgaggtacttctctgactgttaaagcaggtaaaacgaagaaatgttcctccgagacttcctacctattctaacctctcaaacttctaattgcaacaatggcagctttatttttatcttaatatttatgtgttgagggttccatataagattagatttgaataaagcactgtatgcctttaaaaaggtttgaaaatcactggtctaataaaagaacagtgaaaactgacaggcagctatattataaaaagaatactggattgagggttcatgatgactgttttattctagttgttgaacatgtacagccatgtcgaaggaaaagttctatttctcacctctcataaaggatggcattttaaaggtgaattttaatgtcattcatctaataaatatttgttgcatgcaataagcacaatgttattcatatattcatagtaaagtaatagggagaaaggaagtacggaatatcctgaggatatcagctgtcatcagagatgtaacaagctgggtctcagagcacaagtttgccaattgattaaaaaggaaaaaaaatgaggcatcgtagatagaatcataggtccagaagaacagaattagaaatagctaccactgaatgaacatttcctccatgcatagacttttatcctcaccacacctatggagatagaagttattatccccatgcagacaggggtatgccaaaatcacaaaactcgtgagtggcagcgccacgtttgaaactggggttgtctgatttcaaagccaaggctctgggttcacagaagtacatgtacttaagaggtgtgaagcaacatgggactactggaaggaggcggtgagccacgaggctggaaatgcaggcacctgctctcgctcacttgaccatagagcaacttgggcaaagaaggggtgggctgacattggagtatggaacaaacgcatgatttcaaataagcatgtgtgtatccatcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccggggtaagggccgcgcgaggaggccttggcggccacagacgccggcggggacgagcagctggcgcacgggccctcggcccccagggctgcacctccgggccctcggggcgaaggggcgcggggcggtgcctcccacctccgcgggcgtgggagcgagccggccgttccctggtctcccttgagcctgccacccatttagcctgccaccccctcacccttccgggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagggaagtgctgtcatggagtgtggacctcagccctttcgctgtgtttgttgggctttttattagttttttcgagggaaggggtccagatcggcagcgcatcgttcactttttgttttacatactagtatttggcccaggagtaggcccacggagaccagcatgttccattgagtggttttgggtgacctaggatcccgcaagactcaagtgttaattccactagccttaggggaagttaattagtgttgattatcccacccccagcccccttttttcccttcgtttcagtatacaggtaatgttagcctttaagattcaaaaattgtaaaatctgactaaagcactgatttagaaactatttgaaaattgtttctgtaatcccagcactttgggaggcccaggcgggcagatcaccagaggttaggagttcgagaccagcccagccaacgtggtgaaaccccggtctctactaaaaatacaaaaattagccggccgtggtggtgcttgcctgtaatcccagctacttgggaggctgaggcaggagaatcccttgaagccaggaagcggaggttgcagtgagccgagattgcgccactgcactccagcctgggcgacaagagtgaaactccgtctcaattataaaaaaaaaaaattgtttcattcagacctccctcttgccagattaaaaaaaaatgtattttgggtagcaaagtcagcaaattagaagatggaaatattatttattctggatgacttctatagtgatttctaaccattttgatgttgcaacattttgtgagttttctcccctccctcccataaatatgatgtatgaattaaagttcattttacttgaacaaaacactttggaatctgaattgttgagggggaaaagagctggtatttactgccataatactgcccttgattagatttgttacacaattttacaagcaataattatggtagcttcatctgaactgtgttaaaaatggactagagtaaaaagagtgttaacgtacattgaggccaggcgcggtggctcatgcctgtaatcccagcactttgggaggtctaggcgggcggatcacctgaagtcaggagtttgagaccaggctggccaacatagtgaaaccccgtctctactaaaaatacaaaaattagccgggcatggtggtgggcgtctgtaatcccagctactcggtaggctgaggcaggagaatcgcttgaacccggtaggcggaggttgcagtgagccgagatcgcaccactccagcctgggcgacagagcaagactccgtctcaaaaaaaaaaaaaaaaaaaaagaaaaacaaaacatattaatgtgacggtttttaagaatgtaatatttttaaaaaggcagatccactgctatggaaacgtctaagattttaagttgaaaaaggttttagaatgattcagtttaagtgtgtgttccttattaaagatgtatgtccacaaacttgtatccgcatatgaaagttttggagggatacataagaaatgttcataatggttacctatgagacagaggataagggagtgagggaagatggagaggacttcatgacctttctgaattattggaaaaatgttctttatttgaacaaagcaagtattattaaactatatttaaactaaattaaccataaacgcatgttacatgtgcggctaaaattcagttaaatgtgctttttaaaaaagtattagcctgatttccactatagtttcaaattggcctctaaataaataaaaaactttaaaaattgaatttaaaattttttgttttgtgattgtgtcagatactctttttagaaagtcaagccagttatattttaatgaattcttttaggggttcaaggtaatgagccctgtatttgtagtatatatgagtttttaaatattaaattagaatgggaatgttaaccgaagctgattttttttttttttttttttttttggacacaggatctagctctgttgcccaggctggagagcgatggcgtgatctcggctctctgcaacctctgcctcctgggctcaagcggttctcctgcttcagcctcccgagtagctgggactacaggcttgtgccaccacacccagttaatttttttatttttgtagagactgggtctccctatgttacccaggctggtcttgaactcctggggttaaaagatctgcccactgcggcctcctaaagtgctaggattacaggcttgagccactgcaccctgctgtcagaagctaatgttatgttactattccattagttagctaacattagaaggctgattttaggctgggcgttgtggctcatgcctgtaatcccagcactttgggaggccgaggtaggaggttcacttgaggtcaggagtttgagaccagcatggccatcatggtgaaaccccgtgtctactaaaaatacaaaaattagccgggtgtggtttctgatgcctgaaatcccagctacttgggaggctgaggcaggagaattacttgtacctgggaggcagaggttgcagtgagccaagatcacgccactgcactccagcctgggcgacagagtgagactgtcacaaaaaaaaaaaaaagctgattgtagtatgttattgattagtcttgtgtctaatccatgtttttaagattcttttccttaagacaagtgatcaattcctgtcataaatgaaaaaagtgagtgtaattaattcaaataaaatttatctgttcttatgcttctagttattttaaaattttatgcagattttctatggacatgattggtttcaaatgaagaaacagtgctgttaaaatacatgaatcatataacaggaatgctgtaatagttctgagtatgtagaggactaggaaccgcttagattgtgtattctgtttcttaccatttgtagacatgaataatcatcttgattttatttagatacctgaagttataatgattcctttataattaaatattaaagaagatattcagatgtaattttgcaaatttatggaaatagttgttatcctaaggtgttttcatttgctccttacatgccttaggttttaaaattgtaggctggctgggtgtggttcctcatgcctgtatttccagcattttgggaggccgaggtgagaggatttcttgaggccaagagtttgagactagcctgggttagtataacaagaccccatatctagtaaaaataaaaataaaattacaggctttttaaaaagttacgattcttttaacctctctggcagacccaaattaaatattctaggacaggagtgtccagtcttttggcttccctgggccacattggaagaggaattgtcttgggccacacatgaaatacactaacaatagctgatgaactaaaaaaatcaccaaaaaaatttcataatgttttaagaaagtttgtgaatttgtgttgggcctcatgcagcccgtgggccatgggttggacaagtttgcctggaaacaagtttgtacttacgatcacatgaccaatgttggtcccgcttgattttctatctcccagcttgaccagtgtctcagtagggttgcccagaggaggaaaactcatttgatccaataatttatgtggattttaaccattcaaacctccttctgaaatcaagccacttaaagtggcccagataggtgaaaatctggaggtctgtgaaactctaggtttaggtcctcttcacgagctaggcccaggcccctggtgttacgtgtcttgttaccagactagggtgatttcatcagcattgagttagatcaccaacaaaatgaaggtttctccagtgcgtgctatgttgctggcacagtgcttaataaggtccagtcgtacagagaagcttatagtgctagaataattgcatttgcatttatgtaattgacatttgtagttgattgtggcctgctttatcgggcttatgctactttatatgttgaatttaggagtgtttgaaacagaaacaaaccaaaaccaaatttggtttcatcttgcaaaatgctttggtataagtagaataaatattttggtggcctaagatcagaacagtcactgtgcagttaacttactaaagaacatcagtaccatgagataaaattagtaaggggaaaataaatattaaataagcccaaatggggctttataaatcccaggttattatttttttgaagagaaaaaaaaaatgtacttttagagcagatgtagatagaatttttcatttttgcttgaaagaacattatactgttcatattcttaccatttgatgactcagtgggaagtaagggaactagtttaaaccacactgctgtgaagaggaaactatatatggtaaaatctatttcttaaacacagccttactgcacacaatgaaagaacgaagtcaccaagtcttaaaatgattgacatgggggaggaatttcaaggattaagatgataccaatgataccaaatgatagtttagaaaggaatgttttctttgtattttatcacatcatggtttagttttttttttttttttagacagagtcttgctccgttgcccaggccagagtgcagtggcatgattttggcttactgcagcctccatctcccgggttcaagcaattctcctgcctcagcctccccagtagctgggatcacaggtgtgcaccaccacgccaggctaatttttgtatttttagtagagatgtggtttctccatgttcgtcaggctggtctccaactcctgacgtcaggtgatctgcctgcctcagcctcccaaagtgctgggattataggcgtgagcactgcgcccagtctagattttttttaatactgattattattattatttgcagaagtaatcagattgtcagttttatattattgaaaaattggggccaggcacagtggttgatgcctataatcccagcactttgggaggtaaaggtgggaggattgcttgaggctgggagttcaagaccatcctgagcaacagcgagacccctgtctccacaaaaaataatataatttaaaaattataatttttattttttctttactgcttcttgcagagcaggactaccccataggcagtgtgcccagagtagccagtataattttttttttaattattttattttattattgtttttgagacagagtctcactctgtctcccaggctggagtgtattcatgttatctcggctcactgcaacctccgcctcccaggttcaagtgattcttctgccccagcctctcaagtagctgggattacaggcatgcaccaccacgcccagccaattttgtacttttagtagagatggggtttcaccatattggccaggctggtttcgaactcctgacctcaaatgatcctcctgccttggcctcctaaagtgctgggattacaggtgtgagcccccacactcagcctttttttttcctgacagggtctcactctgttgcctaggtgggagtgcagtggtacaatcatggctcaaggctcaacgtagcctcaacctccctgggctcaggtgatcctcccacctcagcctcccgagtttctggggctacaggtgtgtgtcaccacgcctggctaatttttgtattttttgtagaaatggggttttgctctgtagcttcaggctggtctcgaactcctgggcccaagcaatccacccactttggcttcctacagtgccaagattacaggtgtgagccaccattcccagccaattattttagttcttgttattataactgttaatgttttcacttttgaagtaatgtgaaatagtgcaatttttgctatcttgatggatgaatatataccctgtatgaaaactggtgctgagttctatggcaacatctgcttccaataaactactgctcaagcagaatagttttattaataagtgattgataatctttaatttgaatgaaaagtctttttttttgttaggcagtaatagtaggtttacagttgtttttatagtttcagggatttcagtttttgtcttctaacttgggaaatgtttgttgcttaaaatatactcataagaatgttaagatacgaactacccatctgaacgattataattggaagactttgagtgatgtgattatttgccactttgccatgttgtatgtccagtgtgtgtagctctgaaggagaggggagacgtgtcaaccttagcagcctcttccctgcactaggatcagacctatgctccatcccaggctcctcctgccacctccagcttctcttacgatttctcacttagtaaacttatttatttgcattcagcatgccaaaaatgaaccttacaaactggtaggttctcttttcattcattcattcattctataatttttttgagataatttatacgcatataagtgagcattttcatcctgataaatggatacttttgactatatctgtttattacttggaggtaggcataataatttaatatcaaaatagtatttaattcccatatttgagatatttgtgtaaattatgactgacattaggctggcgatcatgacagatgttatacagaaatgtgggaacaatagggataatgatgagaacagattctcttccatatcatttaagtttgtatcaagtaaactggattttgacttaaaagagagtttgtgatttgggagagaagagtgtgtgagaggtgtgtgtgtgtgtgtgtgcacgtggtgtgtgtgttatgttttagtttgaaaatactaaaaaatactagatgttattcttttcctctgaggtagtttttcctccatgtcttaggtcacattatttaagaagacactgagaaaaaatgaactactactcctgaattctgttcattttaagggtgggaagtgtattccagttcatcactatcaaccactgccaaggggaaatagctgtgagcaagtgggttatctattgcatatgctatcatatcatgctaacttctgccttaaaaagtaatccaggctgggtgccgtggctcacgcctgtaatcccagcactttgagaggctgaggcgagtggatcacgaggtcaggagattgagaccatcttgaccaacttggtgaaaccccttctctactaaaaatacaaaaattagccaggtgcagtggcgagcgcctgtaatcccatctactcaggaggctgaggcaggagaattgcttgaacccaggaggcagaggttgcaatgagccgagatcacgccactgcactccagcctggatgaccgagtgagactcagtctcaataaaataaaataaaataatccaaaagaattgtattatacttttagaaatggatagctgtacctgaaaaatgcccttaccttggtggctcaatataaactaagactaggtttgtgggcttgtaagaagacatctgaataatatgttttatgtagtttctattaataaaatgtaaacatgaggtgaaaggataggaattgaggtggcattgggagtgtgaactttcctcatttcagacgaatttttcataaaagctttaatctgattgtcatgactgtaacatatttgaaaaaactctgtttttaaaagactaagtggggccgggtgcggtggcttatgcctgtaagccccaggctggtggattacatgaggtcaggagttagagaccagcctggccaacatggtgaaaccccgtctctactaaaaatacaaaaattagctgggcgtggtggcaggcgcctgtagtcccagctacttgggaggctgaggcagaattgctggaacctaggaggcagaggttgcagtgagctgcgatgacgtcactgcactccagcctgggtgacagagcgagactccatctcaaaaaaaaaaaaaaagacaagtgaaattctggatggcagaatgtcctaggctatttataattaaatgtggttcatcagcgtcatctccaacagggctgctgtagagatctttgaaaataccaaatttttatgttttggagagctacataagatcttgctaagttttaccgcattaaacaaaagagtttcttgtagatagtagctttcttttgttgttggttttttgtttttttgggttttgttttgttttgttttgttttttttgagacaggtctcattctgttgcccaggctggagtgcagtggcgtgatctcagctcactgcaacctccgcctcccaggttcaagtgattctcatacctcagcctcccaagtaactgggattacaggcatgcaccaccatacctggctaatttttgttggttttagtagagatgggtttccatcatgttggtcaggctgatctcaaacttctggcctcatgtgattcaagtggtgtgcatagtagccttctatcaagaggtacattgctcttttctgtctacctttgttttattactgtcatgtatcacattcaggtactatttttcatccttaattctaagaatgtgtggtgcctggagccatagaaaaacagactttttctgaatattaaatatattttaaaacaatcatggtatcatactgttaagtcaacagcaaaacttttaatatttattgatcatttactgtgtacctattatgtgccagacgctgttctaggcagttggaattcatcagtaaacacagtgtagctaacattaaataaatgcttgttaaagagggtgcagactatgattacatttcctttcttatatagcttcctcctcccaccctgaaatttttaattgccctttccttgcaatgtctgctcttactagactatgtattatttattttttgtatgttttttgagacagggtctcacatgatcacggcagccttaacctcccaggctcaagtgatcctcccacctcagtctctggaatagctgggactatagcacatgccacaatgcctggccaatttttaaattttttgtaattttttccgggggggaatcttgccgtgttgcccatactggtctcgagcttctgggctcaagtgatctacctgcctaagcctcccaaagtgctggaattacaggtgtgagccactgggcccagcgtaaacagactatacaagaatttgtaactgccgggcacagtggctcatgtctgtaatcccagcaactcaggaggctgagacaggaggatcattggaggccaggagttccagaccagcccgtgcaacatagtgagaccccatctctacaaaaaattttaaaacttacgctaggcgtggtggctcactcctgtaatcccagcactttgggaggccgaggcaggtggaccacttgaggtcaggagtttgaggacaacatggtgaaaccccgtctctactaaaaataaaaagaattacctgggcgtggtgaggtacacctgtagtcccagctactcagaaggctgaggcacgagaatcacttgaacccgtgggcgggggcggtggaggccaagcttgcaatgatctgagatggagccactgcactccagcctgggcgacagagtgagactctgtctcaaaaaataataatgaaaataaaaacttattcgggcctggtggcacatacctgtagtcccagctacttgggaggctgaggtgggagcatcacttgagcccagcagttagaggccacagtgagctgcagttgtgccactgcactccagcctaggcaacatacaagaccccaactctaaattttaaatattttttaaattaaaaaagtattaaaagctcttgattctctcaagttttactgtagttaaatcctgtagaatatcagcttcttatgtataaaatggaagtcttatcacaatgatatgttctcggagcagtacacagagaatgaaattatgttacccggtattactaaatatatttatctaaatgtaaaaatgtaaatagggccaggcgcggtggctcacgcctgtaatcccagcactttgggaggctgaggcgggcagatcacgaggtcaggagatcgagaccatcctggctaacacagtgaaaccccgtctctactaaaaatacaaaaaattagctgggtatggtggtgggcgcctgtagtctcagctactcgggatgctgaggcaggagaatggcgtgaacccgggaggtggagcttgcggtgagccgggatggcgccactgcactccaccctgggcgacagagcgagactgtctaaaaaaaaaaaaaaaaaaagtaaatagctagccaggcgcggtgactcaacgcctgcaatcccagcactttgggaggccgaggtgggcagagcagctgaggtcaggagttcgaaaccagcatggccaacatggtgaaaccctgtctctactaaaaatgcaaaaattagctgggcatggtggtgggtgcctgtaatcccagctacttgggaggctaaggcaggagaattgcttggacctgggaggcagaggttgcagtgagctgagatcacgccactgcactccagcctgggcgacaagagtgaaactccgtctcaaagaaataaatagccaaaaatgcctaataaatgtttcttttcataatacggtgatattagtttaaatgacacttggttttcccattttggaaaatgacattctctaagcgatttgcccaaaatgaatgaaagtctgctttagaattgaagctttagttctgttcattttctcacatttctctttctaaaaatacttagcattttgccgggcatggtggctcacgcctgtaatcccagcactttgggacgctgaggcaggcggatcacctgaggtcgggagtttgagaccagcctgaccaacatggagaaaccccgtctctactaaaaatacaaaattagctgggcttagtggcgcatgcctgtaatcccagctacttgggaggctgaggcaggagaatcacttgaacccaggaggcggaggttgcagtgagccgagattgtgccattgcacttctgcctgggcaaaaagagtgaaactccgtctcaaaacaaaaacaaaaaaaaccttagcatttgttcagcgaatttgtccatcccacagatacttctggagtgagcactgtgtgccaggagctctgttaggtattggattccagcacgaactgctcagcttagctccctgctcttatgaggcttttggtctagtgagggaacttaggcactaatttagcagtaaataaacatgaaccctggaagtaggcaatgccgtgaaagaagttaaaaggagatgttgcgatagattgagtggctacttcgggtggactgaaagcaccaaaagtttaaaatgttatataaatgcaaagtgatatttttcagatgctgtcttaaaatatagtaaatatcctgatgctaacccacttttattttactgtttcattccagtttgtgaagtgtggatatgcaggctctaactttccagaacacatcttcccagctttggttggaagacctattatcagatcaaccaccaaagtgggaaacattgaaatcaaggtaatattttatttattgataaatgataatcaagacatgtgaggtgttcttataaaagtagtttaacagttcttttaagtagttttaaaatatgttgccatgaaaagcaaaggggagggtagaagttctcatatttttaatttatatcaacacctgaacaggggcacaaaaattgaagttaatttcatctgattttgtttatgtatggcttgatgccattactctttggagtaaaatacttaagtttattacattaatgtgaaacgctgtgttagtgacttaagtcctattacataatataatttttaaaagaaatcggcctggtatttttatgtctttcaattccatatatttgtcattgtatgtgagtgtctctttggcaccttagactttttcttttcatgtttttatggcctgatccctctacttttttatatagccatttaggaaaacacagggtgtaaatctcattgattcctcttttcattaatataacttatttccataatgtgcagaaggaagccattcaagcctttatttggccttggattatgtatcttaccataaagaggaaggaaagttttcattgcctactcgctgtatttaagatgaaagactacatgaaaagacgatcgatttttctcccatattaaagggatcagaaatcaagtaggagttacaatatttaacaagaaagagaacagtgagaggacagtagtcaccagttggctttaagttcttcaggtgactgaaggatcaagttatacagaatgccatagaatttagggtcttttttagtgaattatttgtgaacacgctagcattgtttgtcctatctggatagtctttagcaagccttcagtgtaaggttatgagtcatttgaaatatgcattagggcgtatctctttgggacatttgttttatgtaggaaggtggtaatgggtggtagagatttgctatgtagccttctgcttttgggatagagagttgagttacacaatgaataaaaatacaacctgaaacttgggttctgtgttagtttttttttttcagagttaaagtagcgaatttttctggcctctcctgttaacaaaaaaaataaaatgggacactcagtgtaagtttttcctttttaaggagcttttggaatatttgtgggattccttacttgcttattgtgaactcctttcattctgaatgaattctatcttaaatgaactttgactggaaattagctaataatagtgataaggataaactgtttaatgaagttgaaggctatactttttattcagtgtcaggtttttaaagaatggcttttttatatactggacaataaaatttttgaggtatgaagaaatatcatgtatagccataaatttattttgcaacataggcacaaataactacacatctcttcatgcccactttcttcgtgtttaaggccaagtgatagaaatcaaatttgtcagtatgctaataaaacatttttgccaaggaattccctagcagcatttgcttgtatggtttgtcattctgtattctattggctcaattctgttcactctgtgcaatcttgtaagcctatcaagttaaattattcttcgagtagaaaacagcaaaagatacctgtgtcaaataaatttaacttgaacactagagcttggaaaaacaaccctgagctatctaacactctgcctactcagctagacctttgctgttatcatttatttttcttaattaaagttcttaagttcagtaatgaattaaagaagcttactttttggaattcctgtgcttagtattttgacttatactttttgtgtcttgttagctaaaatgtggtagactgaaaaatggaaatttaaatcgtttaatgagttaatttgcattcaggaataactgtccatgttaatttggccctaattattaactccattaaatatagtagtactgcatctgacctcaacctaattgtctctattgcttgtatgtttaaacatttcagtgaggattttatttaggccttttctgactcttacttctaccttctctctcttcacctttcttgacccgttgaagtagaataacaaaaagatggtaagtgaggttacacacatgctctgtttgttttccacttttgcttgatgggacagtagttgttgttttgtgtccctttagtattggggagggggggttatttccatatttttattttaagtactttgatttttaacctttttcattgcttcaatttgatagcaactaattaagtcctatactttcctgattgcgtacaatggaccaaacaagaactaattactaacatagttttgaattgttttccttgtttttcttgtagatgaatgttataattaaaatggaatgtgttgtgcataatattagaaaccagatggctttatataggatatgtgtgatccaaaaaattcaagtgaagttgttacatttgaataaattcactttattgaccagtattaaattgaacattgactgtcatagcctgtatatatatttgcatctagtgtggtatcatatgtgtacttaataaactgagtaaaattttaatatgtaaataaaccatagatagaaaaagagaattctttccatatcatccttactgatgagcagatttcacaacgttatctgaggataaataagaaaaaggtaaagcttttctataaacaacagatttcccccccaaacattgtacagtgtgtttttctttataactataagcttgctggtcttatctcagacatttaactcttcattgtatttttctgtgatagtctaagtgcttctgtagtagatacttttcaagtttgtttttaatattgtttgtaagaatctctgacaaaaatcaggcacttctaatatatattttaactagtaatagtaactttgtgaagttttcttttgaataaacaaaaacatttaaaagaggaaatttatcctaaataaaagatcataacatttgtgtttatattctaatgagattaagaaaagggtgtgcttgctgggcacggtggcttgtgcctgtactcccagcactttgggaggcccaggcgggtggatcacgaggtcacgagttcaagaccagcctgacgaacatggtgaagccccatctctactaaaaatagaaaaatcagccaggtgtggtggtgtgtgcctgtaattccagctactcaggaagctgaggcaggagaatcgcttgaacccgggaggcagaggttgcagtgagccgagatcacgccactgcattccagcctgggcaagagtgagactccatctcaaaaaaaagaaaagaaaaggaaagagtgcgcttgtagagaacagtgtaggcttattttaacagaagtttttgaccgagtgaggtgtttcatgcctataattccagcactttggcaggacgaggtgggaggatagcttgagcccaggagttcaagaccatcctgggcaacatggcaagaccctgtctctatagaaagttttttaaaaagtaaccaggcatagtgatatgtgcctcccaagcaacttgggaggttaaggcaggagtattgcttgagcccagaagtttgaggctgcagtgggtgatgacagggccactgcactccagcttgggtgacagagcaaaaccctgcctctattagttaattgaacaaacaaacaaatgttttcagtggaattttcttctagggatttaattgtgcttttgaacttgagtttactctgtattctaatttgaggtgacattgttcaaaatgattcttggcaaatataatccctactacccacttttcatgaagtataaatacctttgaaacagcatctcagttactgtgatttttttcattgtttcagataggtgatgttcagtggcggggcaggtggttaaaacctaaggtctgatctgatcacttataacttggttctgagtgatgaaggcaagttatataacacttagtaggatttttttattaaaattttcgatatgaaaattttttaattggatagcttgaatagtcaaactttgtacttcttaaataagttaatactccattttaaatgtcctgtttgttctgaggaaggtaaggatactcaattccaaacatttctttcagttaatcctttatagtatgtgtggtcctagaagtagatacatgaggcatttatttagagttggcattgggtcatgtaaatgtaagcccctatttgtacattaaataaaaagtaaatttctgttgaaatcagatcagacttatttcaaattggttgaaataatactgattatattatctaattatctaatctgttatcttgtacaacacacaaaaaagacgtaaagttagtaacaaaaatggtatatataattacaggtatagatttcccccctaacattttattaagcagtattaagaaaatgtagcaatattgaaatgattttacaatgaaacttgtatatccatcacctggattctgacattaatatatatcatactgatttattacatatctgttcatctgttcattcatcagtgcatcttgttttttgatggatttcaaagtaagttgcagataccagtatacttctccctgaatacttcaacatgtgcatgttattaactagaattcacaaatacagatttttagttttgcatattcctcatagaagaatctaaacggttgggtgtggtgattcatgcctataatcctagcactttgggaggctgaggtgggcggatcccttgagcccaggagttcaagaccagcctgggcaacatggtgaaaccctgtctctactaaaaatacaagaattagctgggcatgtagcctgtagtcccagctacttgggaggctaaggtgggaggatcacctgagcctggggaggttgaggctgtggtaagcaataatggcaccactgcactccagcttgggtgacagagtgagaccccatctcaaaaaaaaaaaaaaaaagagtgtaaacatttaatatttcagatatttgagtaataagttagtaagttatggtaaatgaacttcataagaaattgcaacaaatttttactgagcatttctagcatctgtttttaactttgttatactttttgatgcttttagtggattttccagagatctgtttggttttttgttagagtcctcaccttggtttcatctctgatattttctttttcttttttttttaatttaaaactcatatatttttaagcctttgttttaaaacatctcatgttggccaggtgtggtggctcatgcctgtaatcccaacactttgggaggccgagatgggtgaattacttgaggtcaggagtttgagaccagcttggccaacatggtgaaaccccatctctactaaaaatacaaaaattagccaggcgtggtggcaggtgcctgtaatcccagctactcaggaggctgaggcaggagaatcgcttgaacctgggaggcagaggttgtagtgagctgagatcatgccactgcgctctagcctgggcagtagagcgagactcagtctcaaaaaaataatctcgtgttaattttgctgctgcttttttttgtctctccataattaaaacttaacgtattgtagcaaatatctacttctgatactagtttttttaattgaatttatcaacatatgtagaaattagtattatttaacatcttgactagctgttctctaaaaataagtctaaatgctaggacatccttacttattatatatagaaaatgtgactttcaaatgtgggtcatcttaagtatgctctcattggagacaagacttgtgagtattatgcttcatgtgtgatggtgtagttttccagtatactttaagattgaaaatgttgctcaggagacaattttaaaggatgggttatttgcctatatcttaattttttataactctacaaattctcattcaccttggtgaggcatatgtagaaacagtttaaattcttattcaggcatatgtagatagaagtttgtgctatttataagttagttggtgtatgtatgcattattatagagtaataaagaatcattttattttttgcttctttcattatgctttatagtacttacatttatcattttgatatttagtgcaaagaaatgtgctgcatgcattgagcatttttctacaagtttttttccccctgatgtgctatttcacatatcacaggccttattttttgaacaattgagcaaaagaaacagatgaaacctcatacaaaaccctccaaaatatgaaaatgtggggtttatttgtgctaatgctcttcttttggaaacatttgtgttaaaggtaaggtcaatttattgatttaaaccacattgtatgtaaaaatgtattatccatgattaaactttctaagacattgttcttgatagaaaagattttctaacttgtggaataaaaagatttattttgcaagtgtcagaaatattaaaattaattattcccaagttttcttaaatattatgcaaaactttgatctacagctttgacataattttctaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtgagtttttatgcaggatatgcatatgtgtatttctgtgatattatgttaaatcaaaaattttctactgttgctatggataaagagaataaaaataattgttttccttcagatcttattaagtatctactatatgctagtcattattctaagtaggaaagtaggatagatcagtaaacaaaaaatcctactgccatggagtgtatatattctaacagggaaaaacagaccaaaaaaattaagtttttaatttagtgagttaattaagttaattaagtttttatggaggagccagcagaaggagactgaaaaggctaatacaataagcagttacagagttaattaaatggtttgttagaaggtgagtgatccagttgacccatgagcaatgcaggggttaggggcaccaaccctccctactcacgtgcaaacttaactaccacccaaaatacttaacttctaatagcctactgttgaccagaagccttactgataacataatatgtattatatactatattcttaacaataaagtaagctagaggaaatactgttaagaaaatcatggccgggcgcggtggctcacgcctgtaatctcagcactttgggaggcggaggcgggcagatcacaaggtcaggagatcgagaccatcctggctaacacggtgaaactccgtctctactaaaaatacaaaaaattagccgggcgtggtggcgggtgcctgtagtcccagctactcaggaggctgaggcaggagaatgacgtgaacccttgaggcagagcttgcagtgagtggagatcgtgccactgcactccagcctgggcgacagagcgagactccgtctcaaaaaaaaataaaaaatcataagagaaaatacatttactataccttaagtggatgtagatcatcataaagatcttcatcgtcattgtcttcacaccgacgaagaagaggaggggttggtcttgctgtctcgggtggcagagacagaagaggtgcaaggggaggcaggaaagatttattgacaaaaatcgtgtataagtggacctgtgtggttcaaacttgttgttattcatggatcagctgtagatgctaaaggcaaaataaatcaggttaacggggagtgggaggttgtaattgtacataggttgtgagaaggtgatgtttaaacagacagggtaagtgagttagccagggtatataggagaatggtattccagataaagggagtagccagtgtaaaggtcttaagttaggaacaagcttggtatattaaagaataagcaaggaagccagtgtggttgaggagagagcaacagaagatgaggtcgagtaagtaatattggtgccttgtaggctctaattaggaattgggcggctggaagtggtggttcaggcctgtaatcccagcacttctgggaggccgaggtgggcggatcacgaggtcaagagttcgagaccagcctgaccaacatagtgaaacgccatctctactaaaaatacaaaaattaactgggcatagtggtgcgtgcctgtaatcccagctacttgggaggctggggcaggagaatcgcttgaacccaggaggcagatgctgcagtgagccgagattacaccactgcattccagcctgggcgacagggtgagactcagtctcaaaaagaaaaaaagggaattgggcttttactgtgggtgaaatatggggctgttacaggaaaaggagatgctcagatttagatttctcttgtgttgtgagtatcccacaaggaggcaaagatagaagagttggagactttttcagtcatttaagcaaaagataatgatggttaggattgaagtagtagtagtagagatagtgagaaattaccagattataggtctgttttgaaggtagggctataaatgatacggttcaacaaagaagagggtagacagtggtgaaaaggccaaggaccagagagataggaggagccagcagaaggagattgaaaacgttattgaggccgggctaggtggctcccagcactttgggaggccaaggcgggtggatcacttgagactaggaatttgagaccagcctggccaacatggcaaaactccgtctctactaaaaacacaaaattagctgggcatagtggtgcacgcctgtaatcccagctacgcaggaggctgaggcaggagaattgcttgaacccaggaggtggaggttgcagtgagctgagatcaccccactgcactccaacctgagcgacagagcgagactctgtctcaaaaagaaaaaagaaaaagaaaaaaaagttaatgaaataatgaaataagcagttacagaggaaagagagagcaagagagctatgatcctcatagtttaaataagtaatttttcaaggttcttttatttttgtatatatgaagtagaaatttaataacttctgtagctttccagttactgtttaatgtacatattttgtttacgaatatgtttaaatgttgatggaaatttttgaaagggtttagaagaaaatgttgttagtatttttaaagcctgtattaaaactcagtttttgtattaagtgttttgaaaatctaagatcatggttttaaagaatccatatgatttcttatggcttatattttaatattcttatttgtttatgactacaaatatgtctatgactgatagtgtcctaccttaatctcattaacatgctttcacattggtatgtgcatatatatgatcattcttccattttcatccctgtggaggtggaataaaggatgatggaataaaatactattcagactatctaattgcttaattgatgagtatgtgtttcagagttgtagaatttaaattctgtgtaattttcattgtggtcagttgtaaaatttctaaatatttagatattcagagtgataggcaaccctaccagtcaaggggtgctcagtcaagatcaccaaaaaaaaaatcatgcaggatgttcccagctgacctgggctacagagaatgaacatgtgtgtgaccagtgagggcaaaaaggaaagaactcctccttccagggtagttcatttggaggttgtaattacagtcttgattcaagtagggactgggctcagcagctaagccatttctgtatcttccagcaatcaggaattaaccattgatttttgtctttgccgtggcattttactgggttttttattttttctttctttctttcttttaatttttaagctgctcagggtagacagagctacactcttggcccagattgagggagggggtacgaggctctgtaaagcaatttctatattttgtcttcgaattaaaagatatttcccggccgggtgcggtggctcacgcctgtaatcccagcactttgggaggccgaggcaggcggatcatgaggtcaggagatggagaccatcctggctaacacggtgaaaccctgtctctactaaaaatactaaaaattagccgggtgtggtggtgtacgcctgtagtcccagctactcgggaggctgaggcaggagaatggcgtgaaccagggaggtggaggttgcagtgagccgagatggcaccactgcactccagcctgggcgacagagcaagactccgtctcaaaaaaagaaaaaaaaaagatatttccctggctggatgtggtggctgacacctgtaatcccagcactttgggaggccgaggtgggtggatcatgaggtcaggagttcgagactagcctggccaacatagtgaaaccctgtctgtactaaaaatacaaaaattagccaggcatggtggtgcatgcctgtagtcccagctactcaggaggctgaggcaggagaatcagttgaaccctggaggtggaggttgcagtgagccaagattgcgccactgcactccagcttgggcaacagagtgagacttcatctcaaaaaaaaaaaaaaaaaaaaaagaatttcccttaagggatatcaattaagaaagtcttgttcaatacagagagctttctttcacactaattagtcattaactaatacactaagaaatctttgctttgtcacgcttatgaaatgcttggggacttagaaatctgtcttcagatttggagctctgtggcagcaggactttaataagaaataagaggagctgatgaaaatggaagactatttcaggtccatttgattctattttgggcaattaattcactctgtgaccatgaggaaaacatttatttattatgtaattttctaaataccagtttttttctttctgtctgcatttacaggtaatgtttgaaacttaccagttttccggtgtatatgtagccatccaggcagttctgactttgtacgctcaaggtaggttaagcttaactgttagaaaaaacacttcatcaaacatttattatgtatgttttatgtcagagaatttggtttctcaataagttataagccccagaaaactacattatttatataccacactttgaaatattttcagtttttaaaatttgtgaaataagattttatatacatttttatttgctaaatatgtatttaaggtaaaaaaaaaaggcttaaagacttattttttaaaaaataggatattctctcttttaagctatttaaattttttttgagacagattttcgcttttgttgcccaggccggagtgcaatagtgcaatcttggcttaccacaacctccacctcctgggttcaagtgattttcctgcctcagcctcccaagtatttgggattacaggcatgtgccaccacacctggctaattttgtatttttagtagagatggggtttctccatattggtcaggctggtctcaaactcctgacctcaggtagtccgcccgcctcagcctcctgaagtgctgggattacaggcatgagtcaccgtgcctggcatagctattttaattttttatgcatggaatttgtccccagaattggcttgagttaaaaaaaatacgcagagattcaaaaaggtagcataaaatcatgcctgtcaaatatatagtagattaaaaaggagaaggtaaacatttgggagtgcatttctaacttttgaggtgggtttaatggaggggactacttatatattctcttgatattgccattagcaactgcctccctctttattggaaataaaatattggccacgttgggagagctcttttttttttttatggtcttataaattcaacaggaacttactgagaatgtctgggcctgtcagatatgtgccaaggagtcttttaggcacttcaggggataatccagtgggaaaagagtgtggcactggaaatgggtcaagtgtgtttggagaaaggccagtatgtgtgtgacctgatggaagtggtagaaaataaggtgaggtgggtagggagggctctttgggaaataaaatgtaaattcttgcattagtcagtgttcctgggagtatttttgaattgatgatggtgtgaattcctccttttttttttcttttttgcaatggaaatcctcttctttttaaaagagtacaacattcaagggctgtatatgagttttatgaggcttattgcatcaaggaattatatccacttaaaaaggaggtagttttaggccgggtgtggtggctcacgcctgtaatcccagcactttgggaggccgaggtgggtggatcacgaggtcaggagatcgagaccatcctgactaacactgtgaaaccccgtctctactaaaaaaaaaatacaaaaaattagctgggcatggtggcatgtgcctgtaatcccagctacttgggaggctgaggcgggagaatcgcttgaacccaggaggcagaggttgcagtgagctgagattgtgccattgcactccagcctgggcgacagagtgagactctgtctcaaaaaaaatatgtaaataaaaataaataaaaaaagtttttttgaccaggtatggtggctcatggctgtaatcccagcactttgagaagccaaggtggtcaaattgctgtatctccagagtttgagaccagcctaggcaacatagtgagatccctatctctataaaaagtaaaattagctgggtgtggttgcacatgcctataatcccagccacttgagaggctgaggtgagatgatcacttgagcccaggaggttgaggaaacaggggaaacaaagcagcttctttgctgttcttttattatgaggtttaactgacattgccttttattataagttccagtgaataatcaaagtgatgctttggctagccatgtttaatttttcttagatttctagctgtctagtatcaataggcatttttccagaacacacagtatatgttatttgtagtatattcaaaactatctaagttgaaaaaaataaagaattgtacagagctttaagaacgtgttctgctgggtgtggtggctcacgcctgtaaccccagcagtttgagaggccaaggcagacagatcacttgaggccaggagttcgagaccagcttgggcaacatggcgaaactctgtctctacaaaaaaattacaaaaattagccaggcatggtggtgcatgcctgtagtcccagctgctcaggaggctaaggtgggaggtatgacttgaacccaggaaatgaagattgcagtgagcctagattgagccactgtactcctccagcctgggtgacagagccagaccctgtctcaaaaaaaaaaaggaaaaataagtcctgtttttcagtcctcagtctcagggtctgtttcttctcatctccttggacagcacataatagtagactaaaagtcttaaaagagaacactcgctttaatacttatgcattagaaacaaactgcaaaataactaaataataaattctggcttctagttggttacgtttctgttttggcttccctactgtatttggaactcgctggctttggttttcctgatttgactttttatttaaatccccctggcttttatgcaggtttattgactggtgtagtggtagactctggagatggtgtgactcacatttgcccagtatatgaaggcttttctctccctcatcttaccaggagactggatattgctgggagggatataactagatatcttatcaaggtaagtgaacggaaaatatcatggaaattaaattttgtaatttgtttaccaccttaacacagaattgaatctatcgttttaggattccagcaaatctgtaccactagagaaattatccaattacctcccttatttatataaaaattcatataagatttatacacatgaagaaaaaagaagatacattaaaaacaaggaaaaaagtgtacacacatgatctctgtatactaatgagagtacattatatcattacataattatatttgttattcctgaggagtgagtagacagatatttcaaggatagaagagacccctaatttgaaactttcttggacagctcaggcagccttttctgccataaaacctttctttgagcaggtatgttttaagccatgatcttggttgggttgtctgctcttgtcctttcctacaaaatacagtgatagcaaattaatgatatttgaggaaaacagcccaaatacgccagactttaatatttagtagttttcatggaatagatgcagtttttaatatttactattttagtttatttctgaatataactagttataattttctttaaaacattactggagaaagtacataaggtgtctacttgctaacatatatcatttttaatattaaaataaaatttagaaaattgtttataccacaattctataatcagtctatcctctccaggacagtggttctcaccaggggacagtgctgtcctctgggggatattagcaatttctggacacatttttggttgtctgagctgggcaggaatgctactgaacattctataatgaatagggctggctgcacaacaaacaatgtatagtctgtcagtggtgctgctattaagaaaccctgtctctgcattaaattgggttgcactgtctttaccttgacattgggttccttcagtctcatttaaagtaatcctcctcatgaggggagattaaattaatgagaattataatactctcattttaggccaaaattcaaagcgtaactaacagaatttctggggttgtctttagaacacagactcaaatattagaggattttttttttatttgtaaagtctagtaattttttttctctcagtgggtttttaaaaaaatagtagtattttctagcatttaagaaatgtaacaatggagattatacctttgagtatcccaataattcccttatcattcgttaaacaaatgctattgtccttctaatatgtgccagacacagtactagaagctaaagataaaacttttaaagacttgggggcatttcataaatatggcattaattgtgtgagcaaactgcaggctacaggagtccagtactaaaataatatttattcattaatatacttttgattgtttatcaaaactatcaaaacattagtactcatgcagtgcttttcaaaaactgacttttctagtcattttactgacttacttatgaattgttaattcttttaccctctctgaaactgaaatataaatccttttatggcggataaaatcctgcttctgaaatagtaggagctgaggatccactgcccattctgtttgttattgatgtgacatatttaatgagcattactagcttttgcagagtagaactcattcagatgtattatgaacttattgctattgttttgtaccagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacagtaagtgtttccagtgtataatatatatgtgttttaaagtggacagccatgattattggtgtcagcttaaggaggttttcttagaatcagtatttttgtcttgggttgttgtaatatgtatatgtgtgacttttaatgtctctttctacattaagtttctatttaattattttagggcaccatataatgcaaattaaggcaagaatcataaattactctctatactaggatataattagatgcgagatgttattttgagattctagtatttggcatagcatttctcaatgtatgttttacagaactttatttccctgagatgctaataagcatttcacaaaaattaaaaaggattacattgtcagatgagtttgagaaagagttgatttcacttcactgtagaactcagagcctttggtatgctaatatgggcacaattaatatagtatgcgtgtttttcagacttatgctctaggacttttcagaatttcatgggattagtgatctaagaaacatactttggaaatggtcattctagagcattgctttactaattcagtaggtggcagcctttcctgacttaatattctttaatgaggtgttaaatgttaacttgaaattgtaactaatgagatttagtacctggttatagtttataacaccagaggagttgatcctacttgaatttttaatgaattaccatcttaagcctattaaattcgtctgagtataaagtacttccaggtctcatctttgatctagttattactaaaatgaaacagtaataggcaatgaaggcaagtattttaaaaccatatgatgcatactagctctacatattcacaaatatatgcaaaatagtcatttttaaagtaattataaaaaatttgttgttggccgggcgcggtggctcacgcctgtaatcccagcactttgggaggccgaggcaggcggatcacctgaagtcaggagttggagaacagcctggccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcggtaaaaaaaaaaaaaaaaaaaagttaagatagtgatccaaatattcagtaaacccccatttaaaaattttttaaatttattttttattatactttaagttctgggatacatgtgcagaaaatgcaggtttgttacataggtacacatgtgccatggtggtttgctgcacccatcaacctgtcatctgcattagatatttctcctaatgctatacctccctccccttgccgccccccacccaacaggccccatgtgtgttgttcccctccctgtgcccatatgttctcattgtcagctcccacttatgaatgagaacatttggtgtttggttttctgttcctgtgttaatttgctgagaatgatggtttccagcttcacccatgcccctgtaaaggacatgaactcattcatttttttatggctgcatagtattccatggtgtatatgtgccacattttctttatccagtctaacgttgatgggcatttgggttggttccaagtctttgctattgtgaatagtgctgcagtaaacatatgtgtgcatgtgtctttatagtagcatgatttataatcctttgggtatatacccagtaatgggatcgctgggtcaaatggtatttctagttctagatccttgaggaatcaccacattgtcttccacaatggttgaactaatttacactcccaccaacagtgtaaaagcgttcctatttctccatatcctctccagcatctgttgtttcctgactttttaaggatcgccattctaactggcatgagattttgtggttttgatttgtatttctctaatgaccagcgatgatgagctttttttcttatgtttattggccacataaatgtcttcttttgaaaagtgtctgttcgtatcctttgcccactttttcatggggttatttgtctttttctggtaaatttgtttaagttccttgtagattctggttattaagcctttgtcagatggatagattgcaaaaattttttcccattctgtaggttgcctgttcactctgatgatagtttcttttgctatgcaagaagctctttagtttaattagaacccatttgtcaattttggcttttgttgcaattgcttttggtgttttagtcatgaagtctttgcccatgcctatgtcctgaatggtattggctaggttttcttctaggagtaaacccattttgtaacttaatcatctccagatttgctctggagattccttcctgaagtcttcttgacagtttctctagttgtctgattttccatctacctgactattttggaagaaagtggctggcacagggcaaaagataagcaaactaggaatgtaaaacatgttttatttcttccttctctcttttctcaaagaatttgaggtaggctacaaaaatatatacaaataggctgggtgtagtggctcacacctgtaatcccagcactttgggaggctgagatacgaggatcacttgaggccaggagttcatggccagcctgggcaatataatgagaccctgtctctacaaaaaaaatacaaaaatttgccaggcgtagtggcacgtgcctgtagtcctagctagttgagaggttgaggtgggaagattgcttgagcccaggagttcaaggctcaagttttgaggcagagagctaggattgcaccactgcactccagcctgggtgaaggagcgagaccctgtctcaaaaacaaaacaaaatccatatatatatttgatatatatatgcacacacacacatatacacaagtataaagtaataagctgatgaataagtgaggagggacatgggtggacaaatacagaacaggataagatttggtgcaaagaaatgggatgcctgcagttttaacagttcattaaggtgattagaaaacttgaccccatgctggccagcagccagagaatggagagaagccacactatcaggcttcaagtgcttaaggcaggaggttttgctaataagatctgctgtgtgaagtttttccagatattttgggtgatttcatgtgaacccacctgaaggtggaggtggtttttttaagggtataagttttggtaaccttttttttttctttctgttttgagacagggtttcctcactctgttgctcaggctgcagtgcagtggcatgatctcggctcacttcagtctcaatctcccagggttaggtgatcctcccacctcagcctcctaggtagctgggaccaaagctggaatctaaacaatcattgtaattggccaggcgcggtggctcttccccataatcccagcaatttgggaggccaagatgggaggatcatttgagcccaggagttcaagaccagtctgagtaacaaagcaagacccccgtctctacaaaaaataaaattagccagccatagtagtgtgcatctgtagtgccagctacttgggaggctgaggtgggagaatcccttgaatctgggagattgaggctgcagtgagccatgatcacaccactgccctctagcctggacaacagatgaagaccctatctcaaaaaaaatatatatgtattgtagggccaggcatggtggctcatgcctgtaatcccagcacttttgggaggccaagccaggcagatcacttgaggccaggagctcgagaccagcccagccaacatgcagaaactctgtctctactaaaaatacaaaaattagccaggcgtggtggcacatgcctgtaatctcagctacttggggggctgaggtatgagaatcatttgaacccagtaggcagaggttgcactgagccacgatcaagccactacactccagcctgggcaacagagcgagactctgtctcaaaaaaaaattaaattataaatgtactgttagacttgttaatgtaaaattaattctggtatctcatggaaatgtgtcaaatgctagcatacatgggcgtgcttattacttaggacaatccagtgaattgtgaggtgttatgagaggaagtttctacttaacacttctcatttaattaaatatgaacatgatgtgtgactgacaagatttttttgtacaaagtcataatatgatacctgatttgtttaaatcttatttgcttaaattgaaattatatttatcagttacttaaaatgtattaggacctagtaggatacaacagaattgcctaataaaaatagtctagaccagtgttctgtaaacttttttgatcataagacattttttggattaaatgatttgatagaagtggtacacatgttataaagtattttggcaaaataatagtttcacagagtaattatttgatgaaataaaattatttaaaatgtttaatgtggctaggcgcagtggttcatgcttgtaatcccaacactttgggaggttgaggcgagcagatcacctgaggccaggagttcaagaccgcctggtcaacatgatgaaaccccgtctttactaaaaatacaaaaatatgctggcgtggtggcacatgcctgtaatccgagctactcaggaggctgaggcaggagaattgcttgaacctaggagacagaggttgcagtgagccgagatcgtgccattgcactccagcctgggcgacaagagaaactctgtctcaatcaatcagtcaatcagtgttttaacatgtctgttctacatagcagaaatatccataaaatcacaaatatgttaaaattataaaactgtagtaacacataccagcaataatcaaaatacaatggttggtcagtgatgcttgtttctgctttgctgcaaacatcatgcactcatgcatcagtgatttctccaagaaattcctgatatttgggggcgtggcataccttttttttttttttttttgagatggagtctcgctctattgcccctgctggagtgcagtggcgtgatcttggctcactgcaagctctgcctcccgggttcacgccattctcctgcctcagcctccccgagtagctgggactataggcgcccgccaccacacccggctaattttttgtatttttagtagagacagggtttcattgtgttagtcaggatggtctcaatctcctgaccttgtgatccgcccagctcagcctcccaaagtgctgggattacagacgtgagccaccacgcccggcctggcataacatttttaaaagcaaaacagaatgtgataagagcagttacctaaatctatttaatttacctttttttccccaaatatattttaggaaaaattgttgttggtaatgattttggttacagaacagatgtatttataagtactagtgttccggagaacactgggaaattttaatcttttgctgattagtacctgattattcttggtttctagctcccagatggacgtatcatcaaagttgggggagagagatttgaagcaccagaagctttatttcagcctcacttgatcaatgttgaaggagttggtgttgctgaattgctttttaacacaattcaggcagctgacattgataccaggtacattagaaatggtgatttcaaagttatttatcagaaaaatcataaaaatagttttaaagttatttatcagaaatagatggaattaaatagaatgactaagtttataaacttacttgaaataatttcagacttacggaaaggttgcaagaaaaatgcagaaaacttatctgtatcctttatctggatttaccattttactaattctaatgttcttcatgtttgctttttcattctgttttttctgaaccgtttgagggtagattaaatgcatcaattctttactagttggtgtttcctaaggataaagatactctcttacatagtcatgctgatttcagatcctttggagatacacccagtagtggaattgctggatcatatggtagttctatttttaactttccgaggaacctccatactgttttctgtaatagctgtactaattcacactcccaccagcagtgtacaagggtttccttttctccacatcctcgccagtattcgttacctttcctctttttgataatagccattccaacagatgtgaagtgatatctcattgtggtttaatttgcatttatttccctgatgattagggatgcttagcattttttccatttgtatgtcttttgagaaatgtctattcaggtcctttgcccatttattaattgggttatttgctttcttgctattgagtcatttgagatttgagttccttacatattttggatattaaccacttatcagatgtctgatttgcaaatatattctcgcattctataggttatatcttcactttgttgattaattcctttgctgtgcagaaacttcttttgttgttgtttgttttttgagacggaatgtcactctctcacccaggctgaagtgtagtggtgcaatcttggctcactgcaacctctgcctcccgttttcaagcgattctcctgcctcagcctcccaagtagctgagattacaggcatgtaccaccatgcccagaatttttttttttttttttgtattttttagtagagatggggttttgccgtattgaccaggctggtctcgaactcctggcctcaagtgatccaccccacctcagcctaccaaagtgctgagagaaacttcttagtttgatgtaaatgcatgtatttttgttagatattgccaaatttccctctctggcaattgtatcgtttatccttttccaccaatctgatgagtgagaaattatttcagtgtaattttactttttatttctgtcattaagagtgaagtcaaaccaggggtggtggcttctggctgtaatcgcagcactttggaggctgaggtgggaggtttgcttaagcctaggagtttaagaccagcctgggcaacatatggagatcctgtctttacataaatttttttcaaaaagattagccaggtatggtggtggtgtactcctgtagtcctagctactcagaaggctgaagtgggaggattgcttgagcttgagaggtagaggctgcagtgagccatgattgtgtcactgcactccagcctgggtgacagagtgagaccctgtctctccccaccgccacaaaagaaagttcctaaaaaaaaaacatatatatatatataaaacatatttttatatgtttaagggacttgtttgtttgtttgagatagagtcttgctctgtcgccaggctggagtgcagtggtgcagtctcggctcactgcaacctgggtggagtgattctcctgcctcagcctcccaagtagctggaattgcagacgtgagccaccacgcccagccttaagggacattttaaatttttttttttggcaaattgttaatggctttttgtagattttggagttttgggttttttttttttttcagttttgaaaagttttcttttagctttctgatatctttcacagatactctgtttgccatttgtctattgctcttagtgttttggccatgcaaaagtttgtttttatttagtcatataaaaagatttatagtcttattacatctagagcttgagtcatagttagaaatcccttctctacactcaggttatagaggaattcacccagaagcattttgtacagcaagcatttatttgtgtaaccctgagttaaatagccacctaattaattttgatgggatggctttggagccaggatagtaatagaaattaataaaaatagcaattgactcataacaagctataaacctggtagaagatgatcagaaatcgaatctagccttcataattatggtaaattctcatgatagggattagggagatgattttgttctttgatgttcattcacagcaaaattgtatttaaaagtacatgccagctgggcgcggtggctcacgcctgtaatcccagcactttgggaggctgaggccggtgaatcacgaggccggcgaatcacgaggtcaggagttcaagaccagtctggccaaaatggtgaaaccccgtctctactaaaaatacaaaaaattagctgggtgtggtgacgggtgcctgtaatcccagctactcgggaggctgaggcaggagaatggcgtgaacctgggaggcggaggttgcagtgagccgagatcgcaccactgctctccagcctgggtgacagagtgagactctgtattaaaaaataaaaaaagaaaagtacatgcctgttgctgattagagcttcgacgtacctaaagtgcggagtcagattcagtaccttctccacagagtttgcattgcaaagtggaacaactcaaattttgttttgtgtgttctgcatgttgaaaatgtacatgtaaatgcttgtgagtacttatcacatgaatctgtatttcaactgcttagtttatgcgacattcactgggcttgctatggcaattaaatacaaaagcaatgctttgttagagttgcagtagctttagccattgagaacctggaagccaggttgaaaaaggccaaaatgggtgcaaatcagctcccaaactttactgtgagaattattcctcagaccctcgctcagattctgttacttttactacatatgcagtctttttagattggattttctgatctcatagatatcagaatagagggtactgctgtcagtagatagcagggtactgtatcagaaaagagggtactgctataagaagcatacacatcagtctagccaaaaataacagcagacagcctctaagcaaaggaacaaaaaagaaaactacaaaagataaatgaaaaattaaaaagcaggaattctggattaaagtagaatagggctaattatagtaaacaaccacatcttagtggctttagggaagcatgtgataaaatagtttgtaatgtaaatcttggtcattattagaagtctcagttatattcacaaaaaagtgtattatatacttttagaagtattttattttcatcaaaattatgaaaagattttatatgtaaagaggggtcgttacttcacagtagtaataacagcaaatattcagccctgtgatttacatgtggaattttatttaattctcccagcaaccccgaggctgacataagtaacagtaaccctgagataccattttcctaacctaaaactccaaatgaataaccattgtgcctttctagatctgaattctacaaacacattgtgctttctggagggtctactatgtatcctggcctgccatcacggttggaacgagaacttaaacagctttacttagaacgagttttgaagggtgatgtggaaaaactttctgtaagtattagtaaatcaactattactaacattcttttaaaaggctatacagtagtttgtgaatcttgacaaccaccagagggagcaagacgtcttccaaaacaaattcctactgcagtcaagtgcatcctggaaatgatagcaagaaggaaatagttcaagataagctctggtcacctctatagagttggtggatggaggcagtgaggtcagggccaaaagttctggttcatctgtaacaaccagcacggactctgaggcacctgtatatgcatgagaagaacctgctgtactatagggaaataaatgccccacttgagttttgttctttttttaaacttattttttggatatgcaatcagccttcagcacttctcttgggctatctcatatttctgactttatttgttgcatatgttgtcttctcagtcagattgaaaaacatcatgtctcaaaattttttgcattccggtgactgtcataactcttgaaacagactttaattggttgttgttggtatgtacagtagaaagaaatttttaaactagaaatagttgatgtttctttggcataggtttttgtgttttttccaccagactctggactatgtgaagtatacagtatgtgctgtatacttaaccaagagttatctaatcctgagttaatctctgagctttgtctcactgactttgatcaactgttttagataatgagattatgtattacagagtactgtatgttacatctttcatatatgactcattgttgaaattaaattgagtatgggctcacatacattaaacagattaacagactggaaaggagccatactgtctaagtacttcacttatttttctgattttattgagttttacatataatttataattaatctcaggtgatcatttattcagcaaacatttcttgaactcctgggtgccagacataggtctaggtgccggggacaaacaaaacaatgaaaacagaatccctgcttttagtctaaataatgtattagtggtaataagtgatatgaagaaaagtaaggtgaagagctggaaaatgttagtggttggggaggtagtgtgctccttcataaactgtgatcaggaaaggccttttggatgaagtgacttttgatcagagacctaagttgagcgtgagaggagtgagccttgtgactgtctgggggaagaatcttccaggcaggaaaaatgcaaaagccccaggttggtgggagtgtgccagtgtggctggagcagagtgagcaagggaggggggcaggtgggatatgaggtcagaagggtagcaggagggcaggtcttgttcagccatggtaaagggtttggcttgactcctggtgaaatggaaagtcttgggtgtgggggcggtttaagcagagaaatgataggatctgatgtatatttttaaaggatcattaagtctggtgtggtgaatagactcttgggggaagagggaacaaaggtgggcatagagagaccagttaggaggcactgagaggaggggagggatggtagagttttagaatagaggaggaggttgaaatggttgttttggagaatggaagcgagaatagagaaatgtaataggattgccatgcagcaggaagggctcagttgaggttagtgatacattatagcaagatgttttgtttctttcctatcttgttcagctgcttgacagcaggtgcaatttgtctgtaggaatctgtagatgagttcagcaaggagggagtggtagatggaatgatctgatagaatgagtttcagtggggctatggagttttagggatgagcgagatagaagcagcaatgaagagcaataactcatattaccaaacctccagggttaaggtagtgtgtgagagagaaacagtaaagcagttgaggtatttacagaagcagtgtcttcaggggctagctaagtttcccttagagtagaggtggtcatctatagcccttatgccaaaactggtttgtttgttttttttaagttttattggaacacagccaagcccatttgtttacataatgttacctgttgtcacatattgtctgtgggcaccttctagctacatgtggggttgggtacttgtcacgcctacaaagcctcaagtatctggcccttcacaaaaaaagtttgctgacccctatgtaagagcaagaaagtaaaaggaacaattaaaacagtctcagaattggtaaataaactgatgtttttctttatcttggattgttagaacccttacagttcatttatgtgacataaatatacaaatgatttagaatgacatagttacattgggtcttttttgcagatcgtgatactgtaaatgaaaaacttgctatgtcattttaaggtttctctttcaggtgttgaccaaccataaagataaggatgtgtccttcctagacacttaatagtagctacagagtataaaacttttcccaattgcctttaattttggttactgtgttcattttctcataacatcctgatgatttgttttgaccatatttggccttgtttattttaagaacatttcatttgattttgagacaatagaaagtaagctttgcttaaaagaaaagaacttcagttttactctattgccctggactagaatcataacagtatgagaccttgaagaagtcatgcaagtcctcttttttttttttttttttttttttttttgagattgagtctctgggctcactgcaagctccacctcccaggtttacgccattctcctgcctcagcctcccgagtagctgggactacaggcacccactaccatgcccggctaatttttttgtatttttagtagagacggggtttcactgtgttagccaggatggtctcgatctcctgacctcgtgatccgcccgccttggcctcccaaagtgctgggattacacttgagccaccacacccagccatgcaagtcctcttatccagactttgcttgacagcaaagtgactttcccaagtggtcatctgccattggatgggaaatttgctctaattatgtcttggatgtttggtctctcagtagggtgttaagtcatgtaatttactgatcaaattaggacactcaagaatggaaagggtggtattaataatgatgggacaccacgtgtaaatcaggactgttccaagcatgctgggatggatgtgtggtctcctaaacatgagctttgggcaaattactaaatgtttctgtacctcaggtaccaaatcctaccgttctacttatattacaggactgttgcaagtttgagggagagcatatatttaaaaagccattttcataaagcagaaagcactgtgcacatgtaccatttcattatcctttctttctcctttagaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgtttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaagtcaatttgaattttgtcatttctttctaatagttatttcttgtttcattttcttgttaatgcaagatgaattgacagtttatgctagttgttaggtcaagttcatgtcagtgttctattattgacaaaacaactcattatttctggtatgattttataaatacataagaaaatagaatagcgatttatagctacatcagaggctgttttcttccaacaaactgttttgtctcccaaaagattaaggtggctttcacagaattagaaatgctaaagagacctgtatgtaacatgccccctttcaaggacatattagctcatctgcagacttttaggcatattatttttaacaaataaaagaaggatgaaaatacatttaactgaccttttcttgttttatactagccttgaggatgagggctggagagtagagagagtatttttgcctttccttcttcgtggacttgtatgtgcaaacctcattgcccgcttcagggccggagtcccagacagcgaacgtaagggttgtctctggtgttttatctagtttcttctgagttgcggaagaagaatatgataacagctatctccatatgtaatggaggaagaaaataccaggcactgcatagtgcctttgatggaatgaatgtctctcagtgcacttcatttttttcctccacccacaaactttgaccattatacaattgagtgagtttattaactgtattaattttagaaccatcaaagagggtagccaactaaagtgaaccagaaactcgaggattaatctaaactcgattttttctttcttttgagacggagtttcactcttgttgcccagctggagtgcaatggagcgatcttggctcaccgcagcctccacctcccgggttcaagcgattctcctgcctcagcct

SEQ ID NO: 13268 - DNA, 32066 bp, Human
  misc_feature (1)...(32066): n = A,T,C or G
gcctgccttagcctcccaagtagctgggattacaggagcgcaccactacgcctggctaatttttgtatttttagtagagacgggtttcacatgttggccaggctggtctcgaacttctggcctcaagtgatccaccacccccccttggcctcccaaagtgctgggattacaagtgtgagccactgtgcccggctgaaaagaatcaattttgtcatagtttggagaatttctccttttctctccatcccttgaatgcaatttattaccaaatctgtcttatttgttattgtctaatttgtcctttcatctggattcccattgccaccctgcgtggtaccaccttactcccagctcttctcatctcctgcttagagtaagagctctctaactagtagcagtgccccaggccaggcgcggtggctcacgcctgtaatcccagcactttgggaggctgaggcgggtagatcacgaggtcaggagttcgagaccagcctggccaacatggtgaaaccccgtctctactaaaaatacaaaaattagccaggcgtggaatcctagctactcgggaggctgaggcaggagaatcgcttgaacctgggaggcggaggttgcagtgagccaagatagcgccactgcactgcagcctgggcaacaagagcgaaactctgtcttaaaaaaaaaacaatagtaggcggggtgcggtggctcacgcctgtaatcccaacactttgggaggccgaggcgggcggatcacgaggtcaggagatggagaccatcctggctaacacggtgaaacctcgtctctactaaaaatacaaaaaattagccaggcgtggtggcgggcgcctgtagtcccagctactcgggaggctgaggcaggagaatggcgtgaacccgggaggcggagcttgtagcctgggcgacagagcgagactctgtctcaaaaacaaacaaaaaacaacaacacaacagtgccccagactctctccctccaatgtacactgcatacaaagactagacaaacgatgccaaaggttacaccaggacgacaatgaagtccaagtcactcatcttggcgcttctttttatcaagctagctagttaatattaccacttacaatcattctccgagtccagccagcttcctcagaaatcctccccaaatgcagttcacattcttccctcactcctccaaaccttataacattattcccttttcctgtggcataatgcaatccagaggcatcctctctgagagcctacatcctttcaatcctccaagaaacagctcctcctcccatccttgagcttttcccacccagaataggctgtaccaaacatttctacattgtattaactcgaattatatcacagatcgaggtcttcgctttcagaaaagactcacattcttctcatataggcctcgcatggcctggccaagtacttcctaagctcggaacaaatactggtcaactttaattgaaccaaatcgggcggggtttgcggagtctgagagtgcaacgttggggagagggggatgaaaacactggaggacgggctgaaagcgtcgagtccgacacaaaagaggcgtcagacaaaacgccaagaggctggggactgggaacgaaggaagaggttctgccagaggcgacctgccacctgcgcgaggaagcggagtaggacggcggccgttggtgggcgtggtcgcgctagtctcgcgggagcggccgttgggcgggccgttgtccctgcgggcggggcgagttgctaaggaaatgactgcccgcagcgcctggccccgccgcgcaggccgggcggggttctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagccgccgccatgggtgcctacctctcccagcccaacacggtgaagtgctccggggacggggtcggcgccccgcgcctgccgctgccctacggcttctccgccatgcaaggctggcgcgtctccatggaggtgaggaggcaggggcccataggctggccgctgcggggcgggaatctgacggagaaagagagcgggggatggggtcctcccctgggaagggtcccaattgggagcctgcggccgcagcggccgtttgcggggcgacagagaccgcggggtcagggccgagagggagctcccgatgcttggggaccgtgtgccggtggccagtggcggcgagggctcggccatgtgggaagaggcaccttccgcccactgaccgccctctccccgagctttggcgccatcctctcgtgccaacctagccctccaggctcatcaacggtgtgaggtttagtgtgggagtaaagacgcaaataggggctatttattcatttgtttttcaagggagaggtgaatagatgtgaataactttttaaattttaatatttaaaatatctgatgtgggaagcctcttttggctaggagtttgacagtgaaaggaaccccgggcagagtctgtttcacattttggttgcctggccttgggctcttgcatgttaatttcagaggctggacccgacctccaggagttgtcactcatttgcactcttttcagggccttttactaacttcggaaaacttgaattatgtcagtccctaggttttcctttttattatgcttcgttttctttctctcttaggatttctctaaaacttaatcagtaattctcatttgcctgtaattgtagtttatagtttctttgattgtaagtcatttcatcaatttttttcatcacaacctacctacaaagggcttttctagaaaattttactctggacaaaaggggaaaagaaaaatattggggggaaagtagtagtattaggtaaaacttgatgtgaaactacaaaagagaagagggaaaactgcggtagggaggaaagggaggaagacgggttaaccgtggctttgtgaagagcattctgaagtctaggcaaaagggccagggaaatactctgtctggtattgagggtttctccacctaccgggtgggcttcaggtaacagcgaaatactgtctcccttgggaattgtttcagatccctcgctcctccctgtggttagctctggaatgacagtatgaacttaaatgttttgttttccgattcaaattttatattcataactgaccttaataacaattttataattaggtataaaatttcaggattggagtgtatcctatagttcatctcatctgctttggctccctttttttttttttgagacagaatttcgctcttgttgcccaggctggaatgcaatggcgcgatctcggctcaccgcaacctccgcctcccaggttcgagcaattctcctgcctcagcctccctagtagttgggatcacaggcatgtgccaccacgcctggcttattttgtatttttagtagagacagggtttcttcatgtgggtcaggctggtgttgaactcctgacttaggtgatctgcctgcctcggtctcccaaagtgctaccaccacaggcatgaaccaccacaccctgcggctcccacattttatagctaagaaattgaggcccagaaaggttaggacactgttttggtggaaagaatttgtaggatcagatcgttgaagacactagacattgttaatcatctagtcaaagtatgcaagcattcaattcaccaccaacacagtataaggggggggtctccagcaggacgggcgggtttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggattacagacatgagccactgcgcccagccttatttagaaatttctttagtgaaagatgataaattttcagtttttcattatctgaacatgtttttatctagcctttgttctgaaaagatgcttggactcagtacccagttctagattgacagttaatttttcttaatttgtaaatgttgtttcattgattgacttccattgttgttcggaaaaatttatcatcagccatttctgacttttgatctgtgttttctctttggtttctctttttttttttctttttttttttttgagacggagtgtcgctctgttgcccaggctggagtgcagtggcgtgatctcagctcactgcaacctctgcctcctgggttcatgccattctcctgcctcagcttcccgagtagctgggattacaggcgcctgccaccatgcccggctaattttttgtattttcaatagagacagggtttcactatgttggccgggttggtctccaactcctgacctcttaatccgcccgcctcggcctcccaaagtgctggcattacaggcgtgagccaccatgcctggcccatcagttgatgtagtcttaaggggacaagagtacatttaatatttggttgtgaggttctctggaagtgacaaaactgctttctatggagagttaggaattttttttttttttgaaacggagtctcgcattgtcacccgggctggagtgtagtggcttgatctcggctcactgaaacttccgcctcttgggttcaagtgattctcctgcctcagccttccaaatagctgggattacaggagtctgccaccaggccagctaatttttttttgtatttttagtggagacaggatttcactatgttggccaggctggtctcaagactcctgacgttgtgatccacctgcctcggcctcccaaagtgctgggattacagatgtgagctaccgtgcccggccaggaattttttgtgctataaatcatattttccttttattaaaggcagtgtcaatatctatagtataattttgaggaggctggctatttattgctgtgtagaagctggcttattagtggtcaaggggtcatctagaattgactataaagatagtattgagcagaaaattcttaaaatacctgcatatttgtttcagtcattaaattaatggaaaaaatataaaaagaaatatcacaagtatgctatggggttctaccttagggcattgaaggttgaaaaacatttattttcttatcttcagattagcatctcatatcaatagccaatagcttaaagcgctttttacttactaaaccaggtcagaatttctctctctctctcttttttttttttagacagagtctctgtcacccagtctagagtgcagtggtgtgatctcggctcactggcctttctgtttaagtgattctccggcctcagcctcctgagtagctgggattacaggcatgtgccacgacacttggcttattttttgtatttttagtagagatggggtttctctgtgttggtcaggcaggtcttgaactcctgacctcaggtgatctgcccgcctccgcctcccaaagtgctgggattacagacgtgagctactgcgcctggccagaatttctttgtctagaatgtggttagcaacttttataaaaacgcattatttgcatttgattagcatgcagtacccattcacagttcaaagctagtatagaattatatcacatgtatgcccatgagcatggagaaactattttctttttatttttttaagttggagttttgctcttgttgcccaggctggagtgcaatggtgccatctcggctcactgcagcttctgcctcctgggttctagcaatttgcctaccccagcctcccaagtagctgggattacaggcactcgccaccatgcccagctaacttttttgtatttttagtagagaaggggttttcccatgctggcgagtctggtcttgaacttctggcctcaagtgatctgcccgcctcagcctcccaaagtgctggaattacaggcatgagccactgtgcccggcctttttattttttaaattatttatgtatttattttgagacaggatctcactcttgcccatgcttgagtggtaaggagtatgggatttcttgtgccggttccttcacatcctcactacacttatctgcctttacagtggctcgatcatagttcactgcatagccttctgggctcaaggggtcttccagcctcagcctaatataggcacatgccaccatgactggctaattttttttttttaagtttttttttgtagagatagggccttgcagtgttgcccaggctgaggaattttatttatgtttattttatttatttatttatttatttatttatttatttatttatttatttattgagatggagtcttacactgtcacccaggctggagtgcagttgcgcggtctcagctactgcaagctccgcctcccgggttcatgccattctcctgcctcagcctcccgcgtagctggactacaggcgcccgccaccacgcctggctaattttttgtgtgtgtttttagtagaggcggggtttcaccatgttagccaggatggtctcgattcctgacctcgtgatccacccacatcggcctcccaaagtgctgggattacaggtgtgagccaccatgcctggtctagaaattattttatattttataccattgccttataagttctcaagcaactggaaaatacaatcagaacgtattcctcaagatttcaaggatattttacacaaagttctattgtctgattccttagcagttgttactactgtttccctaacctctaatcttctattgggttattagtcttagaattgaattttgagaggtaagggcttgaatttgaacatagaaatttatacaggtctgatcagtagttcttgacattgtattatctggaaacaaatctttagaactgagcttaagatgtttaatgacattttgtagacagagtatgatttcagtgtagttgtttttgtttctttctagatctagttcagagatgaagtatatcaacttttttttcctttttgacccaatgctagcagaaaaacaacaccttttaatcatatttagtatttgaaaatgtgtatacaggttcctttttattttatttatttcttacaggttcctttttaatcagctttattgagatagagttcatatactgtatggttcataccacatatggttcatataccatacagtatatgaactcactttaagagtataattcagtgggtttaagggtataattcattcattttaagggtataattcagtggcttttagtatattttcttttttttcttctttttttcttttttcgagacagggtcttgctctgttacccaggctggagtgcagtgacgcagcctcagctcactgcaacctccacctcccaggttcaagcgaattctcttgcctcagcatcctgagtagctggaactacaggctcacgccaccacacccagctaatttttatattttcagtagaaacagggtttcaccatgttgcccaggctggtctcgaactcctggcctcaagtgatctgcctgcctcagcctcccaaagtgctgggattacaggcatgagccaccgtgcctgcctgttttgtagtgtattcaaacagagttgtacaactgtcaccacaatcagttttagaaccccaaaaagaaaccctgtactctttaccagtcactccctatcttccgtccactaacccctggcatccactaatttacatgacctctatgaatttgcctattctgaacattttataaatggaattctaaatacactaccttttatatctggatgcttttactaagcatgtgtatttttgaaattgactttaaagcttgttggcccctggaagagtaaattactctccaccccaagtattccctctacccctcagctttgcctgtaagtttctttttaaaaaaatcacacatacattgttgtagtagatttaagaataagtattttgctgacccaaggttcttttgcttctttctagatcagtgccttgcaggttttattttacagagcttaatagaatcagaaatctctttaaaactccagtctcatatccagttatcactcaccatctctgtgtttgcagcaatagccaggcctggcccagagggacttgatctccacttttggtttttagacttttctgtggcttttaccacctgctgtgtatccttgacctcatactgctggactcctttggatggataccagcaggatggttcaggctccagtgggcactttttaaaattctctccttctgttcagatagacagagctcaggcagatcaccaagtctgttgcctgtgtaaccaggaaagagatgctagttttcttttaggcactcccatttgtttctgttggaaccttcctcacttagttgatggaagggaagcaaaagacccagaactccatctcaaattaatgacttaacaattcttgaattttctcttatctcctagttaactctttttcttatctccaggaggtcagttttaattattgttgtttattcatttattttcatggagacagggtcttactgtgttgtccaggctggccttgaacccctggcctcaaggaatcttttcacctcagcctcccaaagtgctggaattacaggcatgagtcaccacacccagcctgatatttttcagttgatgtatcatagttgtgcctaagcataattttttaattttaattttttatttttggggacagggtctccctctgtcgcccaggctggagtgcagtgatgcgatctcagctcactgcaacctccaccttctgggttaaagcgattctcctgcctcagcctcccgagtagctgggactacaggtacccaccatcacacccggctaaattttttgtgtgtattttagtagagacgagatttcgctgtgttgcccagggcggtctcgaactcctgagctcaggcaatccgcctgcctcggcctcccaaagtgctgggattacaggcatgaaccaccacgcccggccaagcgtaatatttttaagggtcatcaatgttgtgtcatgaatcaatcagtgtttcgttcttttttatggttgaataatattccatggtatggatttgtcacattttgtttatccattcattagttgatagacattttggatttccactttttttttttttttttgctattataaatagtgatactatgtacaaatttttgtgtggaaatatgtcctcatatctcttggttatataccaaagagtggaagtgctgggtcatatggtaactacgtgtttaacattttgagaaactgctaaactgttttccaaagttgctgtaccgtcgtacattcctgccagcaatatatgaggatgccagttccttcacatgttcactacacttatccaccttttttataataactaatggtgggtgtgagatggtatctcattgtagttttgatttgtatttctctgatggctaaatggctaatgatgtttgaactttttgtttgagacagaatctcactctgtccagattcaagcgattctcctgcctcagcctccctagcagctgggattacaggcacatgccaccacacccagctaattttttgtatttctagtagagacagggcattaccatgttgttcaggctggtgtcgaactcctgacctcaaaggatccgcctccctgggcctcccaaagtgctggattacaggctagagccaccatgccaggccttatgtttgaacatcttttatgtgcttattggacatttgtgtatcttctttggagaaatgtctgttcaaagtctttgtccatttttaattggattgtctttttgtcttttgatgtgtaagagttctttatgtgttttggatacaagtttgttagatatatgatttgcaaatcttttctccaatttttgtggacttttgctttctttttttgttttgtttttgttgttgttgttgttgttgttgttttggtcgggggacagtcttgctctgaccacccaggctggaatggagtggcgcgatcttggttcactgcaacctctgcctcctgagttcaagctatcctgcttcagcctcccgagtagctgggacccaggtgtgtgccaccactcccagctaattttttatttttagtagagaccgggtttcaccatgttggccaggctggtcttgaactactgacctcaggtgatctgcctgcctcagcctcccaaagtgctgggattacagtcatgagccactacaccctgattctttttgctggctttctttctttttttttctttttttttttgagacggagtctcgctctgttgccaggctggagtgcagtggcatgatctcggctcactgcaacctctgcctcccgggttcaagccattctcctgcctcagcctcccgagtagctaggactataggcacatgccaccatgcgcagctaatttttgtatttttagtagagacggggtttcaccatgttggccaggatagtctcgatctcttgacctcgtgatccgtccgcctgggcctcccaaagtgctaggattacagacgtgagccaccacactcagcctctttttgctttcttgatggtgtcttttgaaacaaaagtttttacttttgataaagtccaatttgtctattttgtttgtttgtttttgttaagaagctttgcctaacccaaagtcacgagaattttctcttaggttttcttctaagagttttatagttttagctgtttctgtgatccattttgagtgaatttttgtgaatggtatgagggagtgatccaacttcattcttttgtgtgtggatatcaagttgtcccagcactatttgtttaaaccactgttcttttcccccattgaattatcttggcatcattgtcagagataaattgaccgtaaatgtgagggttttatttctgaactctcaagtccatttcattggtctacatgtccctatgccagtaatacactatcttggttactgtagctttttagtacgttttgaaatgtttttaaaatttgtttttcatctaaattttaggattaatttgtcaatttctgcacaaaaggcacctgggtttctataggggttatgcagaatctgtagatcaactgggggagtattacaggcatgagccaccgtgcctggctgactgagtttttcatagatgtactctatcaggtttaggaagttcccttttattcctaggttgttgagtctattttatattacttttttagagacagtcttgctctgtccctcaggctgtagcacagtggctcaatcatagctcactgcagccttgaactcctaggttcaagagatccgcctgcctcagccttcttagtagctgggattacatgcatgcaccaccatactgggctaattttttaaaattttttatagagacagggtcttattactatgttgcccagactggcattgagtctttttatcattaatgagcactgaattttgtcaagtgcctttataatacctattgtgatgatcatagggttttgttctttagtctaccgatacgctatattgcattaagtgatttttttgaatgttaaaccaaccttgcatttttttggtgtataagtcttatttgatcaatgtgtattatccttttatatggtgctggatttagtttgctactattttgttgaggatttttgtgtctatattcataagagatattggtctgtagtttcttgtgatgtctttgtctggttttagaatcagggtaatgctggcctcatagaatgaattgggaagtgttgtcttcttttctatgtgatgggagagtttgtgaatcattggtattaatttttctgtaaatgtttggtagaattcacaaataaaggcatctgagcctgggctcttctttgtgggaagtttttggctttttttttctttaaaaattttcattgtggctgggcatggtggctcacgcctgtaatcccagcactttggggggccaagacgggtgaatcacctgaggtcgggagtttgagaccagcctgagcaacgtggagaaaccccatctctactaaaaatacaaaattagctgggcatgatggtgcatgcatgtaatctcagctaattggaaggctgaggagggagaatcacttgaaccacggaggcagaggttgcagtgagcctagatcgtgccattgtactccagcctgggcaacaagagcaaaactctgtttcaagggaaacaaagttttcataacataaaaattaccatcttagtcatttcttttctttttttttttttgttggagacggagtcttgctctgtcacctatgctggagtgcaatgattgcagtcttggctcactgcaacctctgccacctgggctcaagagattctcctgcctcagcctcctgagtagctgggattacaggcatgcgccaccatgcccagttaatttttgtatttttagtagagacggggtttctccatgttgaccaggctggtctctaactcctcacctcaagtgatccgcccgcctcggcctcccaaagtgctgggattacaggcatgagccaccacgcccggccttaaaaatttttttaatgtacagttgagtagtatttaatacattcacattgttgtgtacccagtttccagaactcttcatcctacagaactgaaactccatacccattaaatgagtccccattctctttcccccagctcatggcaaacagcattctattttcagtctctatgaatttgattagtttagatacttcatactgtaagtggaatcatatggtatttgtcttttagtgactgcctaatttaaaaaaaatttttttgagacggagtcctgctctgtcgcccaggctggagtgcagtggcaccatctctgctcactgcaacctccacctcccaggttcaagtgattgtcctgcctcggcctcccacgtagctgggattacaggtgctcgccacaacacccggctaatttttgtatttttaggtagagactgggtttcaccatgttggccaggctggtctcgaactcctgacctcaaattatccacctgccttggcctcccaaagtgctgggattacaggcgtgagccactgtgcccagcctccatgttgtttttcacaacacctgtatcatttacatttccaccaacagtacacaagaatttcagtttctccacatccttgctagcagttgttattatctgtttttttttaatggtttcttttttcctttttctttttttttttttttgagacggtcttattcttgctcatgctggagtgcagtggtgcaatgtgatagctcactgcagcctcaacctctgggctcaagcagtcctgccacctcagcctccacataggtgggactgcaggtgtgcaccaccacttgtggctaatttaaaaaattttttcgtagagacagagtctcacagtgttacccaggctggtcttgaacttctgagcacaagtgatcctcccacctcagcctcccaaaataatgagattagagacatgagccaacatgcccaaccagttttgtttgtttgttttgttttgtgtttttgagacagagtctcactctattgcccaggctggagtgcagcggcatgatctcagctcactgcaacctccgcctcccaggttcaagtgattctcatgccccagcctcctgagaagctgggattacaggtgtaccaccacacccagttatttttgtatttttagtagacatggggttttgccatgttggccaggctggtcccgaactcctgacctcaagtgatctgctcccctcagcctcccaaggtgctagaattaagtttttctttctttctttctttctttttttttttttttttgagacagagtctcactctgtcacccaggcaggagtgcaatggcacggtcttggctcattgtaacctctgcctcccagattcaagtagtgattctcctgtctcagcctcccaagtagctgggattacaggcatgcaccaccacgcccagctaattttttgtatttttagtagaaacggggtttcaccatgttggtcaggctgatctcaaactcctgaccccaagtgatccacccgccttggcctcccaaagtgttgggattacaggcgtgagccactgtgcctggttttatttttattattattatttttaatagttcctattctaatgggtatgaggtagtgaggtgggtggttgtggtgtttttatgaatgtttaattggaaatgggtggccattgtgtgcaggaaaaacctcctaaattgtgtcaaactcctggaaaatgaaatatcattccagttgcaagaatatctttttttttttttttttttttttaagacagagtctcactctgtcaccaggcgggagtgcagtggcacgatctcggctcactgcaacctccgcctcctggtccgcctcccgggttcaagtgattcttctgccttagcctcccaagtagctgggactacaggcgcgtgccaccactcctggctaatttttttgtatttttagtagagatggggtttcaccatgttggccaggatggtctcaatctcttgacctagagatccgcctgcctcggcctcccaaagtggtgggattacaggggggtcaccgtgcccagccacaagaagatcttgagcatgtgaatgatcagaaatgatttagcctatgtaggcactaggccaggtagtgaaattcagggaaaataattcagatgcttctgagctatcacttatgaactaagaaacagcttaaagccattatagtgtgtttcctgaagatgaaagcatatggtaagatgaaatagtgattattttttaaaaattactactccagaaaggaaaagtttactaatttttattactaaagtttactgttggtgggtgcggtggctcacacctgtaatcccagcactttgggaggccgaggcaggcggatcacctgaggtcaggagttcgagaccagcctgaccaatatggtgaaaccccatctctgctaaaaataaaaaattaggccgggcgcggtggctcatgcctgtaatcccagcactttgggaggccgaggcaggtggatcacgaggtcaggagattgagaccatcctggctaacacggtgaaaccccgtctctgctaaaaatacaaaaatcagccgggcgtcttggcaggcacctgtagtcccaggtactcaggagttttgagacgggagaatggcgtgaacccggaaggcggagcttgaagtgagccgagattgcgccgcttcagtccagcctggacgacagagtgagactctgtctctaaaaaaataaataaataaaaataaaaaattagctgggtgtggtggcacgcacctgtactcccagctactcgggaggctgaggcaggagaattgcttgaacccgggagatggaggttgcggggagccaagattgcgccactgcactccagcctggcgacagagtgagactctttctcagaaaaaaatatgataattaaaagttgagacgttcttcgccgagagtggtcggggtttcctgcttcaacagtgcttggacggaacccggcgctcgtcctgcaccccggccggccgcccatagccagccctccgtcacctcttcaccatgccctcggactgccccaaggcccccgccgcagctccagcgccgcgtagccaccactgccgctgccgccgcctctccttagtcgccggcatgacgaccgcgtctacctcgcaggtgcgccagaactaccaccaagactcagaggccgccatcaaccgccagatcaacctggagctctacgcctcctccatttacctgtgcgtggcttactactttgacagcgatgatgtggctttgaagaactttgccaaatactttcttcaccaatctcatgaggagagggaacatgctgagaaattgatgaagctgtagaaccaacgaggtggccgaatcttccttcaggatatcaagaaaccagactgtgcggggagaatgcgatgggagagcgggctgaatgcgatggattacatttggaaaaaattgtgcattttgcattacatttggaaaaaaatgtgaatcagtcactactggaactgcacaaactggccactgacaaaaatgacccccatttgtgtgacttcattgagacacattacctgaatgaacaagtgaaggccatcaaagaattgggtgaccacgtgaccaacatgcacgagatgggagcgcccgaatctggcgtggcagaatacctctttgacaagcacaccctgggagacagtgataatgaaagctaagcctcaggctaatttccccatagccatagggtgacttaccttgtcaccaaggcagcgcatgtatgttggggtttcctttaccttttctataagttgttccaagacacccacttaagttctttgatttgtaccattccttcaaataaataaatttggtaccctccccccccccaaaaaaaaaatgtactgtgggctggcgtagtggctcatgcctaaatctcagcactttgggaggctgaggcgggaggatcacctgaggtcgggagtttgagaccagcctgggcaacatggtgaaaccccgtgtctactaaaaatataaaaactagccagtcatggtggcacacacctgtaatcccggctacttgggaggctgaggcatgagaatcacttgaacctgggctgcggaggttgtagtaagctgagatcatgccactgtactccagcctgggtgacagggagacattctctctctcaaaaaaaaaaaaaaaaaaaaaaaaacaaaacaaaccaacaaaacaaagtaatccaggaacaacaacatgatgaaggactgcatgcaggactcagtgatggatggtggaagacagccaggaagttaagcatgactctggtattaagtgttgtctgggagagttaagattccatttacagaaataagacctgtaggggaagctcttgatttttttttttttgcagactgctgatttcctgattacatgtgttaagtttgaggtatagagagaaagaacatcctggccgggtgcagtggctcacacccgtaatcccagcactttgggaggccaaggtgggcagatcacgaggtccaggagatcgagaccatcctggccaacatggtgaaaccccgtctctactaaaaatacaaaaattagctgggcgtggcggcgcgtgcctgttatcccagctactcaggaggctgaggcaggagaattgcttgaacccgagaggcagaggttgtgatgagccgagatcgcgccactgcactccaccctggcaacagagctagactctgtctcaaaaaaaaaaaaaagaaagaaaaaaagaacatcctgtagaaacaggcagtcagaggtatagaactacacagaatccaagagatctttcaagaaaagtgacatgcagcaagagaaactatcaagggggtaaacaacctatagaatgggagaaaatattcacaaagtatacatccaacaaaagtctaatatccaaaatctataaggaacctaacaagcaaaaagcaaataacccccttaaaaagtgggcaaaggacatgaacagatacttctcaaaagacgtacatgtggcccacaaacatgaaaaaacgcccatttctaatcatcagacaaatgcaaattagaaccacaaagagataccatctcacaccagtcagaacagcttttgttaaaatgtcaaaaaatgagaaacgttggtgaggctgcagaggaaagcagacacttgtacactgttggtgaaggtgtaaattaatttagcgtaggcacagtcagtttggagatttctcagagaactaagagtggaactaccattagacccagcaatctgatggctggatatacggccaaaggaaaataaatcattctgccaaaagaacatatgtacctgtatgttcattgtggcaccattcacaatagcaaaaacattgaatcaactcatgtgcccatcagtggcggactagaaaagaaaagaaaatatggtacatagccatcatggaatactatgcacccattaaaaataatgaaataatgtctttgcaacaacatgaatgtagctggagggcattatcctaagcaaactaacacagaaacagaaaaccaaatactgcgtgttctcacgcagtgagagtgggagctgaacatcaagtacacatggatgtaaagatggcaacaatagacatgggtctactagaggtggtggtgcggcagggtgggggtgggggttgtgtggcagaggaacagctgaaaaactacctatttgatactatacccagcacctgggaaacgggttcagtcataccccaaacctcagcatcacacagtatacctttctaacaaacttacacatgtattctgtgattctaaaataaacattgaaaaataaaaaaaaaactgacatggtttgtactgtttaatctgacataatggctaggggaaatgaagtctgcagaatggctgtttacggatgttgttgttgttgttgagatgaggtctcactatgttgcccaggcttgaactcctggcctcaagcagtcctcctgccttgacctcccaaaatgttgagattacatgcatgagccattgccaaaacggctatttggattgctgttaaggttattacattctctgtgtagtaagaccttgaaggagaaggatttgagatcaggagtttaagaaaaaatgttaatctaggaagagaggataatttctgtgtttggccagttgcaatggctcacgcctgtaatcccagcgttttgggaggccgagctgggcagatcacttgagctcaggagtttgagaagagcctgggcaacatggtgaagccccgtctctactgaaaatacaaaaattggctgggcgtggtggcaggtgcccactgtaatttcagccactcaggagactgaggcaggagaattgcttgaacctggaaagtggaggatatggtgagcctagatcgcgccactctactccagcctgggagactccatctcaaaaaaaaaagaaaacaagatgctgaaatgaagtaattaccacagtcaatgtgatcctataactttgttttcttttagagatggggtctccctctgtcacccaggctggagtgcagtggtgcatcatagctttctgcagcctccacctcctgggctcaggtggtcctcttgcctcagtgttccgagtagttaggactgactgcaggtgcatgctgctatgcctggctaactttaaaatttttttgtagaggcggggtcttgctatgttgcctaggctggtctccaactcctgatctcaatcagtcctcctgcctaccttcccagagcgctgggattacaggtgtgagccatcgcacctagccaatctcataacattttatgactagcaaacttagtagttctgattcaggcataaatcagttggtggggttatacaaggttgggtgagtttttctagatttctaagagaccatgttgaaatacttggctctgtctcagtaagggatagagagaagcaaaggtgtgggtaaaggttatgagcagacatgtaaagggggcaaattaaagtgtttagggaaggtgaaacagttccaaatcataatatagatcccaagcctcaccaagaagtgaaggagagggtaattgtgcgatagttctcaggactgagacctcaaggtgtaagacgaatctttattgtgggtggtcctctttgagaaaaagaacaaaaaagaaaaatgtgaaatgggtgctaaatttcagagcagaatatacatatatgtgtatgtgtgtgtgtatatatatatatatttttatgtagcaaattccagtttacaaagggcttttatgtgttttgcatcattacaacagttctgtgatgatgtggatgtggtggatattgtaattccacatcacagaggataaaattgaggcacaccataaggtagctgaccagagatcatgcagtatatggtagaatggcaacttgaggccagttcttaggtgtgtttgttgtccttattcagaatggaacaatgtggtttattgtacaaaaatttaaaaatgaatgtcgaaaagtagaaattattacccaaatctcaccctctgtggttgtttgctatgtgatcttccagactcacatatacatgtagataattttttttttttttttttgagacggagtcttgctctgtcgccctggctggagtgcagtggcgcaatctcggctcactgcaggctctgcctcctgggttcacgccattctcctgcctcagcctcccaagtagctgggactacaggcgcccaccatcacctccagctaattttttgtatttttagtagagacggggtttcaccatgttagccaggatggtctcgatctcctgacctcatgatccgcctgcctgggcctcccaaagtgctgggattacaggagtgagccactgtggccgtcctcacatgtagatacttttttaactttttgcttttaaccacttaagatattgtgaactcatttccaaattaacatatatttgcttttaacagctacatttccactggagttacgtaccatttgtaatctattcctggaaatttagatggttacaactgttttttattttatttatttatttatttagagacggagtctgactctgtcacccaggctggagcgcagtggtgtgatacttggctcactgcaacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgggagaccgaggcgggtggatcccgaggatcaggagatcgagaccattctggctaacaaggtgaaaccccgtctctactaaaaatacaaaaaattagccgggtgtggtggtgggtgcctgtagtcccagctacttgggaggctgaggcaggagaatggcgtgaacctgggaggcgaagcttgcagtgagcagagatcgcaccactgccctccaggctgggcgacagagcgagactccgtctcaaaaaataataataaataaataaataaataaagctgtgtacagcctggccaacactttgggaggccgaggcaggcagatcacaaggtcaggagttcgagaccagcctgaccaacatggtgaaaccccatctctactaaaaatacaaaagttagccgggcatggtggcacatgcctgtaatctcagctattcagcaggcggaggcaggagaatcgcttgaacccacgaggcggaggttgcagtgagccaagatcgcgccactgcactccagcttgggtgacagggcgagactctgtctcaaaaaaaaaaagaagaaaaaatcctttattctggttttcccgtagcttccacagatccaaaagggtcaggtttatttccagtagccaaatattctgccatctggactgagatatctcctaggttgaggttattatagaggtagtaacctgattctttcttccttttctccttcccctttcctcctttgcctccctcctcttttcttcctctgtatttattttatcattccttcttcctttcttatttctaggccatataggccagccagggaaaggttagtaaggggtgacattgatccctatgacctgaggaatattcttcgaccttgagacatgccgattatgctcttcttttcctaggatgctcacaactgtattcctgagctggacagtgagacagccatgttttctgtctacgatggacatggaggtaactttaacagatcatattggtaacattctaggaccccaattccagacgttccagggcaagaacaggtccctttgttcatttactttccagggtctggccctcattatcatttcctgcgtggtgctgtttttctgtattctgtcattcttttttcccagtaggtactgtattggtttataatctcaccaggacttgttttaatccaaagagcctctatctttttttatttttattttttaaaatttttaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaagtgtacccagttgagctgattctttatctttttttcactggagaactaagtatacaggtgagaaaagacgagatatttatacccgagagaattgatggtgaaatccatttttttggatcagaacttccccaaacagtgtccttcaaatagggttcaggggtgctaagatatttatcccctcaacccttggggttcactccagtatggcatataaatattgtatcactttctatgtgtggggagcagtgctccaggtgaccttccttcctttccttctaggggaggaagttgccttgtactgtgccaaatatcttcctgatatcatcaaagatcagaaggcctacaaggaaggcaagctacagaaggtctgtctgcttacaccgcccattcctcacttgtgtaggcttttcccttgttctctagcccttgggcttttcctttctttttgtcctctagctgctgctgcttatttactcttgaagaattctgttcctaaaacgagcttattggccgccttttagacttgccttattattcctaggcctctgagctgtttttatctgtgagtgtctcttagtgtggtggctcacactcttaatttgtattccatccttgtgctcaggattgtatatagggagttcattttgtactagtcttagactattttgcttatattcaggctttagaagatgccttcttggctattgacgccaaattgaccactgaagaagtcattaaagagctggcacagattgcagggcgacccactgaggatgaagatgaaaaagaaaaagtagctgatgaagatgatggtgagtgtggcatcccttgtttgaggggaaatcagcattttaagaaatattctttaatattacttatcaattctaagataggatggctttctagggacctggggagtccttatgttaaagaaacctatgatgttctcctgcattgtatgtggttatgaaaaggagggagagaattatcttcgttgagtggcatctgagctgtaagcattgtatatacattatcttttgtcattgtgatggggtcttcctggttcctgctagtatttatgtgcttttttttcccctcaagactggagcagttattagccccaatagccaatcattaagcctaaatcctaattcacagtagcattgtgggcttcctggatcctcagccagaatagggtttttacaacttaacaataaaaaatgagacgtcagaggggaagtatagtaactagtgttgttttgattaagaaggggatgaaacacaaaaaccaaaagaagtctgtggaggaggaggagctagggcatgttcttctgagacttgagcgagaggaaccttgggagtgggaggttgtggggaagttagaggctgcaagggctgttgaggtagtgagagggacggatcccatgaggagtctggcatgggggctctgatttagcctcttccctgcagtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggtaagggcctgtgagggcaggcagatgctgaagttgcagagaggtcctgtttggttgccgtctgtagttttcaactctctttccttctcctattttgacatcatcccccaagacccactgtattctaagctttagtcttgaattcattgagctccatcatcacaggtaccatttgcctttttacctcttcctttgttggtactataacaagcagatctagttctggcttttcagagtctgtctcctagagagagaacaaggagatagttgttaccttggctagttgactgttttcttctctggaaaatttattttctggccacagtgcctgaaagatatttttggctggcagcccttgccttgtcctgggctttttgctagtgactgctaagcccagttcaggatgtcagttgtactcatgctagccctttccatccccccaattttcatgaccatatacttgtatctttcagtgttttgaggacctgtgttcagtcaggacctcttgattctgagtatgagctgtggggagggaggggatcatcccagtctcagcagtctgggatcctccccctggcaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggaggtgtgtggggaaggggagcaatgagtcttgaaaagccacaaggcaggtgtgaatcccctaattttgattttgagacaggggatccccctgatactttaggatggaagtaatagtcatggggatttattctgcaaggggaatgagatggtaagcctttggggttgaattatctaaaaacaagggagagggagtgtgctgctgtctctagaaagatgaaatgtgtgcttctcctgtttgttaaagctcttttgggggtcccagtgaaagcaagcataggtgaacgatcaggagcacatcagtgaggaacgcatgttcagaagcccccatgatgctccttttcttcctcttaagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggtaagggccaagaaactgggaaagacttctagggtctttctctctgtcccagactacctagtagcaaactttaatcttcctagtgcttgtgcctttcaaagcactttaatatctactacctctgttcttatattcctgtgaaataactaagatgggtagaggtatcattatacataggtatcattatacccatcttatgtaacatttgaatgatgaaaaagacctgtgagtgccgggcgtggtggctcatgcctgtaatcccagcactttgggaggctgaggctggtggatcgcctgaggtcaggagttcgaggccagcctggccaacatggtgaaaccccatctctactaaaaaaaaaaaaaaatacaaaaattagctgggcatggtagtgcaagcctgtaatcccagctactcaggaggctgaggcaggagaaccgcttgaatccgggaggcggaggttgtagtgagccgagatcgtgccattacactccagcctgggctacaagagtgaaactccgtctcaaaaaaaaaaaaacaaaaaagacttaaaataaaaagaccagtgagtgactttcttaaggttcagcagtctggtggcagggttgaaactagaaaaactaggacttaggactcagttccccattccactagattatggaactttgtaaagaagggaaatgaatggcaaggtttgacctgccacaaacacaagtctgtgggaagtatccaaactgctcatcaaccattcctttactccaggggaccacttctataagagaaacaagaacctgccacctgaggaacagatgatttcagcccttcctgacatcaaggtgctgactctcactgacgaccatgaattcatggtcattgcctgtgatggcatctggtgagcactggcagaatgccctaaattcccctttctgcagcatgtcttctcttataggactcagggcacctctaggattagagcctaggcagacctaggcctcttggtgggtgaagagcacccagactaaggcagagctgagaatttctgtagttatttacactggcctgggccaccacctctgtccatactcctctacgctgccttagtgagactggaagattctgactgttgttcttgaccccaggaatgtgatgagcagccaggaagttgtagatttcattcaatcaaagatcagccagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctgattggcttgctccccgcctcgtcacaatcacttcccggtcacgccattgaggctcccgcgcggccgcttcccacggactacgcgtcccgtgcgtctctgcggcggcggaagcggaagcgagtacggaggtaccagctggtctccgtaggggggtagggggctccatgaatggaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgcaggccggaggcgcgtcgggctggagccggtcacgatgccccgaaggaagcaaagccacccgcagcccgtgaaatgcgagggggtcaaaggtcaggggtcaggggccttgaggggagaggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggtgggttttcgggtcttggttaaggattagcggccgctggagaccccagcccttcaggaggcaggttaggtgaacagaacaccatttcctgccacaaccgagggctggtttagtttacatttgagctagatgacttcatttgtttaatggtccaatcacttccatcactttgttgaggtgaagttctgaggcctggtcaaaggtgataggaataggagggtgggtgaatcacatggagcaactgattaaaagtaaatgccctgtctctctccctagcccattccttatgtgtatttacttttaagagaggttcagggaagcaaactctctgtaaatcattcaacccagtatttaggtctaatctaactccctttcacctgcagcgtaagctccttttgtattgagaggttttagtttctgtctttatccttccatgtccctcttccctgtgatcttagcatcaccctaccctaatttgctgcactacccatccacttatgcaagatgttttttgaaagtcattgaggggatccatgtaaatatctgttctttaggcaggcaagtggtattacatgcattactttcattgtctccacttccctccaaattttgcctcagagataggttttattttatatcagctccttactaaaaggggccttagcaatagagcttagaaaaaggtcttgggggctctctccctttcgtatttttactttcttgtctcaagaattaatttcattatggattcatttcagtctgt

SEQ ID NO: 13269 - DNA, 26624 bp, Human
gtggatcacttgagcccgggaggtcaaggctgggtaatattttattttattttattttattttatttttttgagatggagttttgctcttgttgcccaggctggagtgcaatggcacaatctgggctccctgccacctccgcctcctggattcaagcgattctcctgcctcaggctcccaagtagctgggattacaggcgcccaccaccatgcccaggtagtattttgtatttttaccaaagacggggtttcaccatgttggccaggctggtctcgaactcctgacctcaagtgatgtgcccagctcggcctcccaaagtggtgggattacaggcatgagccactgcgcctggccaagattctttacggatgcaaaatttcctccacaaagaacagctttgcagggccatttcaaaatacggcaaagaaacatgttttggggtcaaatatttttattttcttctttgtctcgtaatgtcatttcgaagtgaggttgaaaagtaaatcgtgatatatagggttaaataaaacccatctgatgagaatttatgatttgtagggcatgactccccagaccccttagataggaatttgggcaaaataaaaaaatcaggccgggcgcggtggctcatgcctgtaatcccagcactttgggaggccgaggcgggtggatcacgaggtcaggagatcgacatcatcctggctaacaaggtgaaaccccgtctctactaaaaatacaataaattagccgggcgtggtggcgagtgcctgtagtcccggcggctactcgggagcctgaggcaggagaatggcgtgaacccgggaggcggagcttgcagtgagccgagattgcgccactgcactccagcctgggcgacagagcgagactccgtctcaaaaaaaaaaaaaaaaaaattcagtttagtcctcacgtcactacttactttttcaaatttgtccttgattatcaccaaaatgttggacgacaggagtatttctccctattctaagtctgtttttcccaaaaccagtgaaaatttgttaaccaaataactgtagtttgcagccaggtgatatctttccaagtgtcccaattgtttagttacagttcctaagcattaagtacttaaataagctaaggactatcctcactttatcttcaatttagacttacatcctggtttgaaatcaattccttgcaaactaaaggcagtgccataaataaaaatttttaaccttctaaaataaacatcagtgttagaaaataagtcaattgtattcactcaattgtatttgtttagaaataatcagatattatacttgtttcttgcacattcttgccttgtttcctcacctatgaaatggagataataatactatctacctaacaagattgacctaacatttttgttaatttctgggtgttagcattagtttcatttttttcactatttgtatttaaacgaagagatttttctttaaaacaaaaattaaaaagtgctggctattctaggagtaatattcattccaaataaacatacagtgatctttgaagtggtcaagcactagaaatttctgtagaaaattaatttttcattcatttggcatcgcataaatctaggttggaattggttcttcctctttggaaggtcagtccctgccctaagagagcggtatattaccacccacttcacaagactgttctaagaatcaaatgagaaaatgtgtttatgaagagtttaagaatttagagctccatgaatgataattacagtaatattgttcattaattcaaaaaacatttttaaggatccctcactactagggatgcataaaagttgctaaccctcggcctttacccagcgttagaagacaaaacagagggtaaaagtcccagaaacgcgttcgaaccaattcagctaggaattaaattctcagatcctttattacaccaccggagccttaaccttgaggcaagcagcaatttgttcatgcgcagttaacgctccctaaactgccacttgctcagctccgcgcctaaggtgtctattagtacgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagtgagtgattcggccctgggcgggtgggctggtcttctgccctgcccctgggtacagccctcggtgctctattcccgttccagtctgttgcgagttcaggtctattcaggattctggattacatcctaacgtgggcgagtttctgttgaacgtgattgcacgtatcaagatgtgtgctcttagatttgttttcaatccagataatttcagaaatacattgtttagtacctcaattggaagtctgaatttttttctgatttcacaatgaactgtggaagtggatcgcttgttttactacacctgagcaaagcacaacagaaatttaatttatcgcgtttattacttatttgtaggatcgaagcagctcaatgtccagatgttgtggtagctcaaattgacccaaagaagttgaaaaggaagcaaagtgtgaatatttctgtgagttttattaaccgtctggagattacccccaaccccccaattaaaagactaacgctcttcctatagtatctgacagcatcaattatgacgtaagatttgactactccgtgcaaagttagacattcgcttgtactttttccttcagaaagacaattggcatttactgcctctaaagaggctttctgtaactctagcctttgtggagtgttgcccatcttacttcaggacattatccagtcctttcaaaggagtctttaaatgggttacttatgttatcttttattttttgcttgtttgtttgtttatagagagggagtctctgttgccagctggtctggaactcctggcctcaagtgatcctccctcctctgccacccaaagcgttgggatcacaggcgtgagccacctcacctggcccctttattttttaaggaactttttccagttattggattggtgtttaatcttagtgtgctttgcatgttctgaatttgaccaagtttcactttttttaagaatagaaacccagatgtcttacactttttttttttttttttttttgagacagtttcactcttgttgcccaggctgcagtgcagtggtgcgatctcagctcactgcaacctctgccttccggtttcaagcgattaccgtgcctcagcctcccgagtagctgggattacaggcgcccaccaccacacccggctaatttttgtatttttagtagagacggggtttcaccatgttgtccagtctggtcttgaactcctgacctcgtgatgcgcccacctctgcctcccaaactgctgggattacaggtgtgagccaccatacccggccttacacttttatagctacttgcacactctggacattttcatttatttatttatccagcacatctttaattaagcaactaggttgtgccgggcattgggaattcaacagagggtaagacaaaaaaggttcctacccttgtagagtttacataccctcctgaggaagacagagagtaaacaagcaaacaaataattacatattgtgattattgctatgaagaaaataagcatgtataataatcaataaatgacagaactactgtagaggaatcatagaagggctctctttttcccccttttttttttgcgtctcaatttttcgcccaggctggagtgcagtggcacaatctcagctcatcacaacctctgcctctcaggttcaagagcttctcttgcctcagccccctgagtagctaggattacaggcgtgtgccaccacacctgactaatttttgtatttttagtagagacgtggttttaccatgttggccaggctggtctcaaactcctgacctgaagtgatctgcctgcctctgcctcctaaagtgctgggattacagatgtgagccaccacgcctggccagcaaaggtctctctaaggaggtgctatttaacctaagctcaaaggagggtggcattttattttatttctttttcttttttttttttttttgagatggagtctcagagtctcgctctgtcgcccaggctggagtgcagtggcgcgatctcggctcactgcaacctctgcctcccgggttcacaccattctcctgcctcagcctcccgagtagctgggactacaggcgcctgggagagtggcattttaaatagttgatagtaatttccttttcatgctcaaagtagtttctctaactgatacttgtaatcaggaaattttaattcagacactgtaatttttcctataattcctcttcagggttttttagttgatggacatttaatggaacagaatgtcttaatatacctaatttgatggattgattgattgattgattgagacagggtctcgctttgttgcacaggccagagtacagtgccacgatcatagctcactgcagcctcgagttcttgggctcaagccatcctcccacctcagtctccccagtagctgagatgacaagcatgtgccaccgtgcccagctaattgtattttttgtagcgacggggtcttgatatgttgctcaggctgtatgtgctcttttagaaaacagaagtatggctgggcttagtggctcacacctgtaatcccagcactttgggaggccaagtcaggcggatcacctgaggtggggagttcaagaccagcccgaccaacatggagaaaccccatctctactaaaaatacaaaattagccgggtgtggtggcacatgcctgtaatcccagctactcgggaggctgaggcaggagaattgcttgaacccgggagacggagattgcagtgagctgagatggccattgcactccagcctgagcaacaggagcgaaactccgtctcaaaaaaaaaaaaaaaagaaaacagaagtagacaatttaaagttaagcgtctttaagtacattttgcccataccaaagttcttatttttaattttattgatacataataatcataatttcatgctttatcacgcaggcacaataataattgtacatatttatggagtatatgtgatattttgatacatgcatacaatgtataataatcagtaattaggatagccatcacctcatttatcatttctttcttttgggaacattcaaatcttctagctgttttgaaatatacaataaattattgttaactgtagtcactctactgtgctattgaatgctagaactcattccttctaactgtatttcataccagaattctttatttgtggtatatctctctttttgtttctgttttgctattctagaaaggcaggtagggctagatcatattctccaggctcatgtcatttagatttcatagaaactccaactataaacctttccagatttctctgattaaggtgactaaggctctttccctaatatttttaactgagatataaataataaagtgaaatgcctacttttttacatctgcaaaaatattttattttcttgtataatctttattttattatacactttatcttggttttacttttgctttgcagaggcatgagattctagttttgacactaatgttgatcctaatatttgtgaacttgatctctagctttcaggatgccaacccgcccctgaaggttattccccaacacttcaatggcaacagcaacaagtggcacagttttcaactgttcgacaggtaagtgtcatatttaatctaattaagcccctgttggatttatttctgttcttagactgtagctggaaaaataaaatttatgatcctaaagtatacagaatattcatgaattaattaccaaattatttttataatcattagacataatacagtttgaaatattttctaagttttgtttatttttatttgtttgtttatttatttcaatagttttggggaacaggtggtttttggttacatggataagttctttagtggtgatttctgagattttggtgcacttgtcacccaagtagtgtactctgtacccaatacatggtcttttacatctcaccccctcccacctttcccatttttcaagttttagatggttacaattttgtgcagaaactgatttcagttatccattttttgaagagtaccatctaatgtctaagttttcttcctttagaatgtgaacaaacatagaagtcactggaaatcacaacagttggatagtaatgtgacaatggtatgtaagtttctcagttttaagatgtacaatgtatacctgattgaaagagtctatatttacttccagtcgttaaagattcacttgcctagtcagtgttactttcattctcttcaatataccattaatagtaacaattcattacattagtagcctggaaagtatagattttcatgacaaattttttttttttttttttttgagacagggtcttgctctgtctcccaggctagagtgcagtcatggctcactgcagccttgacctcctgggctcaagtgatcctcccaccaccgccttccaagtagctcgaacttaaggcatataccaccatgcccagctaattgttaaaattttttgtagagacaaggtctccctgtgttacccaggctggtctcttactcctgggctcaagtgatcctcctgccctagcctccccgagtgctggattacaggcatgagctactgtacccagcctttcatgtcaattttaattcacaatatcttgggggactttggataggtgactgtgaaacttccacaagtttttaaggattcttctagacatttactttctaggaaataaatacattttcaatatttacaaaaaaaattgaataaagccttaatggattttcctgatgaggtgatggtgccatgcagtaaactcacatgtttacagaacttgtgaatggattctgcttctgcttaatgtgatgagtctgtgtcacaattccagtgacatataagtgaaacctgtcatgtatattgtcatgcatatgtcctatattttatcagtttagatataactttaagccctttagtagatatatcaggactaccaaatgaaaaaaggagttggaaagatgatacattgtctcaggacagtagtttttaaccttttaggggacttcatattctttcgtagaatctaatgaaagctatttatcttcagagggaaaaaaaatgcacctatgcacaacattttagtttcaggtagttcatagattttagattttagaagcttcctttaggcagtgcttcctgatatcttttacatggtgacacattagaataaatgactgcttgcatattcttcctgaaaccagccgaaagctgagagattcagtatatggcatctctgtatgcttctgcataccatttggaagctctgctccaggaaaagcgtgaagggaagtaacttatcacttgccaatggtcatttaacttgtaaaaggtatagctagtccttctatcaaagaagcatgcgcacataaacacacaaaaggtatgcttaaggttcaaacccaagttggtctgtctctaaagcctgtgtgcctttgactatgcaatggtgccttcctagtaccaaggatgtatgtatgtagtagggacagggctaggtaggtaaatatattttttttcttacttagcggaaggccttttgggtgcatgcccactaactaaaaaagaagccacatcagtaacattatgacttgataaaattttgtcaaaaatggaaatgacctaacataattgattcaataaactatggtccatcagaacagtggaatattatgtagcaattttaagtgtttgtcatggcaaatgcaaacatcatataagtaataaaatgaaaatgttttaaagtacactctgagccaggcacagtggctcatgcctataatcccagcactttgggaggctgaggtgggcagatcacctgagctcaggagttcgagaccagcctgggcaacatggcaaaaccctgtctctatttaaattatttaaaaaataaagtacactgtgatggcaactgtgtgaaaacataaacatttgtttattaattgatccaataatttaagcatgtgctatatttaataatcaggatattcagtactaactgaaacagaaacagcttctgacctaatagagtgttaggaaaaggtagataaccttattccaagacaatagggtttaactttgtagtggtctcatgttcatcgtgaggttttattttattttattttattttatttatttttttgagatggagttttgctcttgttgcccagtctggagtgcagtggcacaatcttggctcactgcaacctctgtctcttggattcaagcaattctcctgcctcagcctcccaagtagctgggattacaggtgcctgccaccacacccagctaatttttgtatttttagtagagacggggtttcaccatatttccaggctagtctcgaactcctgacctcaggtgattcatcctaaggatttaatgaaagctacttatccctagggggaaaatgcacctatgcaaagtaatatacaaggtgatatgtacaaacaaaggttattttgttaaggaggttatattgagctgaatgcttctcccaaatagtcctgcgtcctgctttttctgtctggcagcatgagtagatctgtttcttctttgactggacaacccttcaaatatgtgaaatatgtaatcatgtctctttacatgggataaatatccttcattctattaagtgttcttggtgcattttttcccccatacttatttctgtctttatcatcctcttttggacacaccattgtctgtcagtgtccactaaagtcttgtccaaactaaacacatcttggctgggcacagtggctcacacttgtaatcccagcactttgggaagccaaagcagaagaattgcttgaggccaggagtttgagaccagcctgggcaacatagtgagacaactatctctacaaaaaaaatttaaaaattatcaggcatggtggcacatgcctgtagtcccagctactcaagaggctgaggtggcagaattatttgagcccgagattcaggctgcaatgaactgtaatcacacctctgcactccaacttgggcgacagagcaagaccctgtctcaaaaaatgtaataataaggaaaaacaacatgtcccacatattgtgtagccacttaggcactatgtttgtcagggctgccataacagactaggtggattaaacaacagaaatgtatttattttctcagtcttgaaggctgaaagtcaaagaacaaggtggcagcaaggttggtctctttttgtttgtttgtttgttttttgaggcagagtttcgctcttgttgcccaggctagagtgcaatgacgcaatctctgctcactgcagcctccgcctcccaggctcgagtgattctcctgcctcagcctctgggtagctgggattacaggtgtgcaccaccacatccggctaattttttttttttttgtatttttagtagaggtggggttttgccatgttggccaggctggtcttgaactcctgacttcatgtgatcgcctgcctcggcctcccaaagtgctgggattacaggcgtgaaccaccgcacccggcctaaggttggtctcttctgaggcttttctccttggcttgcatagggccaccttctccctgttttctcacgtggtctttcctctgtgtgtgggagtccctggtgtctctttgtgaatccaaatttcctcttataaggacactagtaagattggattacggctcaccctaatggcctcaatttaaattaatcacttctttaaaggccctgtctccaaatacagtcacattctgaggtactggagtttaaggttttaacatacaaatttgggggcagagattctccccataactggctccgtatctttgggttgcggtaatgggaatatggaaggacttaacttctttttttttactgttcagtgtaaaaattaatacacaggaataaatcagtttttttttttttcttttagccaaaatctgaagatgaagaaggctggaagaaattttgtctgggtgaaaagttatgtgctgacggggctgttggaccagccacaaatgaaagtcctggaatagattatgtacaagtaagggctgtgtggataaacagaacaaaaagcattttaattttggtgcaccacttaatataaggggtcagcaaactctaccctgggccaagtccagttcatggccttttttatatccatgagctaaggattgtttttaggttttgaaagagtaaaaaagaaacaaataatatgtggctgagactttatgtggcctgcaaagcctaaaatatttgctgtctgactcttgatagaaaatgtttgccaacccagacttagtttattagctcttcaacctaacaaaacagcttagtttctgaaacaatttactgtgactttttttagtttggcttcatatcccttatgtttggcttggtaatcattttatgagttggataagattcatagtttttttaaatgatgaggcatcaggcaaacagtgttatgagtagccagggaaaaaatggaaatcgacacaattaggtgctttaaaatgcataatcacatctatcacttcatgggcctgtaaaaaataaatcacatattctaaagatgaaatgttgaggatatctttaaaattcatgtggctgtaatcataagttatgtagacaactccttgtccttcaggatttacctgcccccaagtttgcaggtgttccttgagaatccagtgcatgcctctgcattagcgcttactccctatagcatgtagttcttttcagttcaacaggtatttattatttgctatatggtgccacattgtgtttttcacatttaaaactaatttttcctaaaaatgtaaaaagccccaagaatcaataaaaagaccaagaatcacccctcccctgcccaagaaaaaatagccaaaggatatagatacctcacagaaaggaaataaaattattcttatatgacaagatgccaaaaatcacttgtaatagaagtataacataactatgccaaggtgctatttttcaggtaacatattggccaagaaagtttgatacaccatattgacaagagctggggaaacaagcactcttagacgtggtacaggagtataaatagactcaaatcttagggaagttaatttggtactctttctatataaccaattgatcttttggatgatatccttaacatatgctacatttcaaaaatagctatatatatatatatatatattttttttttttttttttttttttttttgagacagggtcttcttccgtcatccaggctggagtgcagtagtgcactcatagctcattacagcttcaacctcctgggctcaagcaatcctcccacgtcagccttcaacataccaggggcagcaggcacccaccaccacacccagctaatttttaaattttttgtagcgataagttttttaattttttaaaaaaatttttttgtagagagaagttttcaccatgttgcaaggttggcctgaaactcctgggctcaggcaatcctcctgctgggattataggcatgagctatcatggctagccaaaaatggtttttaatttataaagaattaaaacttacttatttagcttattttcagagaatacatacaagtaaaatacaccatgttaaaaaaaacccttaaggaagtaagcgtttaatgtatatcctcttaagtttctcacaaatcagtggtattttcataattagcaatcacagcctcagactccaaagtagacttttaaaaattgaatcaaattaggttttaaaaatgtcattctaattcaagtgtccttaattcttgaaaatattagctttagctgaagattttgaaatggtgtatacaacatattaatgtcatcttatcaatgttacagttttattggatatacttaataagttagttttttcaagtactatcatgtaaaaaatttttagtctttaacattttacttactaaaatcatactttatttaaaaatttacaaattcagaccaggtgaggtggctcatgcctgtaatcacagcactttgggaggctctggcaggtagatcacttgagctcaggagttccagaccaacctgggcaacatggcaaaacctcatctctaccaaaaatacaaaaaaattagctgggcgtgttgacatgcacctgtggtcctagctactcgtgaggctgaggtgggagcatcacctgagcccaggaagcagaggttgcagtgagccaagatcgcgccactacactccagcctgggtgacagagtgagaccccatctaaaaaaaaaattacatattcaaaatttaaggcgttattttcttccgcattacaaacatagtagtttccggaatgtctcattgttatggacaatgaaagaattttcttttatttgttctttgtttctaaacaacagtgtggcaagaaattcaccagtttgaaaaaaaaaaatgaagcttataataccatttagtaaaattcagtctcattttttctttcagattggttttcctcccttgcttagtattgttagcagaatgaatcaggtaaaattaataatagagatatatgcattcttttgtttgcattgtgtgtgaaagtatttgaattgttaatacatatactgaattcttacagtatgcaagactttgtcctaagctctttaatggttcttatttaatccttactacaaccctctatggagagttattattgataactactttttatagatgaggaaacagcatttgaggttaagtaacttgcaggtggtttttcagcaagtaaatggcagtactgagattcagtgccaggtagatctaactccagagctcatgctctgtcttaatcatggtgctagagtattcatttctgtagctttcagttataagtcttagattctggggtttgaattaaatacaaggtccctgacttacaatggttcagtttaggattccttttttcccaccatgcctggctaatttttgtattttcagtagagagaggattttgtcatgttggccacgttggtctcgaactcctggcctcaactgatccacccaccttggcctcccaaagtgctggaattacaggcatgagccaccatgcccagccattttaggaattttcaactttacaatgtgtttatcagcacataaccccattgcaagttcaggggcatctgtactaaggttagattgctatttctagttctagatgtcctatacattctattaagattgaaatatgggccgggcgcggtggcttatgcctgtaatcccggcactttgggaggtcaaggcaggtggatcacaaggtcaggagttcgagaccagcctggccaacatggtaaaaccccatctctactaaaaatacaaaaattagctggatgtggaggtgtgcacttgtaatcccagctatttgggaggctgaggcaggagaatcgcttgaacctgggaggcagaggttgcagtgagccgagatcgtgccattgcactccagcctgggcgacagggcgagactctgtctcaaaaaaaaaaaaaagaaagattgaaatatatgatttcttggatcaaaagggaagaattatggagtttggttcttcagttttttaggagtaaggactcttattcatttaaaaagcaaataaaaatttaattttatcttcacatagcattgggtacctttggaagcctttttttttttttttggcagggtctcattctcttgcccatgctggagtacagtgatgtgatcttggctcactgcagtcttgtactttggggctcaggcaatcctcccacctcagcctcctggtagctgggaccacaggcatgtgctaccatgcctggctaattttgtttatttttggtagagacaaggtctcactgtgttgtccaggctggtctggaactcctgagctcaagcgatcctcccacctcagcctcccaaagtgctgggaatacaggtgtgaaccactgggcccagccaacaattttttttgtgggtgatattctcttggaaataatacacaagctgatagtgttacttaatcatttgcattaagatattgtagcagtcatactaaattccatcagtgtcatttttgttgtaaccatcaactgtatttgaataaaccagagattattttcaagagtttgataaatccatctgtatagtttaagaacagatttttctccacctaaatttttattcagatttgtactttgatttaatttgaatttagaaataaactgatggtttttttgttttgttttgttttgttttgttttttgagagggagtctcgctctgtcgccaggctggagtgcagtggcacaatcttggctcactgcaacctccacctcccaggttcaagcaattcccctgcctcagcctccctagtagctaggactacaggcgcacaccatcacacccagctaattttttgtattttagcagggatggggtttaccgtgttggccaggatggtctttgtctcccgaccttgtgatccacccgcctcggcctcccaaagtgctgggattataggcatgagcccaccgcgcctggccaactgatggtatttttacaaatacatctttttttttttttttttttgagacagagtttcgccttttgcccaggctgtactgaagcggcaggatctcagctcactgcaacctctgcctcctgggttcaagcagttctcctgtctcagcctcccgagtagctaggattacagaccccgccaccatgcctggctaatttttgtatttttagtagagacggggttttgccgtgttggccaggctggtctcaaactcctgacctcaggtgtgccattgttttttttttttttttttttttttgagacagagtctcactctgttgcccaggctggagtgcagtggcaaaatcctggctcactgcaacctctgcctcccaggttcaagggattccccggcctcagcctccctagtagctgggactgcattcactcaccaccatgcccggctaatttttgtatttttagtagagatggggtttcaccatgttggcctggctggtctcaaactgacatcaagtgatccacctgcctcggcctcccaaagtgctgagattactggcaagagccactgagcctggccacaaatacattttcttttaaccttgtgaagtctttcaagtagttacaaactaaattattaatagttacaaactaaatcctaggatttaaaccaaggtgttagttgatatttgaaagtgtgaaaatatttgttttaaaagcctcactggggctaggcgcggtgcctcacacctgtgatcgcagcactttgggaggccgaggagggcggatcacctgaggtcgagagttcgaccagcctgaccaacatgcagaaaccctgtctctactaaaaatacaaaaattagccggacgtggtggtgcacgcatgtaatctcagctactcagggggctgaggcaggagaattgcttgaacccgggaggcggaggttgcagtgagccaagatcgcaccagtgcgctccagcctgggcaacagagtgagactctatctcaaaaaaaaaaaaaaaaaaaaaaaaaagcctcattggataagccgcctaatcaaactaattagagtcaaacaaattagctttctttgaaagtttaaagaatgaggccatttttaacatcagagttgctttctaaataaacttaatgaaactcatgttgaattcatgttttattattaatacaactcttctccaccccctctttttttttttaggcaacagtaactagtgtcttggaatatctgagtaattggtttggagaaagagactttactccagaattggtagtattgcatgtttttcttttcataatgtaggcaaaaattagacgttttgggtcaactgtgggccacatatacaatggtgctcctataggattataatactgtatttttactgcacattttctttttttcttttcttttttttttttttttttttttttgagacaaggtctcgctctgttacccaggctggggtgcagtattacaatcatagctcactgcaaccttgatctccccagctcaagcaatcctcctgcctcaatctcctgagtagctgggactacaggcgcatgcagccacgcccagttttttttgttttttgttttttgttttttttattagagacaaggtctcactgtgttgtccaggctggtcttgaactgagtccaaatgatcctgcctcctcaccctcccaaaatgctgggaattacaggcatgagccaccatgtgtgcggccttttgtgttttttaaatagagacgaggtctcaccatgttccccaggctgatctcagactcctaggctcaagtgttcttcccaccttggcctcccaaactgtttggattacaagcatgagccactgagcccggctcctttccagtatttaaatatgtttagatctggccaggcacagtggctcatgcctgtaatcccaactactagggagggctgaggcaggaggatcacctaaggccagggaggttgaggctgcagtgagccatgattgtgccactgcactgcactctagcctgagtgacagagtgagaccctatcttaagaaataaatatatggtttttttggatgcacaaatgtttaccattatgttacagttgcctacagtattcagtatagtaatgtgctatataggtttgtagcctaggagcaattggctatgcaatatagtctaggtatagtagactataccatctaggtttgtgtaagtatactctatgatgttcatccagggtcaaaaatcacctaacaatgcatttctcagaatatatctcccttcattaagtgatgcatgactgtacttgatgtgatgctacggtatttatttattttttatttatttgtttgttttgacatggaatctccctctgttgcccaggctggagtgcagtagcgcgatctcggctcactgcagcctccacctcctggtttcaagtgattctcctgcctcagcctcccaagtagctgggattacaggcacctgccaccacacccagctaatttttgtatttttgtagagacaggctttctccatgttggccagactggtcttgaactcatgacctcaggtgatctgcccgcctccacctctcaaagtgttggaattacaggcgtgagccactgcacccagccagtatttatatttatatttatatttgtatatgtgtgtgtgtgtatatatatatatgtataatctgaactatacttgtttgtagtcaaataagaaacactagaatgtaaatcaacatactacttccttcattgagaaagtcttggagaaaaaaagtcaatgaaagagttgatgtatatcctggtacaaggtacaaactccttatctcattgcagacaagtttgttttttttttttttttttttttttgagatggagtctcactctgtcacccaggctgcagtgcagtggtgccatctcggctcactgcaacctctgcctcccaagttcaagcaatcctcctgcctcagcctcctgagtagctgggacaagtgtagagaatatttaatttaaattaaatatttaatttaaatgctagctttacatagtaaatgtatcccttaaaatttgagtcaagttgaaacatataatttttttttatagaaaaagaattccacaatttgtaaaagaaacctggatttgaatctttttctgtaagaaaaagtcttaactattgatttgagtttgcctgaggaacccatttagtgtgttgtataaattgctatttaaattttgtcctaatattttttaggtttccccgaagtgatatgttgcttagaataaacaaagttgtatatactactggtggaaatacaaatttggtataacctttccaggatacaatctggtgatcatatctgaaaaaccttgatgaatatacataccctttgtcaccattttacttgcaatacttaataaactttccccatgttgttaaatgagattaaacaagggaatgttattaaatactctaaacaagacacttaacattcccttgttaatcccatttaactacaagggatggctgagtggggtggctcactcctgtaatcccagcacttagggaggccgaggtgggcggatcacttgaggtcaggagttcgacaccagcctggccaacatggtgaaacccccatctctactaaaaatacaaaaattagctgagcatggtggcgggcgcctgttgtcccagctactcaggaggctgaggcaggaggattgcttgaacctgggaggcagaggttgcagtgagccgagatggcaccactgcactccagcctggatgacagaacgagactccatctcgaaaaaaaaaagaaaaaggacaaaaacaacatggtaaacattttattatgtattataaataaaaaagatggctacaagatgatattacaactgatgaaattgtattgaaaaaaagttgtacagccgggcatggtggctcacgcctgtaatctcaccactttgggaggctaaggcaggcagatcacttgaggtcaggagttcgagaccagcctgaacaacatggtgaaacccggtctctattaaaaatacaaaattagccgggtgtggtggtacatgcctgtaattccaggtactcaggatgctgagacaggagaattgcttgaacccgggaggcagaggttgcagtgagccgagatcgcgccattgcactccagcctgggcaacaagagtgaaactctgtctcaaaaaaaaagaaagttgtacatacgaataggaaaaacaagaacatttttaaagtgaatcaaagtttgatctggaatgttgggactgcaggttttttcttgtgcttgtggtattcttcacagtttttctgcatcaaatatgtattcattttgtagctgaaaaccccattttaaaagggagtggggatacattgagcctgtcaaagtatttataaaagtgtcaaaagattatttcatctgtagtatagtttctttgtatgtccccagaggacaaaattatacaattataaaatgatttctatatctgtccatacagaacaaagaaaaaaatgtatcttaattttttccagtatttatattcatcttaatgtagtgttctgcttacaaatgagaacttcctatcataagaatatctgaaacaaactctttggagatcagggaatattttgaggtatccaatgtcctgtgtctgtaattataggatacaagagataacacctggctctccaaatgaggctttcttgtctatacccaaacataatatagttaaatgttctatgaatttattcatagcagataatcaggcataacattggacatttaaaaaataaacttctggttcagtatttgtctaaatattaattttttgaatttttttttagggaagatggctttatgctttattggcttgtcttgaaaagcctttgttacctgaggctcattcactgattcggcagcttgcaagaaggtgctctgaagtgaggctcttagtggtaagttgcaacttactgtttaaaattaaaagcacccaccaatttatatggtggtaaagaaggagttcagtgaaataggaaaacacatggaatattttattggtggcaattagatttgtaaagcccaaaataatagtagcttaaataatatggaaatgttttctgagataaagaagtctgagccgggcgtggtggctcacacctataatcccagcactttgggaggctgaggcgggtggctcacctgaggtcaggagtttgagaccaacctggcccacatggtgaaaccccgtctctactaaaaatacaaaatttagctgggtgtggtggtgggtgcttgtcatcccagctactcaggaggctgaggcaggagaatcgttcgaacccaggaggcggaggttgcagtgagctgagattgcaccactgcactcctgcctgggcaacagagcaagactctgtctcaaaaaagaagtaggtaaaaaaattagatttttactaagatggcagtaacccacccacacctttgagttttgtcatatgtggctttcatcctcatgctcatcttatgatccaagatggctgctgtagcttcagccttttttttttttttttttttttcttttattgtgagatggagtctcgctctgtcaccgaggctggagtgcaatggtgcggtctcggctcactgcaacctccgcttcccaggttcaagcaattctcctgccttagcctccagagtagctgagattacaggtgcccgccaccatgcctggctaatttttgtatttttagtagagacagggtttcaccatgttggccagactggtctcaaactgctgacttcaagtgatccacctgcctcagcctcccaaagtgctgggattacaggcatgagctactgcacctggtgtgtgtgtgtgtgtgtgtgtgtgtatatatatgtgtgtgtgtgtgtgtgtatatatatatatctttatatatatatctttatataattcagtaatgaatatatataagaacagtaagaatcctgtgtcttgactgtacagtgattaatatatattatatatattcatatatattctatatatatcctcacatatattgtatgcattatatagagaggaacaataagaatcctgtgtcttgactacagtgataaatatatttattcatatatgtatattaatatatatttattatatatgaatacatattcactacagttaagacacatatataatacatatatgaatatatatatatatattcatcactgtacagttaagacacaggattcttattgttcctttagtaggaaccagggaaaaatttcccccaagttatcccccttagatccctctttatttttttttccctattcagaatctttatttaaaagatagtcttagatgtttctcaaggaatcattaactctacagttctctgctttttctttgagggctcctatttccacatgatgattactgtcatataataaagttttcatgtttcgtgttttacatcttaatagaaaatttatttcaaaagtaataggaacagacaatatttaaatttttctttttttttttttaggatagcaaagatgatgagagggttcctgctttgaatttattaatctgcttggttagcaggtatagttaatccttggcttctttattatttatcagtgaggtcagtgaggttagatcgtatttattacatttggtttttgtttggttggtttttttttgagtctcactctgttgctatagttagggtgcagtggcgcaatcacagctcactagagctttaacttcctgggctccagcaatcctcccacctcagcctcctgagtagctaggaccacaaccaagcaccaccacacctggctaattaaaaaaaattgttcgtagagacagggtctcactatgttgcccaggctggtctcaaaactcctgggctcaagcgatcctcccacctaagcctccgaaagtgcagggattacaggtgtaaagccactgcattcagcctgcatttttgtttaattgcctgtgtcctgcgttcattttcagttgtggcatatttttatttagtatctgttttatttcatttcttacatagaaattcttcttggaatttatttgaaaactttttttgttgttttgttttgagacagagtctcgctctgttgcccaggctggagtgcaatggcaccatctcggctcactacaaccttcacctcctgggttcaagcaattctcccccctcagcctcccaagtagctgggattacaggcacctgccatcatgcccggctaatttttgtaattttgtggagacggagtttcaccattattggccaggcagtaaaacacacatatttattttaggtctcctcctggacatatttttgttccatagatcagtgtttttatttcattgccagtacctttttaaagctttataatatacttaaatattgggaaggcaagtaatcttgtttccatattttcacatattcaatatctagtttcttgatctacaataattatgctgctgatgataattaacatttactgggcaatttgtgccaagcatttttcttagtgaggaacccatttaatccttctaaggtgggtactgttaacagtttacagatgaggaaaccatggcagagagaggttaaataatattactaccatcacaaagctagtaagtgttagagtaatgatccaaacccaggcaactttgactccggagctaagcttttaactatgctgatcaaaaattaagctaatacctacctcatctgttggtagtagcagttaaatgagatgatatagcattgccctacttactttatgtatagtatctctactctttacaatagatcagagttgtgtttttgtttttgtttttgttttaataaattttttcctttcagctctgttggacttgatttttttccttttacagataatgacacagattcagaaaggttaagtaattggtagctcagcaaaccagtaattaatgaaacctcagacaagtatagtttctgactgcctcagttgagattttacagtattatgcaattatgaaagcaaaaacattcaagtgtattttttgccctcaaaaagttagataaaaatggaaaaagttctagactacaaaaggttctgaagctaacagctttacaatagaagacacaaagatttgaaagtttaggaaaaaaaggaccgggcatggtggctcatacctgtaatcccaccactttgggaggccaaggcgggtggatcaccttaagtcaggagttcaagactagcctggccaacatggtgaaacctcgcctctactaaaaataggaaaattagccgggcacggtggttcacgcctgtaatcccagctactcgggatggtgaggcaggagaatcacttgaacctgggaggtggaggttgcagtgagctgagatcgtgccattgcactccagcctgggcaacaagaacgaaactccatctcaaaaaaaaaagaaaaaagaaaaaaaaaaggaaagctgggcacagtgactcacacctgtaagcccagtgctttgggaggtcaaggtgggaggattgcttgagtccaggggttcaagaatgcagtgagccatgacaaaatttgattagtgattttcctttttatttaatcttataattacataaaatagttaccttgccaaagttaaaattataattcaaggtacatttggagtattttagcatccatctttatcctcattatcctcttttttcctttctcctctagttaaccattgtattactaatttttgtttcatcttttcattcattgtttctttttaaaagtataagtaggccgcatgtggtggctcaagcctgtaattccagcacttcgagagactgaggctggagaattgtttgagcccaggagttcaagaccagtctgggaaatgagccatgatcatgccactgcactccagcctgggtgacagagtgagaccttgtctcaaaaaggaaaagaaaaatataaacaaacacgtatattggcagtcctacacatactcacataaggtagcatacagaacaatctgttctgtacttcgttttttttcacttaataaatcctggaaatcatactttagcagtataaatacgttcctcatactttagcagtataaatatttccctcatttctctttttatggcttcataattttccactatgtagacatactatagcttatttaaccagtctcttattgatggacgtttgggttgcttatggtctttggctattaaaaatagtgctacagttaatatctttatacataaattttttgttttttttttactaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaagctcagcacttttttttttttttttttatttctttgagatggagtctcgctctgtcatccaggctggagtgcagtggcaggatctcagctcactgcaacctctgcctcccaggttcaagtgattctcctgccccaggctcccgagtagctggatctacaggtgtccgccaccaagcctggctaatttttgtatttttagtagaaacagggtttcaccatgctggccaggctgctcttgaactcctgatctcaggtgatccgcccgcctcagcctcccaaagtgctgggattacaggcatgagccactgtgcctggcctcaatatttttatttttaaatgctttattgcacaaatagaactttatctaacaaatcactttcaaaaataacaggtcaactgttttaatttgtttatgtcacttataacttacctatttctgtatcaggtaggaatgttttctgctttaagtaacacaaaagatccaagtggcaatggttcttcaaataggggtttttctcagataacaagaagtctaaaggagctggccactggcattggtttagtgactcagtgatatcaggggctcagattcctttagcctttctgtcatggaaacaagatggccattgcagttcaagccaatgtgtctgtattcaagacaaaaagaaggggaagcagggccttccacatctgatccttttctcataaatgtaaaatcttttctagaaatttagatcagacttgtgttcatctgctagccataaatgtacaacatgatcaccccttgttcccaggaaagtgggaaaatgaagctgtacgcctttccagtctcactaatggaaggtgggaaaggaaaatggggattgggaattaccatggatcagacaaccaacagttttgccaccagttataattagagcagaggtcattttatatttgaatcttttctgtaatgtcttcataaagctcactttattattatttttgtttgtttttgagacgagtctcgcttggttgcccaggctggagtgcagtgacgcaatctcggctcacgcaacctccacctcccaggttcaagtgattctcccacctcagcctcctgagcagctgggactacagacatgcaccaccgcacccagctaatttttttgtgtttttagtagagaccgggtttcaccatgttggtcaggctggtttcaaactcctgacttcaaatgatccgcccacctttgcctcccaaagtgttgggattacaagcatgagccactgtgcctggcacataaagctcactataaaactgcagtcctaagtacttaaaaatttcctcattgttggatatctagttttgttttcagtgctaacctaatataaaaaaatactacacagatatcttcatgtatgcaatgtttcttttcaaacttttttcctttgatcaaaagtttccttttcccaaaagtaggcaagccataagagtctatcatttaatactgcatttgaaaacttggctaaactgaggtttctaaaattgtttttgtttctcatataattctggtgtgagaagttcaggatggtgcagcagctttacaatgtcttaaatattctgggctccatccagatttctctttcatcatttgagtatgcagttttcatctttttgtttatgaagtatggtttatctcttgcctcacatctacactccagggagggaaatggcaccaccccttcttgtcatttatatctgggagcagagcattttaagaaaccttcaactcgatatctcattggccagaattatgacatatgaccagccctaattgtaaagaatgctggaagatgtacctggacacattgctactcctaacaaa

SEQ ID NO: 13270 - DNA, 9879 bp, Human
gagacaggatcgttgctatgttgcccaggctggtcttaactcctgggctgtagcgattctcccacctcagtctcccaagtatctgggattacaggcacaatccactggacttgctcagagatctttattgtacactgatatacccaagtgcctagaatagcacctggcacatagtgggccctcagtatttgttgaactaatgaatgatcattgctcctttggaagcctacaaaccccacagaagcaggaatcacaactatcttgttctaggctttattttcaaaccctagcttactgctgatacacaatggaagctctaaaagattgctggattaaagtggtagcttgagttaattaatacactgggcccactaattctttgtacaaggaagatagatgcctggctgagattatttaaagcattgtttctgtgggaaagtgttttgtttttttgtttgtttgggacggagtctcactctgtcgcacaggctagagtgcagtggtgcaatctcggctcactgcaacctccgcatcccgggctcccgagtagctgggattacaggcgtacaccaccactcccagctaatttttgtatttttagtaaaggcggggtttccccatgttggccaggctggtctccaactcctggcctcaagtgatccacctgcctcagcctccctaagtgctgggattacgggcgtgagccactgtgcctggcctgtgaaaaaatgttttctgagcttcaatttgtatatatatttatagaacaaaactagttcctacattggcagtgcaggtagggcagaaccagaagcgggacaacacacacagacaccactaacaacagggccgctcccttaggtctggtcttaaccagctctaggccaggtgaagaggctaactcaaccatgactgcgtgtctgtctcgccattgctttcttttctctagtatagatgctcagcgtctaatcagagactgattctcaactggcgtgaccaaaggacagttatattatctccagtctcaatttccttatcagtaataacaggcattttatccacactttcagtttgtgagaaataaggcatgtagacggtttcacagagggtcgggaacaagatcaacccctaacaaacgttagccattatgactaatgacttttactagttttcatttttgtcttccctcttctcactttaacctaatcaggctgggcgtggtggctcacgcctgtaatcccagcaccctgggaggtcgaggcaggcgaatcacctgaggtcaggagttcgagaccagcctgcccaacatggtggaatccggtctctaataatacaaaaattagccaggcgtgttggcgcgcgcctgtagtcccaggtactcaggaggctgaggcaggagaatcgcttgaacccgggaggaggaggttgcagtgagccgagatggtgccactgcactccagcctggacgacagagcgagactccgtgtgaaaaaaaaaaaattaacctaatagaggaaagcacgcgcccaccccctctctgagcatgcgcaccaacagaatagccgcgccctttcctaattaaatcattaaccaaggtgagggtaaggaagaaaaggaggcttggctaagtcccactctgatgtgatcacgttaaaacggtgtaaggcacattacatcataggttaaaaggcctagaaaactccgcgctccccttgccagaactgcagactcgcgagcctaagtctccgagaactcagggattgtgaaacccgccccgactctgcgctagcagcgggatccaggcacccgcagctaactggggagggagatgactgcctggctgacttttcattggctcagagtcacaaaggctgcaggttcttcccccttccggtcgctgagtggttgaggccggaagacaacgctcatcgtcattggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggtaagggcctaacgggaactcggaactcggagctcggagaggcagccctcaggtcggggtgaattgggggcggggagggcggccagccttaagaagactggaacctcgaggcctgttcgcggggcggcgggtaaaaccctgttgtcgccgaggtggagaggccccaggtcccctccgtagagcgctggtctcaggtccctgaggaaggagagcgaggcctgggtgcgccggcatgctttcttggcctgtgagaagacccggactgctgattcccgctctcggccctgcaggcccggaactgcagcacaaagccccttcccgctccggcggacacccggcccgttgctggccccgagaccctgccgggacgcaacaagccgccttaccccagcttcctgtccacgtgcagcctcctcggggatggcgggatggggacctgatccaggcttgttaatgtgtgggggcatcgaggtgaatataatttctgtgacacaggtcctggagaaacgaggaagttaaatgaaatagtacttcctgtcctgtttcagacatttagatttatttgaaactatctttttggaacttttgtgattttttctccttatgatccacatctctgaaagtatttgggtgcgactgtgtgtgtctacatatgattttgcactgatttgtaaatcttttacaggcccatccaagccagattgctggccctttctggtcctggtggaggtagaggacgtggtagtttattactgaggtaagatttcctttggactttactcatgctgaaactactggtactttactaaatatgttggtttgaacaaaacctgtgataaaatcaataacccagtgtttgtcgtctttgttttgtttaatgttgtaatagactagatttctgtataaatatagttatcctgaaaaactggaggttgaagaatatattaagtttaccaattttgagtgaacttaattcttataaagtaacactataaaagcattttggaatgaatgcccgtttaaggctactttagttggaaagatttttgaaagtttaaccatattctcttgtcaaatggaaataccatttatcttgtatttcaagtgttttatgttgaacattttaaatttcaggcgtggattctcagatagtggaggaggacccccagccaaacagagagaccttgaaggggcagtcagtaggtaggtttaaaaaaagattcctgaaggcttctttagtttctgaggtaccacacaaatataaatatttattaacaataattctgtttcagcaatattaaaattgagtggtatgccactccctgccccccccaagttctgttggtatttgactgaacagttgactatcagttccctcaaaacgcagttctgcactcatgataacctaaattttatccaaataaaggtcatgtgaagagtaaaattggaaaaattgtcaattagtaccattttttctgacttgtacttgaaaaacttaaccagtttgaaatacttagaaaatacaggagagcaaaattggtttgggcgttagttcacacattgtagtatcctttctctgctggaggaaagaataaaatgggatggagacttgatagaacaaagcttctggaaacgagtcctagaagagagggcatttgcccttggtgtgcagttacataaatacctcagtggtcatttaaattaatttttggccaggcacagtggctcatccctgtaatcccagcactttgggaagccaagaccagcagatcacttgagcccaggagttggagaacagcctagatacatggtgaaatcccatccctacaaaaagtacaaaaaagttacccaggcatgctggctcacgcctgtagtcccagctgcttgggaggatgaggcaggaggatcacttgagcctgggaggtcgaggctgcagtgaaccgtggtggcaccactgcacttcagcctgggtggtatagtgaaaccctgtctcaaaaaaattaatattttctatgacaggctgggcggggagcgtcggaccagaagagaatcacgccaggaaagcgacccggaggatgatgatgttaaaaaggtattgagattgaaagaacttaaatgaatgtagtaccttcactttactacatttaaaagcacaccactcatatgctagttaaattactgagattttctttttctgcagccagcattgcagtcttcagttgtagctacctccaaagagcgcacacgtagagaccttatccaggatcaaaatatggatgaaaagggaaagcaaaggtatttccctgggggaaaaaaactctagtgaaataatgcagttataaggaaaatcaagggattgttcaagcatcctgtagtatttcttagaaaatgatgggtttaaatgaaatggatcctgttgacagtaaattttcttattctgttctttaggaaccggcgaatatttggcttgttgatgggtacccttcaaaaatttaaacaagaatccactgttgctactgaaagggtatttatccaagttttgttttgcatcatatatttaagttatcaaagtagtagattaatgttttttttaaaaaatccttaaagctcttttaagacctaactgtaaacctgaaacaaagccaagtaaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgaagcggccaggtgcagtggctcatgcctgtaatcccagcactttgggaggctgaggcaggtggatcacctgaggtcagaagtttttcgagaccagcctggccaacatggtgaaaccctgtctttactaaaaatacaaaattagccgcctgtggtggcatgcgcctgtaatccccagctatttgggaggcggaggcaagagaatcacttgaaccctggaggtgaggttgcaatgagccaagatcacactattgtaccccagcctgggcaacaggcgcaaaactccatctcaaaaaaagaaaaaatgtgaagcatatgcagataccttttttttttctttttctttttttttgtagagatggggttttatcatgttgcccaggctggtctgagctcaaagcaatccacccacctcagcctcccagagtgctgggatgacaggtgtgagccactgtgcccggcctgcagatacctttacatagtgaaaaaaaaaaaaaaaaaaaaaattttttttgagatggagtttggctcttcttgctcaggctggagtgtagtggcgtgatctcagctcactgcaacctccgcctctggggttcaagtgatttctcctgcttcggcctcccaagtagctgggattataggtgcgtgcaaccacgccctgttaatttttttgtgtttttagtagagatggtggtgttggcttctgacttcagatgatctacctgcctctaatgtttcacgtaattagtatgtgtaataactttttatcataattgaactgaaatcatatataccttttgttgtaactatttcaacacgtaagtattaaagcaggctacttaacttttagcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctggtgagtggtaatttggaattctaagattggtaatcctttgtgtttacaaaagcactgaccctttaccttttctttagcaagaagaatggaatgaacataatgccaaaataattaaatatataagaactaagacaaagccccatttgttttatattcctggaagaatgtgtccagctacccaaaaactaatagaagagtcacagagaaaaatgaacggtaagtatgcgaagaggtccattgaattgttcatagtgggtaaggtaatatgttcatatgcacacgtttgttttctaaaataattatgattcagtgattggtttgctgtgtttgctttttttttttaaataagataataagatattctaggccgggcgtggtggctcacgcctgtaatcccagcactttgggaggctgaggcaggcagatcatgaggtcaggagatcgagaccatcccggctaacatggtgaaaccccgtctctagtctctactaaaaatacaaaaaaaattagctgggcatggtggtgggcacctgtaattccagctacttggcaggctgaggcaggagaatcacttgaacctgggaggcagaagttgcagtgagccgagattacgccactgaactccagcctgggcaacagagctagactccatctcaaaaaaaaaaaaaaagatacattctgagatgctggtgagtttgtagtataggaatatttgtatcatgatggagtttaatgtgaaagttatagacagtgcttatgcatctgtattccttaagcatttgtgtaaaattacttttttttgcatgctattattgttctgataaaatgctaataagacaaatgtgaaaaccaactcagtttctagatggaaaacacatggaaggatagacactgctaagatgatgatttatctctttgggatcagaaaaattaatatatatgattttatgccaaaactggttctgttttacagaagttttatttttcatcagacataaagattgatctgttttcttcatcagttagaaaatgtgtagttctgtctgccacaatttctagtatgtagatttcccatggatctttgcttttataattttatgtcagtttgtggttacttaattgccataatcttttgtcataactttacaaaaacaaattcagatgaagcttaatgacaatttgtgaccagttataaaattatggctttgaattttcttaatcggtaaattttacacatgtaaatttttattctttagctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttccttgagtttaacactgtagctttagccttgactttgaatattcattttgccttcccttgacaagtaaatggttacagtgaaaatgtgaagaagtatttccagttagtttttgtg

SEQ ID NO: 13271 - DNA, 90876 bp, Human
  misc_feature (1)...(90876): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaggtaataggagataaggttattaacatgatatgaaatccagaacatgagtgagaaggcagcatggaggaggattttatgcatttttgctctaaaggcagactgcatgacattagaatcacagctccacatactgaactcgatcttcctagacatgtgaaatgggcatacaaagaggaccttctttataagctagttgtgagaattaaatcagataatttatgttccagtcaccaccaaataattattcaatatgtattaaaaacactcaagatgaaaggttaccttttacagagaggtctaaggaaagcaagaaaaattgaaggcacaaagaatctgagatgcagaagcaagaaactcctacattttctgaccaaatgtcttcagccttcctggcaaagtagattctgcccatttattagatctctagtgatcttagtctgatatgaccataattccaatacagagacagtacggatgaacctcaatgatagggacatacagcagagactctggttgacatctgtaaatatttacatattttgtagaataataataatagaaatacagaaaacagcgataatgatagccaacaattattggaggtttgctacatgctgggtcctgccttaagtactttttatgtattaagccatttagtacttacatcaagcccagaaacttttattatcgacattttaggaacaaaggaactgaggcatagtgaattcaaataactgggctgagtagccaagttagcaagtagctaaggtagggctcaaagcctgacacctgcaatagataatgcattacattgtctcactaagagagacctccaacggtagccctcagacttttaaaaaaaataaatacattgacagtgggtgaaacaaatgaaataacttgaagaagaaacaaactgcaaaaaagtttattaacagtgtaataataaatatgtaattttttaaaccctaactctagggggaaaaaagcattctttttcaactgattacaaaaacaatcctggaaagtaaaggaaatagctattcaaaatgatcgtatctgaaatcttggtgtaagctgtttccttcatctgtttcctccactaaaaaaaagaaagaaagaaagaaaaaagaggtttagactaaatagagtcagagttgcagtgacctaaacaggaagttgggctattcccaactgccagtgatctctgaagccgactctgaggctccctctttgctctaacagacagcagcgactttaggctggataatagtcaaattcttacctcgctctttcactgctagtaagatcagattgcgtttctttcagttactcttcaatcgccagtttcttgatctgcttctaaaagaagaagtagagaagataaatcctgtcttcaatacctggaaggaaaaacaaaataacctcaactccgttttgaaaaaaacattccaagaactttcatcagagattttacttgtgagtacctggcaatatactgtctagcccataagaaataactttaatttctttttctcgggggaaaagcagggtgctgagaggcaaagaactgataggggaggatcactgtttatttgcgtaaaatgaaaatcagcccttccctgtaaacagagtaaactcaaactgcaatccaaacttgagttctcagcattttgcatttagttcttaagcaaatttatgtgcaatttttatgattttaaaccataaacatttttgtaactaattggtgtatgtagcttttttataatttgaagattgtagtagaattctttactaattgtgcttggttaattggaagttcttgaaagttcggtttacctttccattttatttcataacatataaaatagagactgttattcttctattcaaataatctttcaatactattagttgatgatatttaaaatgaggtataaccattaaaataatcgtaatctaaatggaatattttatgccagcattaactaatctctctaaggaaatattttacaattctccaaagaccaaaggtcatattctgagatacttaaacgagaatacttacgatcaagtctatgttgtgcaattttgtaaattaaaacaatagataacgtgcctacatgatgtactgttatgttcctgttataaaatgtttgcttctagtgaaaaatgaaagcatataatacagcagtaaacaaccacagaaatataatgagagaaacaattatttaattatgaaaaagcactcattagtataaaataattaccaaaaataagggccaagagtactaccatgtgggaaaaaagaaaagataagcaacagccacactgtgactcagtgctctggaaattagtcacaaaatgactttgtataacatgagataatataaacacaaagggcaaaactcaagcaggaaacatactgcccagagagtcatatttcatgtgtaaaagcataatatttacatgaaagggggaaagttgtgacaattttgagagatactgcaaaacttttgaataaaatgtgttagggaggcaaaatctccctaacacattttaaagattattttaaatctatcattctagtgcatgattatttcaatatacagtgtccatatctcatctaatccttaaactaaagagggatagtccctgaaatttggctgagtttgaaatgttaatttgtggcctacagcttaataaaattatatgaaatataattagggatcaacaaagattgaaaaatattaatgtaaatacagatagctaatcaagtaattttaaaataagagtaaaactttaaaatatttatttttactgatttgagtagttatattggaaaaccaagtttttctacttcaagtgaccacagaatcttgttggaaaagtttaatgacatatactactatttgattcctatctctattaggtatactgaattggacaagtttttgttttgttttgtttctttgtttttaaggtacagtctgatatcttttgttttaccaccaatgactaaatcaaaactcctttggaaatgtggttcctgtccaaatggattatgttatcaactggtgtttgatggtctgactgattgtccatttatcagtcagataatcatttaaggaaatgattatcatttgcttgttgattgtacaactattttgacttaaatcttctgtcataaaacttattgttaaattaataatacataaaatgataacatattttgtaataaactctaattttcaaaacagcttaattatcttaaaaattaattttctaatctttagaaatcttttgtttacatctttcaaattcaagaggtaagtgggcaggatggcaaactaatggagaaaaaatgccaactttagagacttaatttaatgccagagtgcctatccatctaaccaaatagtaaatatgctatcaattccttaggaatggttggctgattaaattcagtgtcacaaaattttaaggtatctttcaactgatatctctacctaatacaagaaaaaaatgcaaagtaaacatccttacaaaaaataaaaaggaacagacaatatgaaaagtgaagaaaattacttagactaggattttcaaaaaaatcttatcagtataaattaattaaattgaattataatataggttaaaatgggttaattatatcatcaatttatttttttctatgtggacatgatctaagaattgtactacaatacaactcatctattctcaataaaggccttctacaaccagccatcctttttttgtttaccatctatagcaattaactcattttaggaattaaatttggcaggctgcctttttaaaacacaaatatattttcatgcattagtgtcaaaggtagattctgctatcttttatagaaatatagcagtactataattctttctgattgctacaatgtgcattaggagaaacttgaattcaatagacatgtgtttctggatatcaaatctcaccagaaacagggaagtgttcaagtgtttccagcaagttctcttcataatagaccatctttcctggctttctgaaatcctcactgactgctttcttggtgttatgtatcaattccgggggcccagtcttcccattacctttctctccctgtcttcacttctccaagtgtcaggtgccaagtagaaccacagcctgagattcaactaccagtagctaccagttgctgaaggcaacttcttcacctctacttttcttcttcctcaaaccgacaataacagaaagtatgggcccatgtcaaatccactgttttctctttaagcctctatttgggatgctatgtcctctcttagttggaacaaccaggtgttaaaattacttcaaaaacaaaagaatataaggacatcatggcccataatagaagttccaatgctgcagtacaactatcccaattgttccatgtgatggaccacaggtctctgtgtagacttggaattattgcaaggaattacccagtcaatatgtgagtaaaaaatattatatattgcttattagggcataagaaagctatttcaacatcagaaatgtgaaagtattcatcagtaggacactgataaaatgtaaacagtttttattaccaagcacaatgtgcctttgacaccctcgaaatataccacaccctcaagtgctgccaccacactgctgccaacctagtctatctcttctcctcttcttgacccttatctatttctatccagtccttgaattctatgataattcatctgtaagcatcacttcattcctcattcctcatttcccaaggcttaaaaacagagtaaatctcagaaacagggtaagtctccagaataatggtgtttattatgaatattttggtaatattttaaagtccatttaggaagcttcaaagattaattttcatctcagaaaatgaatcacaatggttatattaaaatgtaatacaacttttctctagttttttggacatatggaaaatactttacatttttaatatttttgtctgctaattctgtttttgatgtcatttctgtcatttagacttttctcattatgagttatattctactgttctttgcatccctagtaattttgatgtggttgcctaatattatgaattttaccttattgggtgttggtatatgttgtatttctataaatatccttgagctctcttctgggatgtagttaaagtacttggaaactgtttccctattttgttgtcttgctattaaactttgttaggcaagaccagagaattgtttattctatggttaattttttcctactactgttgcaaacacctgagtactatacttaatgctccatgaactgagagttttgcaacttgggaacaaaaaatattccctgctttacatgtgtgggcccctctaacccttttaggtggtgcttcacccagtctttagacttttctcttatgaatgcaacagatcaatattgagctgaagcctagaagtccatctgaagatctctggatctttctttctgtgtaactctgtcctctctgacgttcggtactatataccctaactacctcctgagactgtctgctttgtctcccaaactcagcgagaccactgggttcttgtagagttcctcctccctgagctttcatatagaaactaaactgagtctccactcagtctggtggaacaaatgtacaaatgtggggctaaacacttgtttctcatctctatgaaatcactgctctccactgaccaatataatttcttatattttgtcttttttttttacttatttcaggtgggtggaaaaatccaatccctgttaatacatggtggttagaaatagaagggcttttaaaattgtattttcataacaccttaaaaaacaaaagatgaatataaatttaaaaatttaagggcacagagcctgtaacttttagtttgcctaaataagataaacatacatttattgtttattgtatcccaggagctatgtgatatgagtacataagtgtttatacaatgaagaacataagatcactgtttctagaaaacagttatttcatcttatgtaagaagtttattggttcattattttttctaaataacaatagctattcaggaagctaatatctcactctcttctatattttagatgacaaatgagctccacatgcttaaaatcaatcaagtgatcacttgttcaacaggtacttcccacttgccagactatgagtgctcagggttatttacctagagttttagcagaaattacaaattgcttttcctaatagtttcctatcacaatttcctgtaattgtccttcctcccctgcttcttggctacattcatataaagaaagctaggtaaagtaaatacaaattacaactttctcttgttgtgaaaggaagtttcaggtggttcctgctcaatttttttacaccacttgaggcaaacagataatcccaaataaatgaaaacgtagtagacataatttatattagcactggaatttgatgttgtagctatgtgaacattattcaagatcttatatgtctcatttgagttatgtggttttaatctcgtttagcaaagctatttagtcaatgaagaaaggaaatctgtacacattaaagaaatgatctggtgctgatgtgagttttcaaaaaaattaagcatttttaaagagatatctgggctttccttttagtgtaataattttattctaattctagacttcccagaattaactttccttagtatgattttttcttaaggaacagctgaagaatgtgccaaatgaggaaagatgtttaatctgggggaatttggactagcctcaattcccataacaagagagatctgtttttctatatgtggtgagctctggataaaactcttttcaaggctttttaaagtttgcaaatattaataagagccctcaaaaaagcaaaaaatttctgaggtgccaatgtttgccatataactattctgtcaatattactctccccaccaccacttacctgcattcgatattatcatctaatacagagataaggaagatacaagtgaccatctagcttccctaataggtgctggaaacctcttttgtaaaagacatggggagaccatggatgatctccaagaatgtaagtgaaaaaatatctctgcaagtatatacttgcactttagaagggagcttataccttttttccagctctctcagaaccttacacaccaccatgaaagatatatttgagacctactttaatatacaaggataacagtatataaaactagaatcaaaaagtgccaatcaatgatatatcctgaagaagacaacacaaatattttaaagacagataaaacttcacatggggaggaagttggggagtggggaattaagatattctatggataaagaaatctccaataaagaagactttatatttttgaaagccaaggaagagattaaacaattttaagatctctttctgttctatcattatacttgaataagcagattcaattttaatatctttattaaagaaagatctctggatctttctttctgtataactctgtcctttaatgtctttaaagctgagcattaactatatattttttatatattaatcctttgaaagatatgaaaagtgtaccatgtgataaattttaaatcacttataaagtaatgaggatttgatgtaacttccaaaaatatcaaatctctggtcaccattcccagaaaattacaattgaatgagttaggtagggcattcaacaagaaaatatctgatttctgatgatatgatcatgtgttgggtaggactttgataagaaagagatgaatggcaatttagactaacttgtctttataaaaatgtacaataatgagcattaaatatgtgaatcaaagagtactatttattggattctgtgaataaagtggcaccaattacctgtcattctcaggacccatagttctcatccttcatgggttttcttctgtttggatggaagtgactgaagattaacttcttaatggctcctgggggatcatgactcagctgccaggacttctcgttcctttagagtgattcagaggagttgatcacgatgtcatctgggcagatggttgtagtcaccaacagctgtagttcctctcttgaaccaaactcagacccctcccagatacttgtcattagaagcaatcatgaattcttagctttttcacattaaggcttatttttattactaaaaatactctccttaataggagtgaaaacactgatcattatttgtcatgtttattgtacttacagataaaaattttagctaatatttgaaactataacatttttctaatcaggaagttttctaattcatcataaatctgaaaccaaaaggttctagaaatccagtctcaggtattatgagtgtagattttgccccctttttcccctaaatataataaagtaacatttttgtgagaaattcccatacctgggtgaacattttgctctccttttgccataccacaagttgagatcatcagaagcagaaagttgagaagtctccaatgtatttgcctaggcagagataaaatctgatggaaacaggccttcaggagaaatgaagaaactgacttgatctttttagctattaatccttaaaaatttttaaaaaggtaatatcaacctgaattccagaacctgttaggaaagtctcgtctttccatgtatttgcaaagcacatgtacctcccacaagatatcccattcattatgaattaatagattgattttaactaacaaattaattcatttaccaagagttacatagacaggtaggtagatacacaattaaaggagcaactcttcaggaaacagatgttttggtcctgaaataccatttgcttatctcactcaataacaggtacctagaagagcaaatacaaaaagcaggtaaaatagccaaaagtagccacaggtttctcaatctctctatatcattctcatttttaatatgtatggtaattataatagagaaatacacatttaatatattattctttttttttcctctcatgccaaaaattcattgtattatcttgcattcgttttttattccatttcctttcatttggagctactagttttgtagttgtgcagaattttattcttgaaaacctccgtttggttcagatatgtaatgctaacttttatttgtttttttcccctcttaaggaaatgacgataacataccataaagagctttgcttttaaacaaatttagttagtatggaaatcagtagttttgatgaagaaaggtgaattcattcaaagaaaacaatgtaatctttttctgaaaaaaaaaaaaaaaaacttacaaatttaactataaagtccagacaaaataattccattcatttttagagagttttagtagttatggacaactatacatagaacaggcatattaaaatactattcattactataaaaagaaacattggcattatttcctttattatgtgtttcttttttatttcaatgtgttcgttgtattcttagtagtggagatctatagtatatcacattctcttcagatttcaattgcaaattttaagaaatgtgtttacatgtttacatttgccctgttcttaattttctaatgatctcttctcccccttcccccttattgcctctcagtttcacttctccacttccaggactcacattcctctcttaattggcaataaatattaatatttcctgttatttggtaggagaaaattatttttacctatcaaaaacataaacaccaaaaatgattttgttttaattaaatttcttaactttggctcaaaacattacataaaaatttgttttaattaattttctttaatttatttttgttttaattaagtttaaatatgtttcttaacttttgctcaaatattaaatacacatttcctagttatggtttaatgaaatgttaatttctagagattgtaagtaatctgaaatttactttaggtgataaaaaggaaaatatttgtgagaatagcgtgtcttttgaagctttgcagttgccctttccttgaatggtcacattcctatgtctgagttgaaacattgccaatatgtaaatgtaagactctggggtgaaaaaatcaatttcctgagcttcagtttttgtatttaaaaaatctggatatttcagatacttatttctatgattgtttttagctctagcagtgtataaatgtgtgacctcatctccattttagctttaaaattatttaaataaatagtttgcatatgctatatgctattgtgttgtaacataaaaatatatactcattttgcctggtattgctatttcctctccaagggattttcttttaatactatgaataacaaaaatattaattctatacagtgaacagttttattcttggaagagacttccctcctttaaaaaactatgtacaattacttttgtacttaaaagagtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgtctcaaaaaaaaaaaaaaaaaagaagatgacgtaatgggtggtggttgtgatgttaaagatgtcaggaattctctgaataagcatgttgaatacaaaacatgtttattcagtttgaggataaactagacactgctttcacattaacaatccctcctctcctccaccatttcttttttgttgttgtctgatttggaataagtcacatctagccttttgaaaacaaatggaccaattttttttctagctctctatctactttcatcaaactttatctgaagggattttctacttctagaaaaaaatcacaaatgttggagtttccaatcgtggattaaattttgctgaggaaaatgcactaaggttacacactatctgctgtatttacacattatcttcactcgtaaacacaaataggcttaatagcctcatttaacaaatggaaaactgaatcttatagatggttagtgtgtttttccattaaaaagttggtaaacttcgatctttttttatgcctttcctatgtccattctatccatctcattttttcacactaccttgtcctacatataaaataacatcaatatatttatttgctccatctcattttaattcttaagttattttgaaagaaaaaaagagtgtacaagggcacacctagaactttattatcactggtccttactttgcattctcacactctgtaaaatatttctctaatgtactcacagacattatactgtccacagtagcagccccttaatgtttattgaaatccatatgaacaattgataaagtttgaaagaacatacacatacacacacacacacacacactctatttaggcaaaggtacaaataaataaacactttcatatgctcataagaaaagtgtatgttgatattatatctctgaatgacaattttcaatatatattaatattattcaaatgtttaaatattagacccaataattcttctcctgtgaatttaccataaataagtaactttcaaagttttgaaatattagactacaaacacacttttgcatgaatacttacaattgcaaaaatagatattgcccaaaaatatgagaatggtaacataaatttttaaatatccaaaaaatattatgcagccattaaataaggttatgcaagtcagtttggaaagttattaattttttaattttactttaagttctggggtacatgtgcagaatatacaggtttgtaacataggtatacaagtgccatggtggtttgctgcacccatcaacccatcatctacattaggtatttctcctaatgctatccctcccctagtcccacgaacccctgacaggccagggtgtgtgatgttcccctccttgtgtccacgtgttctcattgttcaactcccacttatgagagagaacatgcagtgtttggttttctgttcctgtgttagtttgctgagaatgatggtttccagcttcatctatttccctgcaaaggacatgaacacatccttttttatggctgtatagtattccatggtgtatatgtgccacattttctttatccagtctatcattgtcaggcatttgggttggttccaagtctttgctactgtgaatagtgctgcaataaacatacttgtgcatatgtctttatagtagaatgatttataatcctttgggtgtatacccagtaataggattgctgagtcaaatggtatttttggttctagatacttgaggaatcaccacattgtcttccacagtggttgaattaatttacactcccaccaacagtgcaaaagcattcctattactccacatcttctccagcatctgttgtttcttggctttttaatgattgctattctaatgggtgtgagatggtatctcactgtggatttgatttgcatttctctaatgaccagtgataatgagcttttattcatatgtttgttgattgcataaatgtcttcttttgagaagtgtctgttcatatcctttgtccactttttgatggggttgtttttttcttgtaaatttgtttaagttctttgtagattctgaatattagccctttgtcagatggatagattgcaaaaattttctcccattctgtaggttgcctgttcactctgaagatagtttcttttgctgtgcagaaactctttagtttaattagatcccatttgtcaattttggcttttgttgccattgcttttggtgttttagtgatgaagtcttcggccatgcctatgtcctgaatggtattgcctaggttttattctagggttttatggttttaggacttacatttaagtatttaatgcatcttgagttaatttttgtgtaaggtataaggaaggggtccagttcctgttttctgcatatggctagccagttttcccaacacgatttattaaatagggaatcctttccccattgctggtttttgtcaggtgtgtcaaagatcagatggatgtagatgtgtggcgttatctctgaggcctctgttctgttccattggtctttatatctgcttttgtaccagtaccgtgctgttttggttactgtagccttgtagtatagtttgaagtcaggtagcgtgatgcctccagctttgttctttttgcttaggattgtcttggctatatagactgttttttggttccatatgaaatttaaagtagtttgctttttctaatatgtgaagaaagtaaatggtagcttgatggggatagcattgaatctataaattacttaggacagtatggctattttcatgatattgatttttcttatccatgagcatgaactgtttttccatttgtttgtgtcctctcttatttccttgagcagtggtttgtagatctccttgaagaggtccttcacatctcttgtgagttgtattcctaggtcttttattctctttgtagcaactgtgaatgggagttcactcatgatttggctgtctgtttgtctgttattggtgtacaagaatgcttgtggttttttcacattgattttgtatcctgagactttgctgaagttgcttttcagcttaaggagattttggactgagatgatggtgttttctaaatatacaatcatgtcatctgcaaacagagaaaatttgacttcctcttttcctatttgaataccctttatttctttctcttacctgattgcccttgccagaacttccaatactatgttgaataggagtggtgagagagggcatccttgtcttgtgtcagttttcaaagggaatgtgtctagcttttgcccattcagtatgatattggcagtgagtttgtcataaatagctcttattattttgagatgcattctatcaataccaagtttattgagagtttttagcataaagccatgctgaattttatcaaaggcctcttctgcatgtattgagataatcatgtggtttttgtcattgattctgtttatgtgatggattaagtttattgatttgcatatgttgaaccagccttgcatcccagggatgaagccaacttaatggtgggggataagctttttgatgtgctgctggattcagtttgccagtattttattgaggatttttgcatcgatattcatcagggatattggcctgaatttttctttttgtgcatgtgtctctgccaggttttggtatcaggatgatgctggcctcataaaatgagttagggaggagtccctctttttctattgtttggaatagtttcagaaggaatagtaccagctactctttgtacttctggtagaattcggctgtgaatttctttggtcctgggctttttttggttggtattctattgattactgcctcaatttcaggacttgttattggtctattcaggcgtttgacttcttcctggtttagtcttgggaggttgtatgtgtccaggaatttatccatttcttctagattttctagtttatttgcttagaggtttttatagtattctctgatggtagtttgtatttctgtgggatcagttgtgatatccactttatcattttgtattgtgtctatttgattcttctctcttttcttcttcattagtctggttaacggtctgtctattttgttaatctttttaaaaaaccagctcctggattcagtgattttttgaagtttttcctgtctctatctccctcttttctgctctgatcttagttatttcttgtcttctgttagcttttcaatttgtttgctctagcttctctagttcttttaattgcaatgtttggttgtcaactttagatctttcccactttctcctgtcggcatttagtgctataaatttccctctaaacactgctttagctgtgtcccagaaattttggtatgttgtgtctttattctcattggtttcaaataacttatttatttctgccttgattttgttatttacccagtagtccttcaggagctggttgatcagtttccatgtagttgtatggttttgagtgagtttcttaatcctgagttctaatttgattgcactgtggtctgagagactgttataatttccgttcttttgcatttgctgaggagtgttttgcttccaattatgcggtcaattttagaataagtgtgatgtggtgctgagaagaatatatattctgttgatttggggttcagagttctgtagatgtctattaggtctgcttgttgcagagctgagttcagctcctggatatcctttttaactttctgtctcattgatctgtgtaatattgacagtggggtgttaaagtctcccactattattgtgtgggagtctaaatctcttcgtaggtctctaataacttgctttatgaatctgggtgctcctgtatttggtgcatatgtatttaggattgttagctcttcttgttgcattgattcctttaccattatgtaatgcccatctttggctctttcgatctttgttggtttaaagtctgctttatcagagactagcattgcaacccctgattttttttatttttttatttttttttttgctttccatttgcttggtcaatattcctctatccctttactttgagtcaatgtgtgtttttgcacgtgacatgggactcctgaatacagcacaccaatgggttttgactctatctaatttgccagtctatgtcttttaactggggcatttaacccatttacatttaaggttaatattgctatgtgtgaatttgatcctgtcattatgatgctagctggttattttgcctgttagttgatgcagttgcttcatagtgttgacggtctttacaatctgttatgtttttgcagtggctggtaccgattgtttctttccatatttagtgcctccttcaggagctcttgtaaggcaagcttggtggtgacaaaatctctcagcatttgcttgtctgtaaaatattttatttatacttcacttatgaagcttagttttgcttgatatgaaattctggcttgaaaattattttctttaagaatgtggaatattggcccccactctcttctggcttgtaaagtttctgcagagagatccactgttaatctgatgggcttccctttatgggaaacccaacatttctctctggctgcccttaacattttttccttcatttcaaccttgttgaatctgatgattatgtgtttttgggttgcttttcttgaggagtacctttgtggtgttctctgtatttcctgaatttgaatgttggcctgtcttgctaggttggggaagttctcctggataatatcctgaagagtgttctccaacttctttccattctccctgtcactttcaagtacaccaatcaaatgtgggtttggtcttttcattcagtctcatatttcttggaggctttcttcattccttttcattcttttttttctctaatcttgtcttcatgctttatttccttaagttgatcttcaatctctgatatcctttcttccactagattgattcagctattgatacttgtgtatgcttcacgaagttctcatgctgggtttttcagctccatcaggtcatttatgttctttcctaaactggttattctagttagcaatttctccatacttttttcaaggttcttagcttccttgcattgggttagaacatgctcccttagcttggaggagtttgttattacccaccttctgaagccacttctgtcaattcatcaaactcattcttcatcaagttttgttcccttgctggcaaggagttgtgatcctttggaggagaagagatgttctggtttttggaatttccagcctttttgtgctggtttttcctcatctttctggatttatgtacctttcgtctttgatgttggtgacgtttgtgtggggtttctgtgtggatgtcctctttgttgatgttaatactattcctttctgtttgttagttttccttttaacagtcaggtccctccgctgcaggtctgctggagtttgcttgaggtccactccagaccctgtttgcctgggtatcaccagtggaggctgtagaacagctaagattactgctattccttcctctggaagcctcatcccagaggggaacccaccatatgccagctggagctctcctgtatgaggtgtctgttgacctttgctgggaggtgtctcccagtcaggaggcacgggggtcaggaacccacttgaagaggcagtctgtctcttagcagagctcgaacactgtgctgggatatccgctgctcgctccatagctggcagacacgaatgtttaagtctgctgaagctgtgtccacatccaccccttccccaggtgctctgtcccagggagatgggagtttgatctataagcccctgactggggctgctgtttttctttctgagatgccctgcccagagaggaagaatctagagaggcagtctggctacagtgggtttgaggagctgtgctggaacttccctggggctttgtttacactgtgaggggaaaaccggctactcaagcctctgtaatggcggatgcccctcccctgacaaagctggagtatcccaggtcgacttaaggctgctgtgctaggagcaagaatttcaaaccagtggatcttagcttgctgggctccatggggctgagatccactcagctagaccacttgcctccctggcttaagccccctttccaggggatgatggttctgtctcactggcattccagacgccactggggtatgaaaaaaaaaactcccgcagcttggtaggtgactgcccaaaggctgtccaatttttttcttgaaacccagggcctcaatggcgtaagcacgcgatggaatctcctggtctgcgggttgcaaagaccatggggaaagcgttgtatctgggccagaatgcactgttcttcatggcacagcccctcacggcttcccttggctaggggagggagttccctgaccccttgtgcttcccaggtgaggcaacgcagcaccctgcttcggcttgccctccatgggctacacccaatgtctaaccagtcccaatgagatgagctgggtacctcagttggaaatgcagaaatcacgcaccttctgcattgatctcactggaagctgcagaccagagctgtttctattcagccatcttgcctgcaactcaaaagttatcaatattatctcattcaatgacaaaggaggttaccaaacaatatatgtgcaatgatcattcacatatgctcatataaatataatcacacatatacacacacttatacatattaacatgcataagaaatcatatacaaccagaggttgcttctgaataggcagattgatggttattctgtattttctttattctgctttatgttttatgatttggaaaaatacacatgtattacttttccagtgtaaaaagacagttttaatattttaaatactaaaagaatagaacagttagttaaatatgtagctaaaaataaatagaatcctccaattttgaaaaaaaaattttaaataaaagcagttggtaagaaatcttcattctctcaatcctttctacctttggaagaaagtatttaagtgtattataaaaggtcatagaaaaattttatttaactataatgaatacaattttaataatatcaaatagaatgctgtctttagacatgtcaatgtatcacttacatgaaaaataaactatttttgtaaatggcatcaaacataaataaaatggtcaatttctaggtgactgcattggtaaaccttttttaatttttcccattgcagagatgaggaaaaataaaatttttggttgacatagaacttgtacgattatcatgatcatataaatcatatcaaaagaggaatatgctatcgatatttttaaatagaaaaattgatatgaaaatttatttataatcaaatggttgcaaaaaaacagaaaaatttctgtgaatatttttctgttattgacacttgtaataactgtaaaaagaaacgaattattacatcaataaggtgctgataaaatacatcacattttaatgattcattgtcggactgaattcattcagacacaataaacattttatataataagaccttgaaagcacaatttggaattctttggtagaatatagagtatattagagactctacagtcatgagctaagccagaaactaaaatataaacaactaagtttactgcagcagcctctctagtactggccctctgtagaactctataccacacacctttctacagacagtagttagcctgagtctgtaaaggtattgactccttggcaagtcagttgtggccagatgctgctgtgactccattactgtccatttaatagaagttttgagaatacattttatgagtacagaatatggacaggttttgtgagaaacaaaggtggaagaaaggaaaaatgattagttaagtaataattgtcttccctaataaaggattagtttatactcgaggcccattacccattatattcacttttattcataccatttaaaataattttagcttatatatttgttttaaatttctccagtgaccttttactttctgtaaaaaaaatacaaaataaaacaatttttaccgaatttttaattcataaaagatttatttcacaaatatccattgagttccagagggtaccagaaagaacaaacatgattcccatatttaaagagcttacatttgagagaaaagacagagtaagcaaataaatatataatgtgtaacacaggaagaggtacagtgatttaaaaagcataggaaggaagagaacgtaaccatcaagttattttacgctctgaaagacaccacttgagtagagattttatatagaagcaatatttccattccattcatgtgattaagtcaggggacgatgccaaaagtgaagagataatgttgacaatatgggtaggatttaccaggttttctctctgctgccattgggaatgtctttccaacttttttcatattcatgataataactgatcattttcctaaaatcttgtggtaaatattacatatttagattagggcccttagaatgtttagtatgcgaattttattgtgcgcaattttgaaaaagatctccaatttcaaaacaagccttctgggtactttcatagttagtctgcacaactaactgaatcagaaaacaaatatattactcaatttcaggttacaagaattgacctccagggcagtgccttctgctctcttacatgtgatttgcaattacagttgagaaataagggtagagaaggaattcgaaggtgaggatctgttttccctgccaagtctttccttcttattgtgagcaaaaaatacactttctcattggagaacacttacagaaaacagtcactttcccagaccagtacttcactcttaaggaacaaccaaaaacaaacgaataaacaaacaccatagtttgggcaaattatcataaaatgtacaacataagaagttggcgattgctgtattttcaatagaaatgtgattgatatgaccagtcctgcctaaaggttagtaatgccgcaagaaacagagaatcaaagtctatagctatgtggaaaggaaagaattgaattgcacattagaaagtgcactctagggctgatgtatcttcagctccagcctactgatagaaaggcagtgacccccacttccaagacaaacttgcaaccaagttagagacactttcttgaaacactaggaatgttcctgctctgagttgtgtttccccaaaatgttggatacctaacccccaatgtgactgcatttgaaggtaaggttttagggggtaattaacataaatgagataataaatgttcaatcctaattcagtaggattgatggccttaaagaaggccttagagaaaagatatctttctttctctccatgtgcacacaggacaggaaaggccatgtgaggacatagggagaaagcagccaccattggcaagccaagagagagccctcaccaggaacgattggaccagcaccttgatcttggattttctagcctccagaactgtgagatacaaatttctgttgtttaagccacacagtctgtgatattttgttacagcaaccctaatagactgagagagctcctgagagcttcactcacagaatcaattgtattcttacctggtgaagatccattctaagacttattggctgtttggaagtgatagcaaataaaagccaccttgaactgggtctgatgcagcattcttaccaaacttcaaacctggactagttcatccttatgcattgaggcttttttattcgtgttcgtttgtttttaccagttaactatcaacataaatttcatttataatattgtatgttcagtgttccaaaaaactggtcctaccaacatagtttggaatgactccattataagatggtgactgcctgtatcaaatctttactgcctttttcaaattcttaccatttttataaaaaggagtcacactactcaatctatacatcagtgttaaatatgatttttactaatttttttttttttttaccaacactatcttaaaaaatctgacagcatagagcagtgattaaaggcatttgcttcagggtcaaatatagttacactgctgttttttggacaatttgttattttgaaccattgtttcttacctttataaaatgagcataagataatgttcttttaaggtgagtatgagatacaaatgagaaaagcaataataataaagattcaacaatggaaactgctatttacattatgattgttataattagaaggacaaactgtaatttaacgttcctatagtaataaaatggcatctacagagcaaatctaaacagacttaatcttcatataacaattcatcccagataatttgaattgaccataataacatgtttgaaaggaggctgaaataaaacagggtttgctcttttcaactctttagccaagactttttttaaaaaaaactggtatataaatgctttgtatttcctttcaagtttgaagggaaaataaatataatacttaatagattttcaagtatctctttagacattctcttgtttaggcttgtactaatccattcattcagggtttgactgttgggtgaacttctttgccctattcccagctgtgagaggcaattctccaggtttctaagctttagacctacgcccttctctgatgaggttaattagggtttgggctgaaacccagattcctatatatgtggatagagtgatgtagaagtactttatgataataaatataaatgaaatttagattttaatttagaaatagaaaacatttaggcaactcactgaatcaaaaataaatatagacaaatttaattaatatatttatttattatattttcctgggttgggctttggcctctatttcatatattttgtttatttttcaggatgttctgggataatgtagtccaggttctagttctgcctttgtcacttactagccatctagtcatataatgctgaaaaatatattatgtagctctaagataaattcaacgtacctgcatagcactattcaacatacttgcacagtattattgtcaatatgtagtctaacagataagaaaccactgtgaaaatagtaaaccattataaaaaatgatgttttataatgatacatctttgcacttctaatattattgctttaaataaatgtggtatatattcagcatacagccaaatttacaaaattttatctttttaattttatgtcatatataaagaaccttaatgccaaaataatctttatagtgatgactcgacatcccaaaaatgtgggacccaacagggacattaataaagagataaagcaggctctgtgccgacttgttagaatttggtacgtggcaaatgtgcagtcacacggccttaaacctcccctgggaaactgctcaaacatttgcattcccacaatgtatttattcaggaaatactcttttcctgagaaaaatctggctctcaaacctctccctgagattatgcaagttctccattggggaaatacagttggaaatctagtaaagaatgtttattaacaaaaatccatttgcagatcctagttattctcaatattttgtggatttacaattgagaatactacttgcaaaaagtaaacttcaaaaaaaggaaatagaaagctatcagaattcctgtagagtttgttgttccccttctcctccaacatagttttattctaatgttttctttattcattttctttggtattagtgtgctgtaaactcacccaaaatgaaaaacaatcaaaataaaataaaacaaaatgaaagcacatcagttaaagataaaacaaaacaaaaaacaggctgccaggttttagtggacagaagggtaggccccctggagatcagccaaattgagtggatggaagtaatcaacaacaagaggacaacaacattagccactgctgagcagaaaattagaaagattcttcaatttatttttttttcttttctggttgtcaggttttgtctctcctgtcttccactggtacaccataaatcagcagctaaaatgaaatttccttcttttagacatggcaaagtactcattgagcttagagattaatagtaaaactttaaaaaagaaaaaaattcaacaatatgtaataaagagaaaaatctgaactagaaactttagataagtaccatgcttttagtatacatgttagcaccataaatttttttctagattcacttaaagatgataaaataatgtgtataccccaaaactaatgataaaacagatcaataactgcctgctagttgtatcatgcttttcccaaaataatgaactggaaatttaatgttatgatttaatcctattactctctttaattctatgtgagcttcttgctcttttttttcatcccataaatttcatttttgtcaatatctgttgctattcctttcgaggttttttcttctggccaccaaagccaaattgccaaaatattttagctccaatggatctgaatctttagaacatgtcttttacattgagacctgtactgcttcaccttaccacttgtagtctttcaaatctaagctcccatgcttaaccaaattcaaacaaaaatgtctctcggtttgatcctaaactctttccaaatcagtgctatttttcagttatatttttagaccttcaaaaagtctgagatgacattctcaatgcagaataagatctataaatactgagcttctgtttctacagtgtacccaagaggttttcaaggattgcttataaaaattataatagctaacattatcaagctagtcactattctaattcttttatatttaatcctcataatactatgtagtaggttctagtaaaatactcattttatagataagtaaatagagacaaataggaagtaaatatagtatcaaattcatataattagtaagttacggaactgatatttgaagctttatagtctgttttagttggctagggctgccataacaaagtgctaaaaatgaatagtttgttatttcctcatggtcctggaggctataagtttgagatcaaggtgatcagtaagattggtttcttctgagccttctgtccttgatttatagatgttcagtctttcctctatgtgtcctaatctcctgtttttataaggataccagtcatattggattaggactcaacaacaatgacatcatttattcttagtaacctctttagaggccttgttttcaaatacagttgaattctgaagtactgggagttaaaactttaacatataaatttgaaaggggacacaattcagcccctaaaacagtcttactacaaaccccctcttcttaaccactaaacgaacttaaaaaagaaaggaagagctgagaaagagagagggaaagagggaggaaggagaaaaaaaggaagggaggaagggagaaagaaaggagctacttgccaagcaaaccagaataattatgaagacaactggaggcagaatgctttccagatgatgctggagacaaagtaattattgggaagtcagctttgtatggtgaagtgtccatgaattctggactcacagagttatgagtgcaaatattactctgttttatgctacttggaaggttatattccctttatgaacctcagttttcttaagatgcacatcatacttcttataggttagggctattagggggattatagttcatatgaagttcatagaagagttcataaaaagtgaaagtctcaaaggtcttccttttttctttcctttcctttcttgtgtcctctcttagtagattcaatacagaacattgacctctctttcacatattctctcataaatattaatattataaagaaagagtaaaatagcaaattatgcatttcttctacctaattatctcttttctaagcccacctttctttagtcatctttcccacagactcacatttctcttttgctggaatttcagcaatcattcttatctgttttctttgacttgaaaaatacctatcatttcagcaaaatttaaaaaatgttaaatctatgtcatttgtttcattttcattacagattctttaaaacaattttaattgaagtatttcatacctttaaaaaatgaaaagcaatacaagacacaattttaaaaatatttatggcaccatttcacaatacttgtttctgatctctttattttttggtggaattggtagtaataaaacaccatgcatatatccaaagatctgtactgccgcctaattttaactcacaaagtttattctaatttattaattattcatcaagtattacttgtatcagtcattgtttggggtattgaacacagagttgtgaatcctatgtaaagtgcctgtgctaagaatagaaaacattttagtggtggagacagcacacataaatatataaatgcacataaatatataaatggtgatgagtgtcattcaaaaaagaaaggaagacattactggtatgaaaggaaaatggtgcagctactttggaaagcagtctggaaattcctcaaatggttaaacatagaattgccatgtgattcaagaattttaccccgagttatatacccaagagaaatgcaaacctatgttcacaccaaaacttgtatacaaatgttcatagcagcattattcataataagcaaaaagtagaaacagcaaaaattttcattaactgatgaatgaataaataaattttggtatatttatactataaaatattttcagcaataaaaagaaagcaatcatatatgctacagcatgaatggagcctgaaaacagtatgctaagtgaaagaagccagacatagtaggccagatattatattattccatttaactaaagctttcagtattggcaatacatagagacagaagccaaataattgtttcctactaatgtagagatggagaactttaagggaagagggtgaagcctaaagggtggagaatttccttatgggggaatgaaaatattctaaaattgactgtaataatatttgtacaaaattgtgaatgattgaattacttaaaaactatagatacagtaaaaagatcagtaacttcaaagggaatagaggagggaaggaggaggatgaatggatgaagcacagagaatttttagaggaaaatattctgtatgatactacaactattctgtggatatgtgtcactatgcaattgttgaaacccatagacagctacagcacaaagagtgaaccttaatttatacaatttaaaaaaaataaattaaaaggtcaggaatttggaaggaatgcagactgtgacaagaaaatctcactctgctatgaatgtttaaggcaacctcactgaaggagtttgggggtggaggagggctgaactaaataacattgaaaataagtggagcctataagtctaaaggtaaaaggaactgcacacagacactgccctctagttaataaagctgtattccatggacatatgggttaacaatattcctattgctatacatgtatattttaattgaacaattaattaaagagttggtggatagtgatagttgagtttcaagggctaaaataattcatgtgttgaacacatgcataagaactcatgtttcacttaaacaaagttggttccttatttatttatgtatttatttatttcactgaagtttttaaacaacttcattgagatataatcactatttaaaaactgcacaaactcatcaaattttagacagtaatatgtgcagttccttgtatagtgattgtatctcagtgaaacatgcacattttttgttatgtaaaatttgatgagtttgtacatatgcaaataaatacccatcaacacaatcaaaataatagacatattcaacaccttccaaagttttgttgtgtctctgttttttattatttattatttatttatttatttatttatttatttattttgagacacagtctcgctctgtcacccaggctggagtgcagcggcacgatctcggctcactgcaatctctacctcccgggttcacgccattctcctgcctcagcctcccgagtagttgggactacaggcgcccaccaccgtgcctgggtttttttttttttttttgtatttttagtagagacggggtttcaccatgttagccaggatggtcttgatctcctgacctcgtgatccacccacctccgcctcccaaagtgctgggattacaggtatgagccaccacaccccgcctttttattttgttttcgttttctgtttgttttgtgataggaagacaaaatagatctgccctcttaagaaattttgaaacacaaaataccatgttgttaacaataaacaatatgttgtacagcagatctctagaatttactattctagcataactaaaactttgtacccattgaacaacaagcactctattttccccactctccaggccctagcaaccactattgtattctcttcttctatcagtttaactattatagttactacctgaaaatgtaaaacttctagacaaaagcataggggaaaatcttgacattggtcttggcaatgattttttgaatatgagaccaaaagtacaagcaacaaaagcaaaaatagacaagattacatcaaattaaaaagctctgcgtggcaaaagaaacaatcaacagaataaaaagacaaactgaaatgagagaacatattttcaagtcatatatctgataatttccaagatacataaggaactccttcaactcaatagcagaaatttttaaaaaatgggcaaaggagttaaacacatttttctccgaagaagacgtacaaataagatatataaagatgctcagcagcattatttaccaaggaaatgaaaatcaaataataatgagatatcagtttatgcctgttaaaatggctatttttctaaaaactcgaaatgtaacatgttggcaaggatgtgtggaaattggaatgctgggcctggtgcagtggctcacgcttgtaatcccagcactctggaaggcagaggcaggtggatcatgaggtccgcagttggagaccagcctggccaacatggtgaaaccctgtctctactaaaaatacaaaaattagccaggcatggtggcaggcgcctgtaatcccagctactcgggatgctgaggcaggagaatcacttgaacccgggaggtggaggttgcagtgagccgagactgcacctttgccctctaccatgggtgacagagtgagactctgtctcaaaaaaaagaaattgaaatgctggcaaattgttggcggggatgtaaaatggtagagtagctatgggtattaatatgaaggtttctcaaaaattaaaaataaaactgccatacaacccagcagttctacctctgggtacatataaaaaaagaattaaaatcagagtcttgaaaagatatctgtattcccatgttcactgaggtattactcacaataaccaagatatggaaacaattcaagtatctttttaaaaatgaatgaagaaatgtggtatatacatatatacagtgaaatattattctgccttaaaataggagattctgctatttgtgacaacatggatggtatactaagtaaaataagccagtcacagaacatattgatgtatttaaagatagtatacctttacagataggatagaatatacacatatattcctttaatctgccaaaaagaaggcctaaaagaaatgacatcccaataacaatgagcatgcctagtgcccagatctgggtttctaataccaatctctagtagaaggaatcagggcttcttggagaaatgtctgtgattataagagtggggcataaaatatacaatatgagactggggcatctagtagtgacaaaaagtaaggcactcagaaaaaattaaaaactcatattgatggagctatctcaaagaagtacaggagccaactgaatgctctctcaaatttgccaaagccaggagaccatttgagcaacaatgtaagtaaagtcatagtgaattataacataaagtatagaatatatatccatgagtccatacttatataaataaaggattaaataatttaatacagagagacaaatatctggtgcaaaagtattccgaacaatttatatagatactctcaccttaaggatagggaccataattctccattcttttaaagtgctggctatatgtagtgactttcttccaaagtacagtacgggtggctggcaagatggccgaataggaagagctccagtctacagctcccgcagagatcaacgcagaaggtgggtgatttctgcatttccagctgaggtatctggctcatctcatcgggactggttagacagggggtgcagcccatagagggcaagccaaggcagggtggggcattgtttcaccagggaagtgccagggattggggaactccctcccctagccaggggaagccaagaggaactgtgccctgaggaatggtgcactctagcctagatacgatgcttttcccatggtcttcacaacccacagacccggagatttcctcaggtgcctaccccaccagggccctgggtttcaagcacaaaacaggaagccatttgtgcagacaccaagttagctgcaggagtttttttcataccccagtggtgcctggaatgccagtggacagatctgttcactcccctggaaagggggctgaagccagggagccaagtggtctagctcaacggatcccaccacctacagagcccagtaagctaacattcattggcttgaaattcttgctgctagcatagcagtctgaagtcgccctgggacgcactagcttggtagggggaggggcgtccaccattactgaggcttgagtagctggttttcccctcacagtgtaaacaaagccccagggaagttccaactgggcgaagcccacaacagctcagcaaagcctctgtaaacagactgcctccctagattcctcctctctaggcagggcatctctggaaaaaaaggcagcagccccagtcaggggcttatagatcaaactcccatctccctgggacagaacacctggggaaaggggaggctgtgggctcagcttcagcagacttaaatgtacctgcctgccagctctgaagagagcagaggatctctcagcacaccactcgagctctggtaagagacagactgcctcctcaagtggatccctgacacctgtgtctcctgactgggagacaactcccagcaggggcggatggacacctcatacaggacaattccagctggcatctgccaggtgccctctgggacaaagcttccagaggaagtaacaggcagcaaactttgctgttctgcagcctctgctggtgatacccaggcaaacagggtctggagtggacctcaggcaaactccagcagacctgcactgcagcagaggagcctgactttcagaaggaaaactaacgaacagaaaggaatagcatcaacatcaacgaaaaggacatccagacagaaaccccatctgaaggtcaccaacatcaaagaccaaaggtaggtaaatccatgcagatgaggaaaaaccagcgcaaaaaggctgaaaattcccaaaaccagaacacttctcctccaacagatcacactccttgccagcaagggaacagaactggacggagaatgagtttgatgaattgacagaagtaggcttcagaaggtggataataaactcctccaagctaagggagcatgttctaacccaatgcaaggaagctaaaaatcttaaaaaaaagattatagaaattgctaactagaataaccagtttagagaagaacataaatgacctgatggagctaaaaaacacagcatgagaacttcgtgaagcatacacaagtatcaatagctgaatcaatctagcagaaaaaaggatatcagaggtagaagattgacttaatgaaatgaagtgtcaagacaagattagagaaaaaagaatgaaaaaggagaatgaacaaagcctctaagaaacatgagactatatgaaaagaccaaatctacgtttgattggtgtacctgaaagtgactgggagaatggaaaggagctggaaaacactcttcgggatattatccaggagaacttccccaacctagcaagacaggccaacactcaaattcaggaaatacagagaacaccacagcgatgctcctcaagaagagcaacccaaagacacataatcgtcagattcaccaaagttgaaataaaggaaaaaatgttaagggcagccagagggaaaggttgggttacccacaaagcaaagcctatcagactaacagcagatctctctgcagaaactctacaagccagaagagagtggggccaatattctacattcttaaagaaaagaattttcaacctagaatttcgtatccagccaaattaagcttcataagggaaagagaaataaaatattttacagacaagcaaatgctgagaaattttgtcaccaccaggcctgccttaaaagagctcctctaggagcactaaacatggaaaagaacaatctgtatcagccactgcaaaaacataccaaattgtaaaaaccaacaacactctgaagaaactgcatcaactaaaagtcaagataaccagctagcattataatgacaggatcaaattcacacatagcaatattaaccttaaatgtaaatgggctaaatgccccaattaaaagacagagactggcaaattggatacagagtcaagacccattggtatgctctattcaggagacccatgtcaagtgcaaagacacacataggctcaaaataaaaggatggaggaatattgaccaagcaaatggaaaccaaaacaaagcaggggttgcattcccagtctctgataaaacaggctttaaaccaacaaagatcaaaagagccaaagaaaggcgttatataatggtaaagggatcaatgaaacaagaatagttaactgtcctaatatatatgcacccaatacaggagcacccagattcataaatcaagttcttagagacctacaaagagatttagactctgacacaataatagtaggagacttaaacaccccactgtcaatattagacagatcaatgagacagaaaattaacaaggatatttagcacttgaactcagctctggaccgagtggatctaacaggcatctacagaactctcaaccccaaatcaacagaatatacattcttctcagcaccacatcacacttattttaaaattagccacataattggatgtaaaacactcctcagcaaatgcaaaataatggaaatcataacaaacagtttgtctgaccacagtgcaatcaaattagaactcaggattaagaaactcaaaactgcacaactacatggaaactaaacaaccttctcctaaatgactactgggtaaatataaaaattaaggcagaaataaataagttatttcaaaccaatgagagcaaagacacaacatacaagaatctctgggacacagctaaagcagtgtttagagggaaatttatagcactaaatgcccacaagagaaagcaggaaagatctaaaattgacaccctaataccacaatttaaagaactagagaagcaagagcaaacaaattcaaaagctagcagaagccaagaaataactaaggttagaaacaagtgcttggtgctgcgaagaaaacgtgtgctcaataaaagattacttagtaaggcaattttacttttgtagtgtagcaggacgagccacagacaaaactcctcctcagacaccaggttaaagaaggaaggagctttattcagcctggaacttcagcagacttgcatctcaaaagccgagctccccgagtgagcaattccagtcccttttaggggcttacaactctaagggggtccgcgtgagagggtcgtgatggattgagcaagcaaggggtacgtgactgggggctgtgtgcactgataatcacaacggaacagaacaggaaagggattttcacaatgcttttccatacaacgtctggaatctatagataacgtaaccggttaggtcaggggtggatctttaactaccaggcccagggcgtggcactgggctgtctgtcggtgaatttcatttctgccttttagtttttactttttccttctttggaggcagaaatgggcataagacaatatgagaggtggtctcctcccttatccccctctctttgagaacctctctcattagtgggagttctcactttcatcctcactacccatgtcttcttgcaagacagatcaatagtgattcatatagtatacttgtgctgaagcattttggtgaactaaggtagtgatgaagttttttattacttgaaggagtacaggtagcaaacaagggagtagtaagcaggttcctattactattataatttttattataagagttttaaatccttttagtgctggaaaccatttccaaccatggccccaggattaaatccatgccacacttgcaagggcacatgtgccagttttgtcatatctttaactatgtcttcaactacttgcccttgatcatttatgtgcaaacagcaattgtttaggttaaattttccacagactacttcttcagctgctagcaagtagtctagggctagtctattttgatagatagcatttctcatctgggtttttgctgggctaaaacagttaaagctctaccagttttattagttattatttttaagacagcttttaactgtatgattcggttgagcatataaatgggggtttggtatccccactagccgtcttgtgcctaagtggcaggcccatagtactgcatgatttttttcagggggccactcatcatctttccagctgcctatagctatgcttctcttttctcgggaagcacagactgggaagcctagaagtgtgcctgtttttatgggcactaggaaaaaggatgggttatagcacacatcaggctggtcacttccagggctatataccttgtatagaatagcattaaacaaacaagctccttttagagtcctggtacacttataataaccataaaataatagaactgtagcaaccttttgtcctaccgcagtgacttgacgtatatactgggaacagtcctcagtctgggaaaggtcagttgaagtccttactgtacaagtccaaattttaaggaaaatgagtcccatgatgagtttcctcatgcttcggctgtgcgtggaccagtcagcttctgggtgtgactggagcagcgcttgtcatcttcttcagagtcactttgcaggggttggtgaagctgctcccgtccacgtgcagctaccagtctactgatgttcaaggatggtctcagaggttgggcctgctagaataaactgagtccaacacctctacacagttatgtttaactgggctctctgatacggggagcaaggtggtggggtttagggtgttgcaaacttcaatggttatgcagggattttcacagagcaagctttggtatctagttagtctagtattctttagccaatgatgtcctttggtatttattaaagtcaccacagtatggggggcctttatctttaggttttgcccaagagttagcttatccacttcttatgctagcagggctgttgctgccaaagccctcaaacatgggggccaactcttagaaacgccatctagttgtttagagaggtaggccactggccccagccagggccccatggtctgggtcaaaactctaaccgccatttttttttctctgtctgacacatatagtgtaaaaggttttgtctggtcaggtagccccagggctagggccgacatgagtttttcttttaactcatgaaaagctcgttgctgttggttgtaatagatgtagtttatccaatctacatttttattaactgtcacccaccaaaatattgactcaaatcctgcagctatttgattttgggctttaaattgatctggtattcccttttggattccaattgcatctaaatagatgtgagagttgaaaggcccataaggggcttctctcactttacaatgtcttatttttcctccctctggttgatgaaatgccagggtgaaagggatagccaactggactaaagcacaaatgccactccagttatttggcagagtgcccagtaaaggtccaccacaataccaccacacatctgcttggggatgaaccagggctgactgattgataagctcttgaaaattcttaagctcactgcatcccttcaggtctccaaggaatgctaagttttctccctgtcatgagagacacgaagtgaacctagtgttggaagacggaagcgggatggccctcgagggctgacccacagggtgctcgacttccggatatagcagaaagagcttggcatgacttaatactccaggctgtagaatcctggaaaagagctaccatgcagcccatgcctggttgactggaggaccaccttagtggaaaggggacaatctgggcctctggcctgccatgtgcacaagcataacaattgcttttgtttaacatgtggagggaatatttgatccattccaaccaggcatttgcatcttggtaacctgcttaattgccaaagtttgtattaagtctttaacttctatgatcctctagtaaaatgaacatatggttttaggaaattacaaaaaccggttggggaagtccatccttgctctgtagtggtccacggaatgttggaccaactatggcataaaagctctacatcggggggcaagactcctagttggcactggggtctttatggaaatctccctggattaaatggtcccaatttactaatgcccagtctgaggagagtcaggaaggtcagaggtacttttctgaagtagagggctgtctttgacttggtaagtccccacagggtataacaaggcaagcattaaatgcaatagtttgaggcaaaattgacttggttatgttaataactagatggtcagcaatagagtgaggaaagaagaaagagtaatagaatagatgaaagagttaaatttttcttagcttagtttggtagggttttcccctgggactatggcctatgactctggagggggtggtgctttcttgacttgggtgtgatgaatccatcccctttccattgtaggaacagcagtctcagcggttagcagcacaaggtaagctccttcacaggatggctcaagttttccttcttatgtgatctttaggctggagctggtttaccagaaattctaggggtggtacgtgtgctaaaagacttttagttttgagggaaaggaaagtgtatataatttttaagaaattagacaatgcttcttgtgtgatttttataccagataagtaaatttcacctttatattagtgtgttattaatgttaaacttagttttaataaaacttcgtagacatatttattcaatttttaatgttggaccataaggtaagatttttatagactctttttaaccttttatagtttttgttaaagagcaggttagtgatttaagaaaaaacccgttgtgtttttattttaatgtttagttcacagaaaaactggatgatacctctttaactttagctaatatgtttacacacagaattttctttatgattaatgttttaaaacttgcttaagccttcaaaagaaaacttttttttaaccttttaatgtaggtaaaaatccacattcttatgcctccttataatccctttaccaaaggtatattttactttccttatacaccttgcacataaactgtttcttcaatagttttacattcaggaggcccaattacttttaaattatacaacatttcttgcataaattcttttttataacttttttttctctttcatgactttcacagacaattctttgacatgcgttaactttctgacttattacaaacatttctttctttaaacaaccagttaatttatttcaggataagaatttaccatataacattctttttacataaatttcgcggccccccccaactttttttcccttttttttgaagatgataaccattcttttccaaagtggacttcctttatgtctgtggactagactgtctaaggccacaagattagaagttactataatatatgttacactgttaacttttagcacactttacttttgctgaaaaccttgtaagtttgggatttcaattatcctttgctattaataagaacttgtttagttcaaattaacttagaattggtatagatggcttttttttttttccttcaattacccaggaggaaccatctatcatcctgtcctgaagggagttcctcttaggtctggttgaacctttgtatagtaattaagatttaaatcccctgttaggaaacctgctgggttaagggaattttcagtagttaatgttaaatcatcttttttcttttttttctaacagaatacccttatactttaagatttttaagttagtaagctacctttttgtcttttttttttttttttttaacttaggatacttctgaactggtaaggtgtgctcacaatgaggtttcccctaaaagttatttttctactttcttctgttagcaaagcagttgccgctacagagtgaatgcatttgggccatccgcaggttactgggtcaaggatttttgataggaagtctaggggttatcagcggcctcaatgcttttggggtattcccttgtttacactgacaacaagaaagtgttattggagtgttatagggttatggataatacctttaattatcaattataggttttaaatttaccttggcttttaaaggaatagggtacactgttttttttcttaactacttgtatatctctctctctctctctttccttgactccctctttgtctttctgtctcttcctgtcactttctctctctctttgcctctttccctctctgtctctttcctctatctctctctctctgctggtctttccttgcctctgtcagctgcttatgctgctgttctctcaaccactgtgaggcggatctaaaaccagctgtaaccaagtgtctatgtacaggaactggtttgcgtgccctggcttacaggttaccttgtgccatacctttgaaacaagggacccgtcaaggcttacttctgatgggaaatccacctctaatgctggccagtctatttcacataaagttctaacttttcctggtgtcagagtaacaccataatctcccttaaatcctttcttgaaatttttcaacacagttcctggtggggtgggcttactttgtgcctgacccatgcttcctcgagacaaaacaccacatgcacaccgcaaaacaaagaacaagtaaaaagggcacacagacactttcacagtttacaccaaaccagagtcaaaaccaaatcagagtatcaagaaatccaagccaggtcaaaaccaaaaccaaagtatcaagccatccaagtcaagtcaaaaacaaaaaccaaagtgctggtacagacacgccgtgggtgatcaggccacgcttccactcaaatggagtggtcaagttccaaagaccagtcttaccaagtttcagatgtccagactgcaagtgccagttctttcccggtgttcagccactgcgttgaccctctgcgggggcctgccgtgcactgctctgaggaggcgttccactggggcaaatgcctacccaggagcgctctcaggatctgcatcgctcaagctggctggagtccccacagggatgctccacaaggcaggcctaagctgcctaaggggctgccttggcctctgttaatcacctcgcttcctggtcagggtaccaagaaatgtagcagaacaagccacagacaaaactcctcagacaccgggttaaagaagtgaggagctttattcagctggaaatttcagcagacttgcatctcaaaagccgagctccccaagtgagcaattcctgtcccttttaagggcctacaactctaaggaggtctgtgtgagagggtcgtgattgattgagcaagcagggggtacgtgactgggggctgcatgcaccagtaatcagaatggaacagaacaggacagagattgtcacagtgcttttccatacaatgtctggaatctatagatgacataactggttaggtcaggggtcgatctttaactaccaggcccagggcacagcgccgggctgcctgcctgtggatttcatttctgccttttagtttttacttcttctttctttggaggcagaagttgggcataagacaatatgaggggtggtctcctctcttagtagaagggtgttatttgcatttgtcattttgaaagcacaccaagaggggtgggcagggttttttatttttaacacaaggggcttttactgttgtgtcttttttttactgactgagttggactgtataattgaagctaattttgattggctaatctgaatagagcaaggatgtgggttacagtggtaggacaagtagtttcagcaggaagaatagttgtagagtgcgtaactaagggaacagaacagatgtaagttatagattaggactggtgggaagggttgtttatagcacagttaactatagaaactggagaaacaaagaacaggaagaacacagaactaaaactttttgaagatgaatttatcatctctgacatgtgtctagtctctgttagctggagttggactgtacaaatcgacactgaacttgattggctaacttgaaaggggcaggggtgtgattacactggtggacaatgggaggggtgatttacagaatgattagcagatgtgggctctgtagataaggaatgataggaaagttgtttactgaaactaaaacggggaggcataaaggataaggaatgtagtttggctttgggagtagggaacaaagagcaaggacgctaaacaagccaaacttttaaagaggaactctttttatatctgacaactaagatcaaagcagaactgaaggagatagagacaggaaaaacctttcaaaaatcaatgagtacaggagctggttatttgaaaagatcagcaaatagatagattgctagccagactaatgaagaagaaaaaagagaagaagcaaatagacacaataaaaaatgataaaggggatatcaccactgatcccacagaaatagactaccatcagagaatactataaacacctctacacaaataaactagaaaatttagaagaaatggataagttcctggacatatacaccctcccaagtctaaaccaggaagaagttgaatccctgaatagaccaataacaagttctgaaattgaggcagtaactaatagcctagcaaccaaaaaaagcccaggatcagacagattcacagccgaattctaccagagatatgaagaggagatggtaccattccttctgaaactattccaaacaacagaaaaagagggacacctccctaactcattttatgaggccagcatcatcctgataccaaaacctggaagacacacaacaacaaaaaagaacatttcaggccaatatccctgatgaacattaatgtgaaaatcctcaagaaaatactggcaaaccaaatccagcagtacctcaaaaagcttatccaccacgatcaagtcggcttcatccctgggatgcaaccctggttcaacatacacaaatcaataaacttaatctatcacataaagagaaccaatgacaaaaacctcatgagtatctcgatagatgcagaaaagtccctcgataaaattcaacacctcttcatgctaaaaattctcaataaactaggtattgatggaacgtatctcaaaataataataactatttatgacaaactcacagccaatatcatatggaatgggcaaaacctggaagcattccctttgaaagccagtacaagacaaagatgccctctctcaccgctcttactcaacatagtattggaagttctggccggggcactcaggcaagagaaagaaataaagtttattcaaataggaagagaggaagtcaaattgtctctgtttgcagatgacatgattttatatttaaaaaaccagtcttctcagccccaaatctccttaagctgataagcaacttcagcaaagtctcaggatacaaaaatcacaagcattcctatacaccaataacagacaaacagagagcaaaatcatgagtgaactcccattcacaattgcgacaaagagaataaaatacctaggaataaaactcacaagggatgtgagggacctcttcaaggagatctagaaacaactgctcaaggaaataaaagaggacacaaacaaatggaaaaacatttcatgctcatggataggaagaatcaatattgaaaaatggccatactgcccaatttatagattcaatgctatcccaattaagctaccattgactttcttcacaaaattagaaaaaacaaactactttaaacttcacatggaaccaaaaaacagcccatatagccaaggcaatcctaagcaaaaagagcaaagctggaggcatcacgctacctgacttccaactatactatgaggctacagtaaccaaaacagcatggtacaggtagcaaaacagatatatagaccaatggaacagaacagaggcctcagaaataacagcacacatctaaaatcatctgatctttgacaaacctgacaaatataagcaatggggaaaggatttcctatttaataaatcatgttgggaaaactgactagccatgtgcagaaaacagaaactggacctcttctttacacctaatgcaaaaattaactcaagatggattaaagacttaaacataagacctaaaaccataaaaaccctagaagaaaacccaggcaataccattcaggacataggtatgggcaaagacttcatgactaaaacaccaaaagcaatggcaacaaaagccaaaattgacaaatgggatctaattaaactaaagagtttctgcaaagcaaaagaaacaatcatcagagtgaacaggcaacctacagaatgggagaaaatttttgcaatatatccatctgacagaaggctaatatctaggatctacaaagaacttaaacaaatgtacaagaaaaaaacaatcccatcaaaaagtggacgaaggatattaacaggcacttctcaaaagaagacatttactcagccaacaaacatatgaaaaaaagcccatcatcactggtcagttagaatggtgatcattaaaaagtcaggaaataacagatgctggagaaataaaaactcttttatactgttgttgggagtgtaaattagttcaaccattgtggaaggtggtgtggcaattcctcaaggatctagaaccagaaataccgtttgacccagtataaatcattctacataaagacgctttcacacgtttgtcacggcactattcacaatggaaaagacttggaacccacccaaatgcctatcaatgatagactgtataaagaaaatgtggcacatatacaccatggaatactatgcagacataaaaaaggatgtgttcatgtcctttgcagagacatggatgaagctggaaaccatcattctcagcaaactaacacaggaacagaaaaccaaacaccacatgttctcactcataagtggaagttgagcaatgataacacatggacacagggaagggaacatcacataccggggtctgtcagggggtgggaggctaggggagggatagcattaggagaaatacctaatgtagatgatgggttgatgggtgcagcaaaccaacatgccatgtgcatacctatgtaacaaacctgcatgttctgcacatatatcccagaacttaaagtataaaaaaataaataaataaacagtatggaaaggtaggggtagaaagtaacttcatagtggagaaatctaacaatcattaccccagtcaggtgtttaagatcaatatcagcagtcataaattatgttggtagtatgtatccttgtcataatgtgacaaaaatggcactttaactctgttatcttctttcccaaaccccataaccctggtctaattatgagtaaaaacatcagataaattctattaaggggataccctgcaaaatacctgaccagtattattcaaaactgtcaagatcatcaaaaataagaaaaatctgagaaactgtcacagccaagggaacttaaggagagatgacaactagagcaatttggtattctggatgggttgctagaacagaaacgtgctggggaaaagataaggatatttgattaacatatggactttagttagtaacaatgtatcaattttggtatattaacgataagtgcaccatactaacgtaacatgttaatagggaaactgggtgtgaggtgtatgagaagtctctgtacattcttctctatttttttttaaatctaaaactattttaaataatggggtcaatttttttaaaagaagatgtttctattagaaagccaggattatgggcttatcaagcagatgtttacagcaaattctctgctgaactatggggggaggagatctgcaaatggtgttttataaatctctgttttctaattttaagaaagctggatttttccaaaaggaaaaagattttgcatggtatatagaagttggtgcatggattcatccctacattaaatctgttatcacccagaaccagacagcatttttgagtaaaaatttagatatttgattcctcctgcaattcatgtactttatttgccttttgcttttctttttttttaaaaaaaaattacatacgctactatttagctatggcttgctgtggtatatagtcatatagtcatatagtcatttatctgtctaacacccttcccttctgaaagcaacaatttcctccttctgggagttacacttgtccgtttccaccacccaaaccatatggttccattaatatttgccatgctattacattttcttattcctgaccccagactggttttgggtccaccaaatctatgatggtctcctacaattcccaactcaaatggattggtccaaaaggtgtcccttgtttcatgctaaaactatcagagctagtctcaagctatttaagcctggaccataaagagaagtagtcacactattttgattgaaaaactcttaaggtttaaaacccaggacagttcattgttcatgcatcatgctatgcagagaagattgggtcacactgagagaaaataaagctgtctaaggagtgtagccacaatgagaaatacctggtggtgctcagctcaccagctctagctgtttctgagaactaatgcaagcctgcccttgtcatctcagattgttccacatattctagaataaataaactgatgatccaaatttgtcagagctggtttctaatcctagcacccaacgaaagtctaaagtactaagtttaggcaataccctaggctgccattttttaagacaggaacttgctgaatttagagccctctctctcaagggcttcagcaggcccccaacctcagcctgcttcctgaactgtgtgatgcagagtacactctgtattttatactcaaagtatagcaggatagtatatttcaaagaatcaaatggaaataaatgaatctctgaaaaacgtgttcaaaaatgcgataaggattagaagtttagtttcaagattcttcaaaatcatgtatctatataaatatatatatatatttgtgaattcaaatggtttatggtatgatttacaagatatatgagatctctactgactaaaaatcaaatgtatgttaacacttgcaaagtgttgtgagaaaaaaaggttatgtatctcactagtgattttaatgaaacttaaagcataataacatttattacttaattattatatggctacccacaatggtgtatattgcagctgtgatctgctacagacaaaaccagataattctctagattgtttttgatggagtatctgtccctgcatttgtgaatgtttgctgataagatctcgctttccttcctgactggaagggcactggtggctgagaacaggaaggaagcaagtgttctcttcttttatttttctgtgttgcatgatcattacacttttccttccacctttaaatccaaagaagaagtcgtctttaaaaaaataaaggtgacttacttctttcttttcttttttttttttttcctttttggcgatagatctttaaacaacgttgaaacaggaaaagtctcactctcctattgaaatctgattcctttagagtgtaagagtgatggcttatcacttagagtcacttttctgtgaaactttttgaatcagataactccctaaactgcggaataatgaactgggaaagaggactaactcgaatgtcagacacttcttttgtcctctgttttggctgtctgctatctcacagaaaacctggttaggaaattgatgtaaataatgtattttttaaaggaaacaaagatgaaaattctgaaaatgtgtttcctttttaaaagaagaactagagcagagggaaagataaatcaggaattaaaagttgcattaaagaaataatagaaaaatgcctaaataattattggttctgactgagaaagaatagctgtgcgaaagatgtggaaagtaaaattgcacatggaaatggactttaatacatacttcgccatattgatcagcgtttacccatgtctctcaattactgtcctttttatttatattttcaaagttgaaatatgacctgtttgcttgaatattaataaatatatgcactgaatgtgtttgcccataattctgaatactacatatacattttaagtatgactcattgagtatgcacagagaaatgtatgtgtatacacataaaatggcatagaaatttgcatatgaggtacacatatgatgtttactagtctgtaaatgagtgcatattaacactttatttattagatatgtatgggttctgtatttcagagatgatttacacaatgaagaaagtacatgcactttgggcttctgtatgcctgctgcttaatcttgcccctgcccctcttaatgctgattctgaggaagatgaagaacacacaattatcacaggtaaaatattagaagcaattatctttttaagctagttaaagctctcaattttaatctaaaaaatctaccatagttttccattgtggagggaaattagttgttattgaagtgatatttttctttggaaatttattatacctaatgtatgtgtgtgtgtgtgtgtgtgtgtgtgtgtgtgtgtgtgtgtacatgcacatgtgtgttttaaacagtccgaaaccaagtaactttagctgaaacacttctctcttttttttcagcatacaatattaaacactggagtagctccgggctattgcaaggagcaaaatgttgtaaaaacaactccctatgacatttgatgctaccctttggctaggaaaagtgtgaggaggaaagggaacttcagacatctgaggtttcagctattctctctttcttccccatatttccaaaatcaaaacttcccagttgagactaatataaaaatctagtcaaccaggacaccaaaggatctagtaatataagttagatctaatcccataaaactctgtgtctaaaaatgagaatattaacaataaaaaatagagcaaggagaagactgtatggtgatggttattgtggatatatacctttcttaaagtaacattttgtggcaaattagtaaattgttgacagaaatctcaagcattggtattaatgagagaatattaacaaaatgatagcttatttttgtatagtggtttaagatgtaaaaaagatttccataaatgcattcttatttgatagctttaatagctttttaaaatgactgtgttcagtgtactttaataaagtttgaataaatacatcttctgggcctgaatctgtggaaggtgctagagaaacaggtatggctgagatgaggtgctcaagaatctcactgtttcctaggggagtgtgaagggtggacagtttatttccgtataaagtagtacacaaagtgacagaagcatggagagtgctgctgttgatgggaagaggaaggagattcaatcaagcttggctctctgagggctccacaaggggaagtcatgttataaaaatttcctagagatgaagcattatttagtaaaaaccctaatgtacctttttgaaaataagaatttgaacattatgagtttcaatccctcattcggcttttttctcaaaaggtggtgggttaaaattctaacattctggaggttacagaaacaaggaaggtggaggataaaataagtcttaacagggaaaaaacaggcaatctcacttgtgggaagtgagaagcaaatagatccaagtgttccctgtatttgtcccagtccaattttcctcaactggactgagaaaatgaatattggttaaccaggaagttcctgaaattgtggctgctgccactgtcaatcaataatccagaattaagttatcagtaattaagccagaatttaaaattactataaggtagcttccaaacctaggtggtaacaaagaattttgatatttaagctagacttaaagacctcttcaccaactagttgcagttttatctagttttattttgtttttgtttaaaattaatttttataataaccttatctcacatctgaaaaaattctatttaggagatacaatttatcacatgatgctaagatcataacatcattttatagaagtatattatttaattgaaataaggtactcttattaatagaaaaatacatcaaattttattgcttctctcacaagcaaatagtagatgatttttttaacagtcaaatcagcagggaggataatctagaattaacgtctagataaggcaaaaatgataataaaaagagtagtgataagctttttaaaacaattccattgggctaggagagagaaaattaagagtgaacatttagtgaaaggcaagtatcttttgtaggatttagaatcagacagacctgagtttgcaggtgtagtttgccacctagtacctttgtgagactgaataagttaaactttctgactaccagtgtcctaagctgtaaatgaataatgtaaataactaatttcctatgatttttatataaaaagtggaaaagcatctggcacattttctgacacagagaaggcaaaaggtacatgtgtttgttcttccctgccagaaaataaaataaaataaaataaaatcctttaattagagtctagcagcatgtggattcttagatggtaagttacctgaaagccctagatttgcaaataagttccaagaggatgagtattcttacagtcaagggcatgatatgttttcaggcagcaaatattatagtaagcttctatccaacatcccaggacatggggcggggggagggaaggggaaggcaggattgtaacctttagactatgagacataaaattcatgacatcaaaggcaaatgattcaatataaaccataattctatttatatgactggatcagattaaattccttttagattgccctctatgtgttttgctttctcatggccgctggcagataattattacctctgtaaacatttccttcaagtctcaatttcaagtctcaggaaagttatcgctgaccccttcaggctaatttaggtatcctactgttcactcgcacagcacccaggactttctgaatgtttatgtaagtccttagtgtctatatgctccatgaacgaggggttgctgtcatctaatttactgtcatatctgtagtgacagcacagtgcttgacgcatggtcaatacccaattattaacattcaaaagggtttattcaaaataagaaatgaaaaccgaggcagatttccatcccttttgggtgaagtggcatggcactgtgggtcacacagcacacctggccattgcttgagtccagggatgctgtgcttaggtgtgggctgcaagatcactgcacaaagaatattctaatacaggatttctataagaaatacattaaagtgtgaataaagacaaataatcacctaataattaacaaaatataattcataaaagttaatacttagtgtttctcctagaaaatttctataaaattatcacctacttccattattgaaaccatttttagtttcataaaggtgaatgtttgaaaaaaaatgttgttgattgagtggaaattatataattaaaaccgtatgcttgatccaaatgctactttaggaatctcagtcacatgtctgtgacaatatcatgtagttattaagaatgtgtgagatagctgttgtaaaaccatatgaggatcaattttaaacccatcatttatggtatgaatttaagttatttacttaatttctgaaagctattttataatttataaaatgaagataataatgcctaactcagtaggtggttatgatcattaaagggtacaattacaaaaatgtcaagggtattgtaattactcagtgagcaacattagctattgttgctaggtacaactactacagcgagtttatcagcttttgcctttgtggtgcactgccaccacctgctggcaaaattactcaatagcagattgaactagaggtgattatatctttaatgcagaaaatggaaaaaagatttagcttgataataaatactatcaaatatattaagaataaaaagtagaaaaatcatcaattagtatctgataaaattattgatttatgaaaaatgatttttctgaatatacatggcaatgcaggtattaggtaaagttccctgtgttctgcagatacagatctttattcaagttttctatctgaaacactacctcaataacttgtctctaaagttctaaagtcatgttaacttgggaatgaataacatcacattatatgagaatttctacagcaatttgagataatggtatatagctgtaaaattaaaaatgccagaatatttttattcctgctttgttatgtgaattctggggtcccatatttaaggagctgataggtcacatttttattggtttcaaaacaaacatgtctagagttcagaaactcacgatacgtaatttgatgatacttactgtgggcctgctgtaagtcagacacaccacttagggtcttcacaccaaattttctggtttctcataaaaactcaaaatgtcagcttggcattctaaaatccttaagtaaagacaaaaagatataaacagcatttacaattattcataaatgtgccactcagaaaaaaaaattcaatgatttttaaaactgacaattataacttcagtgatagagaaaatgtgttttaacaagtcattttggttcatacatttttcgatttttagaaagtatttttagcaatcctcaattatatttgttatgaatttctattaaaaagtacttgtgtatctaatttaagaaaaatggaaaattttaccatgaagtgctcatatttataggtaccagaaactctctatatgcctgagagaccttctaaagcaaattatcgtattttagatatgttcatcaacatgaaatgttagataaaggatttgaaaaaaaaaagaaatgacatttaaacttgtcaatgttcaccaatatttcttaactcactttgatacaattatttgtatatatactatagatatttattggatttagtgacactgttattggtttaaaattattttaaaaatcatgttggtaaacacaaacattatattttgtcaattgaatataactccagaaaaatttgaagacacacaaatgcatatgtgcataaaactcaactttagttaaagatttgatcaacattcttacttgctaattagctattttatgacaattgtgtttggtgctgaaactatccccgtatcataataattctctgtcatatgttattctaagttaacaaattctggacctgaaaaacatactcttctatcagttctgtcagctcaatttatttcaattgaaaaaaataatcaattaacttatcaaatagatcaaaataatgagatggtattatgtaaatttaactagtatttttaaaaattgaaagcagtgttagtagttgagataaaatttacgtgttcaaaaataattagtgtcacatgaatcaaacagcatgaaaatgccaacttatgtatagaaagctgtatctttaatccttccaagattgtaaaggctacttacaattttatgactcatataaaaaattaacaatatcatttcaatcattttgttacaaaaagttttaacattactaaaataagactaatacttgctattaattcaaaattgattattagaataataatatattatgggtggagtgcaattaataaaattatctaatttaacttttattacacacatattttctgtttcaaaaaattcacattttgaaattacaggaaatttaaaactgatttcttttgagacaatcatactccaaaaacttatcctgtattttatgctttaaaaatattttatgtgaaaatattaaagtctcattctttttttgttgttgttcaaagtaaactattttagaatgcatgaaaacactttttttcaagatatttatactcatctgtttaattcaatataatactgctgccctctagaggcaaaattggtttcggtcatttataggtttcaatattccccataagagattaataaatcaattgccaaagacatagaaaatacatagactcaatatgcagaaaatattcaagaagtattatatggcatttttgtcattattcttttggttgcaccacccacaattttcagtgtctatctttactggtaaacaaatagactttacttaacattaggcttctattaattttattggacttgaaaaaaataaaatgtttaaaaaatctagttgagtttcccctatttctatgtccattcccaggatagaaaattctgttatgaaaattaggagttaaatatttaaagaaaaaatatataacgtgaagtcaaaagaattgcctcattctatttaaaacatagaaagcattatttacattatttcaacattattaaaacccaagcatggtatggtaagttaaaataaaaagcaccatgaagtatatttttcagaacatcaaacacataaatttttataattagggaaaatggtttaatatagtgttatatacatatgtgtgtgtatatatatatgtgaatgtgaatatgctgttgcttttaaagggttgttttatgtgtaaaaagtgacacaagtgtgggttagggagagaaattcaaagaactgtccattagctgagttaaaagaggtctattgtggacacatccacttgaatgaagttgccttacaactactactcaattccctcccagttcggttggtacgatttaagcaatacctccctaacaagagtctagaagttgtgtttcatttggtgaatttattaactttatctaccattttgataactgaataactttttatagtttcttagtatgttttattgtacttttccttaaaatcaggacatattaaaaaggaaataaagaacattattacagtgttgatggagattacatgttatatcttttatttttactttatagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagaggtaggtttctgggaacccttattactcaagaccctttagggctattgagtctaattatggatttgataatttagggagaaaagtaatttcatgctgttttaatatttccaaggaatcttttatttccacatttttagactttcagggaatcctaaaaacatttaaggaaaatgataattctgaattgtaccatgaaatacccacatttataggtaccagaaactctctatatgcccgagagacattttaaagcaaattatcaaattttaggtacggtcaacttgcatgttcaactatcatttttcattttcttcatatcagtgaattataaaatatgaggccccatttattgtcttatactcttatccataataaagacagaagaaaaaaacctcaactcatgttcaaagaattgtgaagtatttttaaaataaagtgggtgtaattcggcctcccagacttgtaatctcagttggcagaagaaaaactgttagtcacattgacttagtctttcctttgtcaacacaatggtctcatcgctatactctctcaagatcatgaatctggaaattgaagctctatggctcttaattacaaaattgtaagctgcataaaatagtagaactatatatgaaatttaagatttttttattattggaaccttaaaatactacaggaaataaaaatagaataccatagaaaagaaaaatcatccctgatgacccttgtggactttactaaacccaatgttttatattaatattactaagttataaatttcaaaagtacgtcatattatattaaacttttactctgcattaatcctactaaaatttaacatttttgcaaattttgctaattactttattgtatgggattttatatcttctcactaagataaattacaaataattactgaccaaaattttgaatgttttttttttaatgtcaggctattcttccaaattgtaagttactcaagggatagaataagttgagttgcttttatttccctagtttctagaccaatattctaccatagcatgttcgtagagctggttggatacaattgaggtgatacagaaatgatatctctggttagtaacactagatgtcttgttttttgcaaatcaggcagctctgcattctcactctgttactgctttctaaatagcttttactaaacagccttggcatcatggtgctcttggcctgtgggaaaacttccatgtggtgaaaagagtgaacttctctcctctgtggctctgtaagatgtttagttgtatgctcccaagctgaaagaagagaatagacacgaatatatttctttaacctcacagcactgatttctctgtttcctctccatagatgccctaggaatgttactaacacagtttaggcagctcagtggtcctcagtggtgcttttggtttttgtgattgcttggtcttttcccattcatcacagatttctataccccattttcttccatacatattgggccaagtatccttttgtgttgagttgaaaatcattcttagttgtcagtaccttggctagaagcctggttgcctcattctttgtaatccccactctttcatttagcaggctatttattttcatcaactggcctctttcctgaaatatatacctgttctttttatatatgtgtatagttcaagtcttatggtttatcattgtgcaaaacttactcttttctttaaaggttagggaaatgtaatcattttgctcatcagtgatagccttgcttatcatcatttaaaatatcatttctggctagcatgtaaatgtaactctcttacccccatctcctcattatctatcaaaattcacttgaggctgggtgcagtggctcacacctgtaatcccagcactttgggaggctgaggtgggtggatcacctaaggtcaggaattttagaccagcctcaccaatatggtgaaactccgtccctactaaaaatacaaaaattagctgggtatggtggcatgtgcctgtagtcccagctactcaggaggctgagacaggagaattgcttaaaaccaggagccagacgttgcagtgagccaagattgcaccactgcactctagctgtgcaacagaggaagactccatgaaaaaaaaagaaaagtcacttgcaattattgtatgaatgtctgagtgttttatacagcagactactgataaggatataactggtatatggaaaaaatatggctagacttttaaaaacgcacctaaggagagaatttaatcggcagccatgatggataaatagaacaagactttctctccccaacataaagaactataaaactggacaaaatgtaaaaaactactgtttgcaagcattgaacaaaaggcagtgcaggattgtgacctctgggagaaggtaaatacataagatgagccctgcagtctcccctgcttcctgtgtgaaggcattcagaaccaccattacatgaaagaaacccaagtacagcatggtggtctctctgaaaagaggagatggctattagagattagaaagcagaagtggttgtggtttttctaacaatgtgtgttatatggtttcactctgtgtccctacccaaatatcatcttgtagctcccataattcccatatgttgtgggagggactggtgggaaatgattgaatcatgggggatggggcgggggggaaggtggtctttcccatgctattatcgtggtagtgaatgggtctcacatgatcttatggttttaacaaacaggagtttctctgcataagctctctctttgcctgccgctatccatgtaagatgtgacttgctcacagtaaattggtaccagtagaatggggtgttgctggaaagatacctgaaaatgtggaagtgactttggaactgggtaacaggcagaggttgcaacagtttggagggctcagaagaagacaggaaaatgttggaaagtttggaacttccaagagacttgttgaaaggctttgacaaaaatgctgatagtgatatgaacgataaggtccagcctgaggtggtctcagatagagatgaggaactttttgggaagttgagcaaagctgactctcattatgttttagcaaagagactggcagcattttgcccctgccctagagattcgtggaatgttgaacttgaagaaatgatgtagagtaattgacagaataaatttctaagcaccaaagcattcaaggggggtttaggtgctgttaaaggcattcagtttcaaaagagaaacagagcataaaagtatggaaaatttgcagcttgacaatgcaagtgaaaagaaaattacattctctgaggaaaaattcaagccagctgcagaaatttgcataagtaacaaggatctgaatgttaatcaccaggaaaatggggaaaatatctctagggcatgtgagacatttgtgccagctcttcccatcacaggcctggaggcttaggaggaaaaagtggtttcctggacccggcccagggtcctcatgctgtgtgcagtctagggacttcgtgccctgtgtcccagccactccagccatgattgaaaggggtcaacgtagagctagggccagagcttcagagggtgcaagcctcgagccttggcaacttccacatggtattgagcctgagagtataccgaagtcaagaattgaggtttgggaacctacatctagatttcagaagatgtatggaaatgcctggatgcgcagataaaagtttgctgcatgggtggggctctcatggagaacctctgctagagcagtgcagaagggaaatgtagagtcagacccccgacacagattccctactggggcactgcctagtggagctgtgagaagaaagccaccatactccaggccacagaatggtagatccattgacagcttgcaccatgcacttgcacatttcaaaactgatcatgccttcccaatagtcccccaaattcttaactcatttcagcattaactcagaagtccacagtccaatgtctcatctgagacaaggcaagtcccttctgcctaggagcttgtaaaatcaaaagcaagttagttacttcctagatacaatgggggtacaggcattgggtaaatacagctgttccaaatgggagaaactggccaaaacaaagggtctacaggccccatggaagtccaaaatccagcagggcagtcaaatcctaaagctccaaaatgatctcctttgactccatgtctcatatccaggtcacgctgatgcaagaggtgggctcccatggtcttgggcagctctgcccttgtgactttgcagggtacagcctccctcctggttgtaacacttatttacagccaactgttctttgacaaaatcaacaaaaacacacagtggtgaatgggcactctattcaataaatggtgttgagaaattggataatcatatgcagaagaataaaactggaataatgtctcttgccttatacaaaaatgaactcaaaatagattaatgacttaaatgtaaaacctgaaactataataattctagaggaaaatctgggaaaaaccctcctacatattgacctaggcaaagaatttatgactaaatcctcaaaagcaaatgcaagagaaacaaaaatagccaaatgagagttaaattgaagttgatccacaagtaacttaaattaaaaatgttctgcacagccaaagaagtatcagagtgaacagataacctaaggaatgagaaaaatatttgcaaactgtgtattggacaaaagactaatatctaaaatgtacatgtaactcaaacaattcaacaagaaaataacaaaccatttaaaaaatggacaaaggacatgaaaaggtatttttcaaaagaaacatatacacaaccaacaagcatatgaaaaaatgctgaaaatcactaatcatcagacaaatgcaaattaaaaccacaatgagataccatattataccagtcagaatggctactattaaaaagtcaaaaaataacagatgttgaagattaggagaaaaaagaatgcttataaattgttgctggaaatgtaaattagtataacctgtatggaaaacagtatggagatttcccaaagacctaaaaaatagaactaccatttgttccagcaatcccactactggctgtctacccaaaagcaaatacatcattatatcagaaagataactgtacttgtatgtttagcacagcactatttacagtagcaaagatataaaatcaacctaagtgtctattaacagatgattgggtaaataaaatgtgatatttatatatacacatatactccatggagtactactcagccattaaaaataaaatcatgtcttttatagcagcatggatggaactggaggctattatcttaagtgaaataactcagaaacagaaattcaaataccacatgttctaatttataagtggggggtaaatagtgcatacatgtgggcatagtagaataatagacaatggacactcaggaagatgggaggatgaaagggaactggggaatgagaaactatctaatgggtacaatggacactatttgggttatggttacactaaaatccacttcaccactatgcaatataaccacataacaaaatcgtacttctagcccctaaatctatgaaaataaaaaagaaataaatttttaaaaagaaaaaacaaagaactgaaagagaaaaaaagtgccaatcagtaatctacttcttaaaataagggcttttcaaatcagcattatctggggaaatttattcctggtagagcagcagtacaattagtattaaaggatttagaattaaagcacacaggaaggaaggagaaaaatatgagattattgttgtaaagttctgaggtttctacaggtgacaatgacatacattacttggcactagactgtaatggattagtacattataatccttaaagcaaccattaaaaaaatgaaacaagcagaaataacaaataggcccataatgaagatgaaattattattaaaatattcaattacagtaattctaaagaagacatgaacagagggaaacagaaacaaagaagaaatgagaaacagaaatcaaattgctagtgatatttatactcaactttaatgataattagattaaattaaaatttaatggtccagtcacgccagttaaaaggtagatattatcactctgtatgcaaaaataaatcaagaactaactacatgttgtctataggaaaggccctttaaaaataaggacagagagattaaaagtgaaaggatagaaaaagatataatatgtaagcactaatcataagaatgattagtaaaagtagactacaggataaaaaatactacctggtggaaagaaagatatttataatgggggtccattaataaaaaagacacaacaatccttaattcctatgtgcatggtcctaattacaaaactccaaaatttttaaagaaaaagttggcagaagtgagagtatacaattattcagttcagtttacatacttcaagacaccttttttcagtaactgacagaaaaagtaaacaacaatcactaaggatataaaagatttgaacaacactctctaccaacttcacacaattggtatttatctaacactctccttgcacacccagaagaaaatatcattatttacatctggcacacttttgaatggatttagaagcaaaaataaataagtcagtttgaggtataaatatcatatgccaatgtgtgtcaaccaaatgcaaattttgggatatttttgcttgtcagtcttacatcttaatattcataatgaaatattaaaacaaattcatataaattgaaattcaaaagagtactagaatggaaattagtctaacattctctcattgctccttaaaaagcattgataaatgcttcgtcctgtctaaatctaagaaaacttgataatttgctgtaaatcttttctaactattaatcgctttcatactgctattgccatacaaattatcgtgtccaaggttattattattagtcctcaaagacaattattggtaatataaatacacttaaaattctagtgtgctaaaccacattgagttaattggcatgtatattacctgaattaatcctatttacaatgtaacagtaaacaaacaaaatagatgttcttttaaaaattgtattaatcaagcatttatatattcccatcttatgactattgtcaataggtaaatcaggaatgaaaattgcttagtgttctagtcttatgtactcattatatgtatacatttctttcttcttatcaattaaatcatattagttttatatctaaatattttaatgtcaggttatatgacagtctacaatctagttgaaaacattaatatgaagttggttagttgcagtgaaaacaaagtaaaccaaaaaacttacctcaatagatacagctatacatatacacacacacacacacctctttttttaaaaggctattgaataaaacatagtacaattagaaaagaagtttgggtccgttagtttcactttcatagacattttactctccatagaagaattaactatttcaagaaaaaaaggatgatgcagttgctgaaagaggcttataacccaattcatattatttctctcattctttcttcccttctctctctcgctccctttctatctctctggtcatataacgaatgctaacctgctttgaccaaagattttctctgcaaaacaaataattccacaacaaaataaataccactcaactttcctaatgtctatgcgagcaaattaaaacttcatagatttattttgtcaatttaaatttcattacctatcatttaaattagaacttagaattcatacttggaatatggtaggacaaagacaactaacattccagttttagagggaaatgattccgttaatcaaatgttaaaccaaacaacgtgtcccagatgccttttgtttcatttcttctctacattggtaataataatgaaacttgcaattggattgagacaacgaagcaggggaaagaataaggaaaggaaataattctggttaatttcacttttattcccagttatctaacaaattatttttatatgtaatgtaggctgcttgaattactttcatatttcacatttttaaaataattgttttaagtatagatatcctgaacagtaaacatagtcactatgaattctcagctttgtaagtgtgttagaaagttttatcatagtttctaaaacattactctattgaaatgaagtggcttcatggttacaataaatagaaaagattaatttttagagaaaagaaaaagaaattcaatttttattaagacattctgtataagaataattttaatggtaataaatatgtcactcttgtttgttaaattcaaattcatagtattactttataaattgtgacaattgatatgcatatattcttttgattacagataatgcaaacaggattataaagacaacattgcaacaaggtgaacatttatttgtctgtaaatttgaagcatttatgtaaggcatttagatattcaattttttgtttgtttgcttgtttgttttttctggtccctgattcagtatagatattcaattcttaagtttctctgagattgatttaaaaaaatccataaaagagattgatcataaacccatatgacagattgatcatgtcatttttgaaatgatttgttgcatgattcaatggacataatcaaaaattaggaaaatatatacattatatttgtcagaggaggctccaaacaccgtatttactctaattctaatgtagtatgatatttagttttagttcaatcatagtccagagccacacatgctattttaacaccttccagatagagatttagatattttgagtcttaactttatttctctgatctctaatcacttgttaatctaatcaacattgtgtggctttagcaagtttcaccaaatattcccttgaatggatgtatgtctctgagttgtcagcagttatacatgcaaaagtaagtagagatatttaaaaataaatatctagcatgtatgtgtatgtttaattgtgtaatttaaatcatatcatttattgtttttagctaaaaataattactttttcacaaatatatcagcacaagaaaaaatgttatcaatggatcagggaaaccaacgtccttttaataaaggcctggaaactgatttggtccaattgtcagttatggcatttacatttcaatgagaaaatattgaacaaagagattaaattgtttaactcaggacatgaaagaccgcaacatgaaagaccacaaaattcaaagtgcattttaattttatttattttgatttatttatgtgggaaagagttgaaaatttctgtgacacattgataatctttaggctcaattcactgaccagaattggaatcaaaatgtataaaataaagataatagcaaagtttgtacaagaaacataactaaatgtacttacaattttaaaaaatagattcctataaatattaaaataatcttgaccaaaatgtttagtactttaattaaatgaaggccttatctgtaatatcaaaatggcatatttataataaagaagtttttgtctacaaaggagaataaatatttttgtgaaagaaaataccaacctttaaatattaggaccttttaccaaaaacataaaattagagaaaaattaaatacaggtactatttttaggtaaaattatgctataaagtgtatatttataattcagaattcaatcattcttatctcatattatatatgaaagttagagaataaagctgtgttcacatgaatgttaaaaatgcttacatgttaacacctatttgtaacaaagacttgatcaatttcgagtgaactttgtattatgcttcctagcattggaccattataaagagatttgagatttaatacaatcccttagaaagaaagtttggtccaagacaattcccaagtattcaggcccaaacaaaagttgacagtgataatgctttagcttatccagtctgcattctgtgttactcaagtgcaactgagcaccaacttagagcaagggttatgtatgcaaattcaataagaaggttaatttatttacctgaagaaaatgggaaattaattttttgatttgcaactgtagtttaaactgcaggccaaaaaaagaattattttacatgtgtccattttcaactttgtcttcacataagttcatgtttcccaatgtagtttcatatgaaaaataacaactttcagttgtacagtttattgtttgttgtggttttgtttgtttatttttaatttttgtgggtacatattaggtgtatatatttatgtacatgtataatttcttaattatacttatcagcataattttttatacctttatgttttttatatgcaatatttttcctccatccacttttggcaaacataaagttcttgtatcctctgttcagatcatttaaaatttcataaaaagtacacattaagactaaaacaaatcatatgatagtaattcaatgtatttttaccttataaaatgttataacattttaaagaattgttttattcctttcccccacatattattacaattaactaaaaatcataaaaacattcatttgaaagatcaagaggcaatacagaagaaacaaagttaactttcaaattaatacattgaaaagttacagaaaatagacttttaaaactatattatagtaggaagttttacttaataaaataacttttcaataaggagtttgttcttttgcagatctgcaactgttgcagaaatcattaacattattaaatacatgttcttttttattgtaaaatacttgtgggtattgcttccctgacatagaagaacaagttgctttaagatgaaaaaaggttaccacagttcagttttgccaatatggtaatatacttgcaggaaaaaaattgagaaattggaattttgttctaaaaattcaagcccaatacgcctgtgagcataataattttgaaaattagctcacttcttttcacagtgcatgcatgtagacagagctggtgatgtagatcacagtggcacaacttttatgacagctgtgtttagcctgctttggagcactatcaaagaagaagtattagtcttttgcaaaagcctctccaatccttgaacatgtatttcctttctgcctctgcattattgaagtcattccaatgacaagaagaaggaaaaaataaaaatgacacagcagtagaggatgtcctacctagtacagatattaattcccgcataagaattcaggaacttctaaggctagccatgaaaacttcctacccctcaaatattctttttcaacttttaaaaatttaaaccattcttaatggagcaacgcactacaatgcttttcctgagaagccaccctcaatagcttgaaatgttcatagaccttccctaaatgttaatacacatgaacatattaaaaataattaaaccacatttttgccataatgttttgtaatttcaaagcaagagtggtacatggtaaaataatcttttattccttaaatttgtaaaaaaatgacagttaattccctattaatttactatgagaaatttagaatttgaaatgccaatcccaaaatatggtagataattttaatagtgtatatttatggataaagttagatttttactttttaatttttatgcttactccttcaataacttagccaggtatttataaattttattaaaatcagtaatttatttacacaaaagaatattgctttctgacatttttataatttctagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtcgtaagtttatttcttatttcattttagttcatttataggcatccttttaaaactaaggcatctcagatggcattctatactcaggttttgtttgagccatgcaaatgaagatatatttgtgtgcattcaatgtgagatttgtgactgtagttttttaaaaagcacagaaaattaagaaattattttcatagatctaatactttttatgttgcattatttaattcttcttcctgagaatactgcagtacaattttggcacaatagaattgctgaaatctttcacatttatacaaatatgagagcaaacagttactgaaaaccaccacctaaagtcactcagttttatctgcctataacatttattaaagggatgacttaaacattaactgctacgcttttttgaccaagaactacagttactcatggaaatattaccttacaattatatttaaagattcactgtttgctaatttaacatagcaatgtgaatgaaattgccagaagtctgcttttttaactgttgtacgcttcatgagtccaaatatgagattgtgacaatgtttatctattttaattggctgtatttttttccagcgaatggtttccaggtggataattatggaacccagctcaatgctgtgaataactccctgactccgcaatcaaccaaggttcccagcctttttggtaagaatcttgtggattttattgcttccaggaaactattatcatgctaacaatgaagtggattgtgtattagaagtatgtctttaaatatatatatatacctgcgttgttgcttaataatgtgtttgttgaaatactgagattcaaattgtttaagacatttaatctcataaaagcaacaattttcctaatctattttaaagtatgctttgaagtaagcttttgattatgtatcacatgaaaaactttcatatgatatttaactctatgccaaatttattttgtaaaatggtgctaggaattatcagcctcagtgtaagatggtaaatcattgtactggcacagcagtgcatcaaaggcagtctaaagtgcttttaaagtcagtatgacactaggcaaggtctctggtgttactcacaggacagattagaaattgattgaataaccatgcctaaatgttatgtcactctggagggaattttcttttgaattctgcaggactcttttttatgttcttgtctgttaacctatttatcagatttaaacgaatatacaggaaatatttccacaaaatgcagagctgagaaaatagtgaaaatactggaaaacataatcaggaaccacaaatatctgggcagttagaaataacataaacagctaaaaattaccagtgtaaaattgttagatcctagctaaattataaaaatcacatattcttattcagatattgaagattttgtttagaagtagtccatgtgaacatgtcaaaggtaaacttggcatgtttatatataaacttagcctgagtgtgaagaattctgtaactattaaaattgcaatcttaggattaaaataataataaaaaaaaaagaaacagtgtttgggccaggaattctctaccttggccatttatcagaatcagattggctttgagctactcctctttacaacaaacaaacaaacgaacaactaagcaagcaagccaacagaacgcaaacaaaatccctgcccacgtggatttgaagcattaaaatgttgactccgacttttctagaaagagtctgtgaatgttcagctgagtcccacagtgatctaatcatttgtgggtcttgcttcagcactgaatgtcacaccttggaaatcacaaggaggatttgaaacatgattaaagaggaaatgaaaagtgtaaagagacatgagatctacgagggagcataatatgtgcttttaataactgaaacactattatgtgaaaggagaattaagttctctacatgacttaccctttagtcctgcctatttcacaccctccccagacccccatccccatcctcccttatccccctcaacccagcctaagcatgaggattaatgtgtgagaactaaagtataaatgcctttctataatatgtttctttcttatgtgagatcttaaaaaattgatggctgtctcaggtattaataaattccctaaattgtaggcattcaataagtgtgcaattaacacttaagaggtcattaaggggatgcaaactttcagtgggagttggaaaatacgatatattcaaaatgacttcaggtccttacattcaataggtagagcagtgaattgaatgccagatgaacttgagtctaatttttaaatactacttcgttcgtaaaaattaatacttttgtgattctgacttatctgaaaaattaagtactatcgttgcattatttctttatgtctttccagctttgtatttttcactcgtattttgttttattcagttattatattttcaaaagcacgttaaatcttactgctgtaaaagaaaatttagaatgactaaattaacaggtttaaatatacatgtgacacagtatatcagtaagtacaagaaatgtatgaaatcagtttgcaacatgcttgaatacttttgtttgaattattttaccaattcaagtggagatctgcagtcatttatcattaaagtgagtagagtaggttagggaataattttgccttaagtttttttgaagtataaaatttaaaatttttggtaagcatactaccaagttagaaagggcaaaataaaaattagtgtgagaaagtaatattaatgagttttaaatggcctctgatatgtcttctttagtttattgtgtagatgcacattgaaaattgtaacaaataaataaatgcttgtaaaagtaaattattaactaagcagtaagaattgacaacatgaatttaaaagaaaacaatattaacaataatttattcagaataatagacatttaaggaataatgttatcgtaactgcatttaaaattagggcaaatgtctcctttatttgtctaaaaaactgttttatttttgattgtatatattggcctcaaaatcaacattcctccggccaatttgaccccttttcctttttctaagagcatttccttcccttcccttccccgcccctcccctcccttccctccctttcttccttcctaatctaaaacatgaaacaatgttgcagtaactaggagacatttgatattaaggatggcataaggtggattgtcaatgaagctatgttgccattcttcttaaaacctacgtgatttcgaatctgccccagccaagatgcggaagtgggaatgcagatgtccctgtactctgttctaaaacctagatgaccccttgtcacttctgtctgaggggtttgctgagatctacagacacctcttaatttccccaatcaaatataattacatctgtcactgcttacaattatattaatacattctattgtagtttaagaaaatgcaattctttgtttacataaaactttgtttttcaagggttttatcaaacgtgtaaagttctctgtggtatcaggttattttgaaaagctgtaaatcctttaaagtttcaattcaatgtacaggaataataatctgccccacaacataaatggaataccagtctttaaattctttccactaaataacaatctttaagtagagtatttgaatattctaaaattcaattattattaagtgaaatatttataaatataattttaatgtttttcttcatgatattatggaagcattttagaagtttagttaaacattatcataatatgactttttaaaaattgctatttatttttaattactggaatgttgtaaatggctttcaagatatatttttccagtaagctttcttgattcgagatacttgaatacttactaagcacaattccggtgtaatttttctttttatttccacatttcaatattaacaagttatttaggtaatctcaaagacagtcttactcttccttaaagagattttaaataatgatttgtaagcatatccctgagcgtgagtgcattatttcagtttgattggctgtgttgagtatatccatgtagttaaaataaatgtgtgttctctccacctgaaatatttctaaagcaatttccctaaatgtgtgcaattttgcgcataaaccctagaactgaaagccatcacaactgattcttcttgatttcccccatgattgaaataatgatatagcagataaaaaacctttgagcctgaagacatgcgttaaattcccaactcttcaactaatagctgtgtgaccctaagatatttcttaacctgagtttcatctttccaatgtaaaatgaggatggtaatattatagtactaagttgataggttgtgttgtgaggttaaatcagtcaaaatacataactttcttaggacagtgcctgatatctagtcagttcgtgtagggttactcattattattatccatgtgattcagagtaatacacttaactcaccaggccttagattctcatttgttaaacaacttctttgtaagttcccatttgcagaagaaatttatatttcagacactcataaagtctctggttattcagataaatgcatcagtaaatatacagtctcaaaatcatgactaatattttaagaagaattcatactagaattaaattaatgcatatatggaaactcgaagagtttgaatgtgttcattagaaacaagttgagattattgtcacagaggagtatcatggggcttcaaggtcaaaagatgtttatttgtataattgttctttatcttttcgacatttccaactttccgaactttttgagttcttctactgtttttctggttattccaatttgaatgattagtaattttctttgtatcacttatattcttccagtcattcattaaatttcattgctttttatgaaatgtttatttctctctcttccattttcattcctatttatttcattcagatcatcaatccttcatggttagattccctaaacaatcatgtcatccaatttggaacactaatgatagttaaagagggtgctaaaaaattaaggtatatgtctattttaaatatatgtatgcattgacttaaaaatggaattgtcgttttggtgactctacaaaaatagttttatatttaaaagtatttcagtatttttaaatcatatatatatatatatatatatatatatatatatatatatatatgaacgtgatatccccccaaaataagcataaactaataggggcttaggcaaaccaggctgtatagacatgagacaaatagataaataaatagatatcagaaagctcagatatgactcagatattgtatataacacataatgtaattatatatctaacataagtaaactaaagcatattagagagagagagacaaaaaggaacagtcatatgtaacaaattatacatgacctttttgacatcactgtcctatttctagtcatcgatcatgtggtaatttagcttcatccacttgcctaaaatttgtctgcattgtccactagtcctctatctattgcagatattttctgtcccttaaatataacttttttccgtccattcaaattggccttttcattatcattaaacacaaattactcactcttattctaaaggatgttttatgttattttccccacctaaaattgactgaccctcctaatcttcttaaccaatctgccttttcactaccataaggaggccttctttctgtctctctcccctggcttcttactatgattccttcaatacttgtactattagatattgtgtttgctctgcctcactgtctagattacaagatttttttgaagaaaaacataatgtactatacagtttatagacttcccccaccctcagcattgaccacagtgttaaacatataaagatgactcacattttttatttatcaattttgtgatccacagttacaaaagaaggaacaaatgatggttggaagaatgcggctcatatttaccaagtctttctgaacgccttctgcattcatgcatccatgttctttctaggattggatagcatttcatgcctatgttaatatttgtgcttttggcatttccttaatatttatatgtatacgtgatgcctttgatagcatactgctaataaagttttaatatttacatgcatagtaaacatagtcttctcactgcacctcacttgtaaatgtctaactagcaaagaaaaatgaatattctcaggagttcgtgctagttgtgagtcttttgaccggacctaactattcatggaaaaaaagtcatttttttcctgatttttatacatccctttgcttccatacatcaactatttgtttttgttttgttctgttttgttttttgttgttgctgtttttgagatggagtttcactcttattgcccaggctggagtgcaatggcgcgatctcggctcactgcaatctccgcctcccaggttcaagggattctcctgcctcagcctcccgagtagctgggattacaggcatgtgccaccacgccccgctaatatttgtattttcagtagagacagggtttcatcatgttggccaggctagtctcgaactcctgacccaaagtgctgggattacaggcatgagctactctgcctggccccatacatcaactcttgagaggggccttggaactacatcagctttatgatattctggggggaagaaaattcaggtagacttaaaaagctactgccaacccaattctagtatttggccactgactgagaaagggaactcctatatacctgacccagttccacattgcctcctgccagcctccaggtccagggaaagtaattggatgacatcctgaagatccttttgctacttgaaactctatccctctcctgaatgtattcaatgtatgacctccagacatacattccatttatgtggaaaaaatagaaaataaaatctatgcatacataaatacatttttaaaagatttttgttatcactagccttctgaaacaggtgttatgttcacaaagggcctaatggacagccaaacacaatcactgatataatcaatttataaatctgcatgagattgttattatctccttgttattatctcgcctcttgttgaacgtgtgattgcatgtagaggaatactgaaaccatgagaactttctggagagaaactctccctcaccggctaaagagttccacatccagctgcataccacaggccatcacaagcactgtttacagttcttaaaaaacgaacaaacaaacaaaaaaaacccacttcatccacagtccactttcatagttctaaagaagtatcttgactttcataatgtgttctaagaccaagaagcacaggaacatccctcataatctaaagatgcctgcatagtaaatctggagcctcatattctgattttctgacaagttggctttccaaaaatagataacaagttttggacagcacccagcaagttttctacttcctgacaggaatgctgatgagaaacaaaaatgtggcacttcatctctgccaaaatcactgccatcaaaatgcagtcaccctagatgaccactgtctacttttctaatccctttcttcctggaccatctttagtcttaacacaagataatttgttgccccagtcataaaagtcctccagagaagtgtttctcaagcttgaataatatatagatatctttaaaaggaaaaaaaatcacagacttccaatttgtaagccaaattacttaaaataactttcattttgtatgaaccagtaacatagtaggaataaattcattatgatcattatacaactataaaccaaaaattgtttacaagttaatactatgcaagctacaaactaataaataatactaatttgataagacttcttttgcttaaaaaaaagaaaaatccttattgtaatatgaatttaatagtgactggtgtagggcagcttagtaatgtggtagaaatagcttagacaaacttgagctactctaagttgtgtgtaattctctaccttttttctatttgagtaatggaaaatctttgcagaaatgaaattaagaagtattaatacaaaatggtggctgggtgcagtggctcactcctgtaataccagcgctttggaaggctggggtgggaagatagcttgagcccaggagttcaagaccagcctgggtgacatgcagagaccctctctctacaaaagataaaataattagctcagtatggtggcctgtgatcgtagacccacttattctggaggctgaggtgggaggattgcttgagccagggaggttgaggctgcagtgagctgtaattgtgccactgcactccagcctggatgacagcaagactctctcataaataaataaataaaatctgttgatcaggaaaattccaactctgcctcttctagggacacagtggagtggggtttccagtttttgattatatctaatcaaaagtggggtttccagttttgattatatctaataccactacatggatctgattgaccagtgcattacatggatctgagtgaccagtgcagatatgatcacatggatgcaagactggaactttggtgtggttgtttctagaatcagtccctgttgaccatgccaactcaatacttgttactttcaaatgttcaagctctctaaatactgtttgaatcagcactgttgcaccaagatttgtttctagcctccttgtatgatgacatattttgattagaactctttctcctgttcaaacttaggaaacttcaacttcatgtttgtaactgtggactatggtacatttagcatgttctgaacctgagcttcagaaaagagggaatttggacatcagttctaaaggagaagttgtgacaattttatttttatctgataaaattattaaaatagttttgctcaggtattattttcttaattttctagttagttttcagaatgacatatcttagtggttgagagcattgacgttatagaaagaaagatgtggtttttaattccagttctgctatttgctgactcagtctgtggccttgaaaaaaagatcacaaaatttcgcttggcttcaggttcctcatttgttctatgtggcaagaagtatctcaaaacttttggaaaactgtaatgagacataaaattcttaacccagttgttgagcacacaattaaagcacaaagtattaatttttgaggttgttttcaatgatgatgatgacgacctattttcatccgaggtttatagtcaaaaaatgagtactatttgtatacattttgttattgatcatttttaatgaagctaaagtctgtaaccttgatctgacatatcttcatttaacaaattttattctaagtttctttgaaataacatatatagcacttgaaaattcaaacataattatacatattttttgtctttggatcttataactaattgaaggacatatacacctatattttcaactttatcttatgacctaaggtacagatctgtgtacttcctaatttcagttcatttcagcaaacattgagtgtctcctacacgggactaccataggtactgggagtatgagaataataaaagtgtaagtttgtcctttataggtgtttttgtcaaatagggaagaagataaataaataggtgacttcaatgcctgtgttacgtgctaagacagagacctgcacaagggttacgggagaacagagtcacaataacattttacattcattaaacaatgtcataattaaaatattctatcttctcaaaacttgagctctatcttcatcttccacttcaaactcgtttgcctggatgctggctaacccatggacatagtctacaatttcctctttatattcagatatttttctaagtaaagccacaatgaataaaagccaccaaaatttacaaaaattacaactattataagtagaatttattctataatgtttcataacatgttagacaagtattacatcttctgaatgtagaaacactagaattatttcatctctagctctctacctgcccaaattcaatctggtgcttaattttagctactcccatggtaactgcttcggttgtggtaattttatattcttctctattagaagttactggattcaacctaagcatgcctggttgagtttgcttcatgtattcaacaagatcagaacttgtattttcattattcaataatttcagtggctctttaatgtctgcattataaaaatctaaatataatagtattcaagaatcttcttaatttgacctaaatgtaattttccagccttgtatcccactatactcttttttgtgttatgttctccagatagcctggagtttgcgaagtacccccaagcaaaccagaaacattctgacctttgtgttttcactttccttcacccatatgcttctctgtattctctgcttactaaaatcccattcttcctaaaaagctgatcaacagactaaatgttaattttttacttttactaaaattttgtagggcttaaaattttacatatatgtcatgaagaaagtttttctaatgcattataagatataattatcttagaataaagtatactcaatagctgtataatctataattttaccatggctttctttctttgtggccttgcttagacaaatccctgaagaaacatgactttatggactctgtccatggattacgcagtatctaggcaatgaaatccaacccagagaacatctacccaatttatttccttccctcttaatatgtggagggagtttctgtctgggcaggttttcactcagtctattctttatgacctttcaattttaagttcactggcaaccctccttctatactttatcctcaggtaagtggcccagtatacacatgcggggggaaaaaaaaaagctccacagtgcttgtttttccattcccttccccgttttttttttctttatagaatatcactttccaccaatttaataccacttctcctgattaatgaatagagatacatactctttcttttttacagagagagggacaagtttaccacacattcctactcagaaacagattccaatctctaatctctaggcttttatctattacctcaggacactggactcactctaacatattatttctatcatatatcttgagcattatgattgcaaagaatttgaataaaaaagaaaataaaagaagaaaaactggccatatccacattatgcagaaacaatcactgttggcattctagcatatctcatttactattttcttgtattttttttcaacttaccacaaagtaaataaagttcaagactggaagtagctgctggaggagcccgaacaatatagaataagctcagcataaaagtatctttttgtaaaatttaacctagcaaatctctaagctccctacctaataaagctatctctatagtaatcatcctcccaactgattgcatgtcctcttaaatatttgcccaatggatacatatataaattctattctcatttatatgtgcttgtatatatatgtatgtattgtgtgttggtacaaaatataaattattatattttcttgattctaacatgcaggtttttctaccttttaacatgattctaatgatgatgaaacttataactgatagtgtataacagtgtaattatgtttttctttctttttttttcgagatggagtcttgttctgttacccaggctgaagtgcagtggctcaatctcagctcacttgcaacctccacctccggagttcaagtgattctcctgcctcagcctccctagtagctgggaccacatgcgtgtgccaccacgcccagctaatttttgtattcttagtagagacagggtttcacctagttggtcaggctggtctcaaactctggacctcaggtgatccactcacctcggcctcccaaagtgctgggattacaggtgtgagccaccacgcctggccgtgtctttctttgtttatgaatagtacataaaataatagtgcatcttcaaattaatgacatttggatttcatataaatgatatttcatataacatttggcaagctataagcagtttcttgtcccacatagtactcttctacttttgttggcatggggaagaaaaaagtgttgaataggagataaattcatagcagtaaggtccatggtttgctaaatggtttaggcactttaaatgtcgttgtaggcatataaatttgtgaaaagtttcagtggaaaattcagcaacatctaccaagttataaattgaatatagattttgcataattctaattttagaagtatgtcctctggaagcacctgaaccagtgtacatgggtgttcatgagccactgtctggtactgaaaaaaataaattataataatccatatgtccatttgactaaatatactgtagtcaactcataaaatgaaatactgtacctacattaaaaagagtgaggcctatataaaaatgtggagacacagccacaaaatattatcaagtatagtaatatagaatattatattaatacatttgaatatgcaaacaatttggagatatgtaaaccattggtagtggttaaagggcaagaatcaaattatggataaattttgttttacatttgttatacttttatattatttcaaagttttacaaagataatttgcagtaaataatttatatttctctttactacaaaattatagagaaaaaaactttaaaaaagatttgttattcaattccctaaaaagtcttagaagaataaaataaatgtacttaacaagttgtaagatatttcttaaaacctagtttgtttagtaaaacaaaagcctaagtaggcaagccaaatgggaatcataaaaaagataccacagtaaagattcaaagtgaatatatgattcaaagtttactgtacaaatctcaaagcaaatttacattaacaactttacctgtaaaactgagtttagagcaccatcttacagttcagcagtcacactagatcatgatagttcctgatttaaaaaaaaaagtgtaccctgaattctgaaacctatcaaaaaccctgtagacagaaggtacacaactggttattaatggcagaatcaagacagaatgcatttgattattaaattccctttggaaaaacaacaaaagtcaggttagtgtctttttattctatcttaactttctgtcaataattataatctcaactaaaaaaattacatttcgcaaaacctttatattttctttcattgtagatagcaaattctggattttgaatagatgagtgctgatctatatgtagaataaatttgctatttggaaacaatgaagtttttctcttcaagaagtgaaaaaaattcaaatggaactaaaatgttcttaagaaaccatttgcttcattactttaattttactgtcatttatggtatagtaacccaatgatagtcttactgctcagagttaaaatgatcttaagataaatgaattagtttacgtattaggtaaaatttatgttctgaagaataaccgccttataatgattccttaactgacaataatttattgcatctttaaaaacctctaaaagttaattacacataatacaatatccttagtgattaacttcacattttaatgcactatcgaaatattgccatttctagtgttaggaacctcactgttgatctgggtcaaaactctgttgtgttgaatgatctgcgtaagcagtggttgaaatcagggcaaagtaagatagataaacaactgacattgcatcagtcatggacaagtaggagcaagtatctgattataggtgcatctgcataccaaatcccaggctgtcagaagcagcatgccagacaccctctgattcagaagtcataaagagtgtcagtagaggcaatctgatgccttggataatttagtgaagttttctctgctggcatctatgctggtcaactgtctgtttgctctcaaaccaatcccctgctcatgtggttttatggggaactttctcctctggcttctgaaaggatttggtaaatggcaggccttgttggatgactggatagtcaaaggaagactgaagctagcatatgtctctccaccacatctgtggtgtatcttccatggtttcagcttcaatggaaaggcccaaatggttctaggattcacctgctgttcttggtctatgataacagaggctcctcttctcatacgtccaatctagggactgtagccccatatgtactagcctagctttttcccattttgaaataaccttgattttatgattgggccatgtttactataggttgtatgtgggaaaagagaagaagtttgctccctgtcatcagaaaattttctctgttctggaataagggggcttgatgtctggcattgctatttagacgtaacaactaacatttgcaaagaaggatacaacttacaaccacattcacacatattatctgcaacttactgtgggcagatatatcttacatacaaaatgctaaagtgaaattgatgtataagtcatatatcattttatcatacacatctatttcgaagttactgtgggtgtttaaacaggaaaaaaagcgatagtaatttcctgttttctctgtttctcaaattaggttaattgcatctagtgcatctcttttgtttctgaacataggtgataactggaagctcatgagatcaaagtggtggcaattaataatcattttatattctacactgtgcaaggatgatgataatacacatcccacacattggaaaagtgtgtacaatagtacaaatcaattacaatataactctcctagactgctagaaaattcctctaatataaatgattcttagtgacaggaaatgtcaacattttctagaatgtctagcacacattctcaccattcaactttgatttatgatggcatatcatcatgtcaaaggatacaaaatacaggcatgtaggataaataagcctagagatctaatgtacaacatgaagatgacagttagtaaaacagtattgtgttagggatttctgttatataagtagattttagctacccttgtcacacacacaaaaatgtaactgtgagaagatgggtatgttaatctgcttcactacagcaactattttactatctatatgtatcccataacatcattttgtaaacctcaaatatacacaataaaaattattttaaaaatcacgcactataatccccacataggagaaggtaaaacataaagggctacatatgatttaaaacgatgttttcattttacaaatcctagaaggtcttcttaaaatcactgcatatatacctagtcaaagacctaagtaaaactaaatactctttatttgattatagttctgatatcttattgatatagtttggcacaaaaatatcacctgtctcaaatttcttctcataaattattctcacagtattcattccctctcatatttcccagaatattttttattacctgagttactatatcaagacactctagtccttatttaaatatctagaaggcaggaggtggtaaaaaatgtttatatcaatttgagattttttttcatttttttctcactttgttttatttcttttcttttacagtctgttcatctggggtttatttgccaaaagactgcttcttgcttaaagcacaatctattcaccttcattaactactggattcctcaaagttctattttctgctaatattggacatttagcaaatcttcctcctctgtatttgcttgtatcacatctcaccatttgacaaagccattaaagttttcttgtattgattccttgccatacaacttacctgtagtactggtttattaacatcaagcagtttagctgtgctaccgaagagtactcggtgcccctcactgacagtaattcccagagagctaaaaactaacattcagctgaaactaatttctcttttgatttggcaaatgagtgctccttttattaccctaattgtatttttctcttctgtttttgaaaaccattgattgatcccattgacaaaccagcttatctgtctgatccaaatcaatttgcttcctttgcaaaaacatttaactcatctagaactaagcttcaaatatgagaaaaaaaatgctaccaagacaaacaactcatctggactcattccttgaaacttaaaacttgccatacctgaattcctccactttaaactgtgcttgtattacatcagtcagcatgtgcttagtcaagagaagtaactcttcctcagcttcagtgtttttgttacatcacaaataaaaactttgctcattagaattttttaaagccaaatatttgtgaacaaatgatatgtaaattaatatatatgtgtgatgtgtgtgtgtgtgtgtgtgtgtgtgtgtgtgtctgtaagaaattttcagcagttacattgttgaagagtggtttttattatgtacaaatagtttgttcatataaagagtaatcataacacttctctttagcaaatgagattttttaattcattggagaaagatctcaatatactggacacatggttttgttaagcattttcctagaattgaaatgcacgaattttattaaatacccctttattcagattactgttttacatacacatgcaacaacattaatctataaacaatatacaatacgaaaacctgaaatccactatcacatatggcttaccatgttttcctgattgtttttagaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtatagaagatactcttcccattaattgactagtgtttaagatagcaattgaattgaaatgataatctattaagatatgaaattaattatctttattataagaaagtataatctagctaataaatgtcctcttcaattacatttagataatattgctagatatgtaactgtaatttcttttaatgtcctcatagaaaaagaatcaatttaaaacaaattaaacatgttattcttttagtgttcaaatactaagcattcactttaaaagactataccaaaattgttttaagctttcttgtaatgcacaaaattttaacatatttattaatgtcttctgaatataaaagtaatgcatgtttataaaagactaagaagagtataaaaatgcaaataaaaactatctgtaacttaatcaaccacatacaaccacatttctactatttaaaaataaagcaagcatggatttgtaacagaagaggaactaataataaaaatgaacggcatgcttatccatttttattaactcatatatgcaaagtaacgtccttaaaaataaattgttctacacgaatacatggacaaattaaaggcttttaaatcaataacatcttttggatttaaatattaaaagttactttgagaagattttagataaaacatttcattgtgttattttatcacacattaatttattcctcttcctcttataggtttcatccaaagaatatcaaaaggaggcctaattaaaaccaaaagaaaaagaaagaagcagagagtgaaaatagcatatgaagaaatttttgttaaaaatatgtgaatttgttatagcaatgtaacattaattctactaaatattttatatgaaatgtttcactatgattttctatttttcttctaaaatgcttttaattaatatgttcattaaattttctatgcttattgtacttgttatcaacacgtttgtatcagagttgcttttctaatcttgttaaattgcttattctaggtctgtaatttattaactggctactgggaaattacttattttctggatctatctgtattttcatttaactacaaattatcatactaccggctacatcaaatcagtcctttgattccatttggtgaccatctgtttgagaatatgatcatgtaaatgattatctcctttatagcctgtaaccagattaaggaatacagctcttaaaaaatcaagaacttcctgagtttcacatataaaatggtgacaaacacctgcttctgataaagtttatccaattttgtatttatagtattctattgtaataatagaattctattatgtgcttccctccttagacatagtttttctccttttgtactaaccagtacttccatctatattgagctaaactgtctttgaacagtcaactctgcatcatgtgcctgcctgatttggattggtttcacttttttttttgtttgaccatagcccattctatcagtcaagatgactgaataattgtgtgttaaatacaactcatgataaggagaacctttatggaaacaagaagttttatggcaatcgagagggaattatttatatgtacttcttaatactatgcttcccaatattttttcttactaaaaataacaaaaatatttaaaccttctgaaatctattcagttatcattaggatttgcacacaatgcaactaataattcatgctttaaaaagtaggttatttctgttgaagagaaaattatcagcagggaagagtctactagaaaattcatgtgctagtcattcttggggatttaatattttgctggagttaattcactatatccagacctgtatctttcatttattgctgagccatgtgcagtctggcatctcaacaacctcaacaacctcaacaacctccaagacatgtcagtttctgtagtgttcacctcaaatctgacactggaattggaactgatttagaaacaaccatttcattcatttggtatgactagcttcatgactagcttcatgaatagcttcatgaatagcttcatgacttctcgctaacaatgatagtataattctgcctgttcttcaggattgaaattttgaactcaatttagatttcctgttttccctcatataccacatctaaacagtctccaaatctttatgcttttttttttttttttcgaaaaagttcacccaatccctaggctttttacttttttctttttcttttcttttttcttgtttttttttttttttcattttgttttgttttgttatgtttttttagacagggtcccactctgtcacccaggctggagtgcagtggtgcaatcacaggacactgaaacctcccacctagctgggactagaggtgcaggccaccacaccagctaatttatgtaatttttgtagagacgagtttcaccacgttacctaggcttgtcttgaacacctgggctcaagcaatcttccagccccagcctcccaaagtgctgggattacaggtataaaccacaatgcccccgtttttactctttactgcatccttcccatcagtattaattcctcagaaatttagtacattcctccaccatttcaaaatgctcccagaactcacactagttggtacttaactacaaccttcaacctcaccatttaattttgatgtatgtttttggatttaccaacagtactttctttcatgactactttgatttagttaagaatgctcactgtacactgaatgttaattactcagctaattcacactgatttcctgtttaaaaatatgatcccctccaggccattcatgtg

SEQ ID NO: 13272 - DNA, 95020 bp, Human
ctcccaaaatgctgggattacaggcatgagccacagtgcctggactatttgcttttttaaaaaaaacaaattccttgattttcaagactgctcattcaaaataaactcataaagaatggctcaacagtaagtgctttcagtaagttgtagccctatttgggggtgtgttgttcacccaagttttggtgggtgtacatgtgttgtcatttcgtgggcttcttcttttccctggtcctctcacatttcttcactccaccttggtctgtcggacccctgtcctgcgatcagaagttgaggagtgggagacttactggatctagccagagtttaaactcttctgtcttccttacctggatggatttccaggtagactggttgtcatgtttttaagatataaaagaccctttgggtttatgcatacatatcaatagcctctttggtgtattaggaaagaaggtgagaaataagctgtatttgcatttatgtgtaaggatttgtgtaggatttcttctctcaatcagtaatttctttcaggcagatgctagaccatgccttgtaaaacatgccaaaggttttgctgcatatcttttagtcaaatttaaaaatggaaatatttaatgcattttttttttgagatggagtctcactctgtggcccaggctggagtgcagtggcaccatctcagcttactgcagcctccgccttccgggttcaagcaattctcctgcctcagcctcctgagtagctgggactgcaggcgcatgccgccacgcccggctaattttttgtattttagtagagacgggatttcactgtgttgcccaggctggtctcgaactcccgagctcaggcaatttgccggcctcagcctcccaaagtgctaggactacaggcatgagccacctcgcccggccttttttttttttaaacacagggtcttgttctgtcactcaggctggagtgcagtggcaggctcatgacttatcataacctggaactcctgagcctaagcgatctatctacctgccttagcctccggcatagctgggactacaggcatgcaccacactcccagctaatttttaaatttttgtagagatgaggtctccctatgttcccctggaactcccggtctcaagcaatcctcctgcctcagtctcccaaagtgctgagattgccagcatgagcacctggacctggtccaataaatattacaaattcgaattaggcatttcactttcatttatatacatatcctttcacaggattatttgatagttattaatgtatattatgattgagttttaatagttactttgggaaaacagaaattactgttccagtacttacttgtaagttgtaagtccacacaatgcacttaaacttcaccttgttcaacagattctgtagcacatgaaacacttgaaatatggaagagtcacttctctgggcactttgctcatttcgtctgctattcattcactgattggacattttattgatcgactactatctgcttggcaaggtgctagaaataagaacactaagaaaaaggtcaaggttcctgtcctcaaggccctctctctcagtccagtgttgtcaaggcttgatgaaacacaccagtggcaaacaagcacgcggggccttatttcaccggtgtgcggtccttcttccagctctgaaattatgtctatccaaacatcctaaatcaacaaatcagtgtttctaaatcatacaaccgcagctaacaaactgggaataaggcttcgattattctgacttgatttaaaacgatcactgccaattctttgccctgcgaatcctttctttgactactaagttaagctttacatacctcacttgcaagaggctatgctggctttctggaaatccgtaattaagttcagtgtttgtggaatggagtgtaattaacgaccattaattaacagggtttcgttcgtgagagcctgccaggctaagcagcagaaacacgagaaactgataaaaagctttcctcatttttaaacaacagtcgcacggaagttcccggcgggacaagggaacgtgggtgcccttgctactcccgtggacgcgggtagattgggacgctggaccgtatctccccgcccccgcccccacgcctcctcaggtgctcagcctgaggccttcgtccaggagcgctgccgctgacccaggctcaggagctgggggcccctgcacagacgcccaggtctcgggacaggcggcgactgcactcacggaagtacgctgagctctcccctgtagaagggcgcctctcctcccccacttcctcctccagctccacagcagcctcccgggccggctcctcctccttccaggtctcctcccagtgccgccgcggctctcaggcctgaggtgcggcgctcaccccggcagtccccagcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcgtaagtggccgcacttggaactggagccggccccctcccccaccgcgcgcacccacccagcgtttctccattgggattgatttccgagagatcccggcgtctgtctgtctcacccatcctacctctcagagtggtttatatcctgggtggaggaaatatttggggaaatgaactccctttggtacccatcacccagttacaccccgcttctcacctcttaaaattggttaggggcagcgggagagctttgaagcagacctgtgcttaaaaatcggggaaagtgggaaatcaacaaaggctggtcttgccggactccccgcctcctgtgccagtgtcgaggatttggtcaatatcatccccgaacttctttttctcctctaccagttaggcttcttggtagcctttttctgctttacaggcttaacgcccgtccttttcagtctccctaaacaagccctcccccactctttccgcctctgtctgattctgtttctccttactccttttgcagacattctgatgacttaaaatgaccatactgtcctattgaattcattgtgtcttatctctgggactgtcagacatttgcacatttgaggttgaacagatgaattgaatgtgtcatctgttctttttatagtgattcactatttaggtcattgttcagaaggaacaagggtgtttgctgagttttcactcgctgcaggtcatttgaatactgcagtatttaataattcagttatgttttcaagttgccaacgttccgcgttgcaagggccgtcaggatttataacagttattgccattattgtgttagaaattgtctccgactttactgaatgctgacatcattctcaccaccccacccccgtgttagcgttaggagtactgttttaatgaatgttgactgtttttttaatgatgtttaaatcttgttttcaagagagaaactgttcttagggtgccttctaaacgcttagaccttgtaacaacatatttttgtttccatattttctgtataagatatcccttcggggtgaagtggaggaaaattttgacggttagtacgtggataggaccatcttctactacacacatgcctaatttgagggtggtctcaatggttttctatgactgttaggacactcagcagaatttagtcttagtgtttttctgaatgttactgagtatcattcattttggtaacaacctttgcagcaatacatagattagatgcagttaatggaaactttgttagtggagacattattttatgtagcaagcttagttttatttgttgttagcagttacagtgctttctgtgagacctggagcacagattttccaacatgataaaaataatcattatttaggcaacatttaccaatttcacattccatttagtcattttagtcagcattatctttttatttattgtttttaaccacaggggtgaataccaaacgttatctttaaacatttttgtttccagatactttcaagtgtataccttcatgagacagaacattttagttgctcccaagggttcaatgtgagatataatttgtagagaaattctaatgattttgaaaatatatgtcttcagtcaaaaattagcatttaaatacttcaggccaggcacagtggctcacacctgtaatcccagcaccttgggaggccaagatgggcagattgtctgagctcaggaatttgagaccaacctgggcaacatggtgaaaccctgtcactacaaaaaaatacaaaaattaaccgggcatggtggtgcacacctgtaatcctcgctctgcgggaggctgagatgagaggattgcttggaaagttgaggttgcagtgaatggagattgtgccaccacactgtggcctgggcgatagagagagactgtctcagaaacaaaaacaaaatcaaaaacaacaaacaataacaacaacaaaataaagttgatggcagtgttttacaatgttactgttaattcttcagcagtgctctgagtttagtgtaagataaatgagaggctgataaactttaagtgtttttttttttccatgaaaaatgcagtgatgttgaactcttcatgatatttgctactgctgattacaaaccagggtgactaatctttggccagtcattataatcaatgaatgtgttatgacctcacaggtttacatgacttcactcatagacctttaatgataaagtaaaattgaacttgggtttggttgcatataatattttgaaatattcatcagcaactttgttaccgatagactacagagctctaggtataggtaacttaaaaaatggaaaccaaccttgagtttttttcttttttctttttaaacaaaacgtatataaacacaggtttttacttactgagcttttcagatttaacaaaaatttatgtaaaattttgctgaattttctagaagggcactttaaatttaacaagcattggaatccaaggtacttgggatgccatttccaatattaccagttggatttattgttatttggtattaccataaacttttaaaagaaaaaaagccacataatgaaaaagtatttgtcaattcaagagcgcctttcttctgaggggagaaggatttgtgaggagcagtggttgtgacgtccactcctgttgctttttccagttttggtgtccacataccttggggaagctgtagaattattttatgcctaatttttctctttatagaaaattattattgaattatctgcatagttcatagttttgttgtgaaaattaatgaatcaatatttattaaagggaaggacaaagtactaagcaaaatgttaaggcggcccctcaaaaaatcactccagaaatgagtcaggttcgaagtaaaaattcacaaatatagtgattttcaaaattatgaaaaaacattcgcattctgtttttttttctataagcatttatttatgctatgttgtaaaacttacataaaatttaaagattgtatgcaggctaataattagagtcatacttttcttgtggagactaattggaaaaattaaaaattacatcctaggtttaattataatgatgacatcttattttggtaaacatattttataatttgctaagcacttatatctcatttcattctatagcccacaccaccggggggaagtaaggggaagcagatatactcattcttacagatgaggaggaaatggaggcagaaccgtttgcagtctagttatttgagtaggttggtgtgagtagagggtaaggaagggaaggatccgaagacagggtgtaaaattcaaatcccacttttattaattcaaatattgaatttttaaagaaaataactgaacaattttaaaattcattcttcaaatatatgttatacagttctcattttatgtatttctttattttaaaataatgctataatgaatgacactggattcttgcctttccccccattaaacgctaatggagccttatcttacagttggcaatgtgtagatgtgtatgccttagaagcagaaggtccttcaatggttctcagtcctaacttcatgtttgcaatatctggaaagccttttaaataaaactcttgccctggctgtatcttaaatctaaaagtagatctctgacttgatattccagtggcctggcctgtgaatcatttctcgttgactagcctgtcttaactcaatttgactaaaaagtcttcaccaagagatgttagttgcacctctgtttctattaatgctggcatcattttctctgtcaccttggaaatactttcatattcctccctctcatgttctatttttctgtgtttctcctacttcaccaccttaatatcagtcagtgattagtcaacaggcagaagctcctagaaattcttcctttttaaggttttcttgattccatctctgctttctactccttatttcagtgtagttatgacaagcatagtcagtggcactcaggtcctcccccatccctctgcccatcatttggctcttaaacgtgcagaacatcttgtctgtttctattcattttatctttctgtaacatcctttttcatcctggtattctgttgcaaaaattttcataataaagcttccattgccagcaagaaagtccaaaccgcttaacatggattaaggtcacttgcaatctgtcccaacctgtgtgtatttttaaaacttcatgtaccatttctactcttaccattttaacccttttcacaacactttacaaaatgatgccagctcattttttataaacttcagagtagctctgattatattggctgatttttctcatcataaataatatacatgtatattaggggacataaaactaggctataattttgttatttagaaagcaaatcctatattacttctgattaaggacatatgatgtttcatagagcattatgaaagacaagggaaaatatgtggaaattgtagttactgcttctgttttacagtagttgttgactggcatttttgtttttcttttgattcaaaaaagcattttttaaaaaatgaaaagtaaatctgaaactggaattgtagctttgaaataacattcagtactatttcatacacatttatttctatatacatgtatgatagtttttcagaagttccttttggtgaaggctcattggtcaactcagagtcagctaaatatattaaacatgctttatcttagaaaggtcagtgctgaaagcagacaaacaagttagtttatttggagggtttgaaaaatggacttgtcattgtttggcaggttgcccctccttggttgtcaaggtcacattccgtgaatcaactgcccttcaagtacagtttggatagggagtgcatccaaaggccatcctcctgattggttcctctgagcctcttgtctgtctccctctcactgcctcctctgatacctctccctctgtatcgctctctcttttttctttttctgtctcttgtccttcctctctttttcctttcctctatctcttttcttcctttccatccatctttctgtcctctctcccaaactcaatcctttatattttagcacttcttggcatggatgtaaaccttaattttgaagtcccagagagttatttaatggcagtgtttccagtcattaaaaaaaaaaatgttgaggatggggattctgatgatgttcttggacatactttttggagggaaatggagtctatcaggagagagttgcgggcataggaaattaagtcactcagcttcagatttacactgctaatcagtgaaaactcttgtcaaccttacctcaccctgtgtattctccccacctcgccaccattgataagaaatgtttaagctggcttttctacccttctttctctttttcttcttcatttgagttaatcacttgaccattaatggccctttgaaaacactgaggaaagaaaagcccttttaaagacagaatttaagttttacattttctactcttctagggaataacttattaatggcatcaattgttttcaggacgaagatgataattaaatcccatcatcttgtattttcgtggtgtttcagattttctaagtttgcatttatttattatcaccttcagaaagtttctttttaaagtaattacagtgggcattgttattgccattcgatagaagggaacagagattcaaagttactgcttcaattgatttgcagtgtttgtaaattttaattccaaactgtttccattagatagtgctgcttagatcacaaacattttttttctggtctgtcagttctcttaccctaattaagctgttgtacactttcattagtcattcttagatgaaattcaagtaacaattatttttatggagtgttttattaactttgttttttgtagtatgtgttgctttttttttttttttgagatggagtcttgctctgttgcccaggctagagtgcagtggcacaatcttggcttgctgcaaccttcgcctcctggattcaagcaatttctggctaacttttgtatttttagtagagatggggtttcaccatgttggccaggctggttttgaacccctgaccttaagtgatcctcctgccttggcctcccaaagtgctaggattacaggcatgagccaccgtgcctggcctgtgttgctttttattccttaatttttttatatagcatcttttatcaccttgtacccagttttctatgcaagtatttctttttcactacacagcttcctcgtaagactttaacatatgtctaaggtcattttactttctctatctcttcattgttctctttaaaaaacttaaatatcttaatgataactttaatatcgagatggcattttggatgaaaaacttcatcagcttttttccctcacaaatttagcatgtagatattgacacattccttttatattattctgccatttctgtagcatttcaccagtatgcaagtctgcacatgaaggtatgcttaggaaaacttaatgaacatccatttgtacacctgattaccatcatttcatgcctataatgtgcagatagcctgatgaaaagcaacaggcttgttcctggtattattcaaggaactcatgctatgtgctgccaatagagtggtgttttcattcagagaatgctcctactgggctctttttctctgtctttgttgaaggccttctcctaataacttccgagctctctctgtcttatagtgccaagtaaagaaagtatctgaaacccaaaattaagtagagatgttacacaaggaaattgttttaagggtaatttaaataattggatgtttaatagaggatgctttctgcattcttgaggggttcagacgtagtggaaatgacttatttatatatggctactttaagattgagacatagctattgaatttactttgttactccactgtccatttaaacttttcttgagttcttataatgtggcaggtgcaaaagatgaattagagtaccctacattcaaagaagcaatttatcataaggtaggcagaatagttttgaccaaaaagttataaaatatattgtaagacaggggtccccaaccctcgggccatggaccagtaccagtccatagcctgttagggaccatgctgcacatcaggaagtgagcagcaggagagtgagcattaccacctgagctctgcctcctgtcagatcagtggtggcattagattctcataggagcaaaccctattgtgtgaaccctgctgtgaagtgtgcatgcaagggatctaggttacatgcttcttatgagaacctaatacctggtgatccgagttggacagtttcatcccgaaagcatccccctctatgtccagggaaggaaaggttggggaccactgctgtgagctactatttgaagacaacccagaagtgatttttgcttgtaggtttccaggcaaagcttgagaaccagttctcctatcctgatgtagaacctggtatgatctacaacactaagaacgtgtacatacctgtgcttgtattactctcattaggactactgtggcaatgtcccaagcaagcactattcaagatattgaccctcaaaagcaaacttacctgaactgttcttttgttctagtatgcactcaaaaatcatttaattctgatgaaaaggggtagttgtgtgattttggggtcaaattttagacccgtagaaaaaaaattgtatatgtaataaatttacatattataatttatacacacacacacacacacacacacacacacacacagagtttcactgtgttaaccaactctgctctagaaaaagaaccgatggggttttgatgacgagctgctctcttagttatgggaggtggggactctcttactcatagcatttttttttttttttttttgagacagagttttcctctgttgcccaggctggactgcagtggcgcaatcttggctcactgcaatctccacctcccaggttcaagtgattctcctgcctcagcctcccgagtagctgggattacaggctcatgccaccacgcctggctaatttttatatttttagtagagatggggttttgccatgttggtctcaaactcctgacctcaagtgatctgtctgcctcagccgcccaaagtgttgggattgcaggcatgagccactgtgcccaacctctttttttcttatgaaagacttttgctgaatgaaaactaagttcattttctacccagaatcattttgccgtgatgggagagagccaacattggtgttttactgatgccagatatgactgcatggagctctattaaatagggcgtggtttggttgggagttacgtctttattttgaatttgtggatttttaagataagtgtcagaaagcaggattctttgtaaccctgcaattcgtacagccagcttttgtctactgtagatgagatttggcagctactacccagaataagaaattgattttaaaagttcaagtgaatgcattccatatttaagatgtacattcgttctaatttcacaaaaaggtgaaaagcaattgtaaatgtttcctttgccagaataatttaagtgacttagtatttaatgaaacaaaatgattatggtgatagcattttaggactgtttttgtctgcctgtatcctgctttatttcctcctatatttcaatcagtttcttgagattaaagacaaaaatcttttttactttatcttctttctcttcttgactcctaaatgttgttgtccctgagaactcactcattgcccctcctctttcgacgcttcccctggctgaataaccccaactgtgttctgatacagcatactgtctcaggcagggcttcagactacaactggatgactcacagatatctcaaacaaacatattaataattgaattcatggtttttctgtaaatactaattttattttatttcttgagacagggactcattgtttcacccaggctgtttgcttactttgtagcacttgtaatcacagctcactgcagcctcaacctcctgggctcaagccatcctcctgtctcaggaccccagctccacccccaaagttgggaccacaggcgcatgccaccacacccagtgaattgttttattctttgtagagatgggggtcttactatgttgcctaggctagtcttgaactcctgtaagtacttaatctgccttctgcttctctgctctctaggcttttctcccatcaatgcactcaagaaggaaatctaggtggcattcttgaatgtcttttctctcatattcaggcctccagcgattgctgttgtactccagatgtttttttccatctgtcacctatctttccacccaccctcttactgcagatcacactcacctgctccctgagctgcggccagtcctttgctttccttgttccatttttttctccctctcccttaatgctttccccatagggcataacatttagttttctttagtagatgatttcattcttcttaaaaaactcagtggcttcaaatgaaccttgggataaaatacaaagtttaaccatggccaaaaggccctatttgacttagttattgccaggctccttgaccttatcttgtgccactcccggcttgtcccctccttcagccatacctttctttgtagctcctggagattcaattctttcttgccagggtctttctacctctgcctcacatattccctccatctcttcattccacttccctcatccccaccccccactcccctccatcctcaatacacaaatgctcctaggcaccctccttctgatcctgtacatcttaatgttgtggtgagttccttagaaataacttctctgtctactttatctaaaagagaactttcttccccattctttaaagatgatttccttagagagactttcctttacctagaggaaatctttcccctctcatccttagagataactgctctgtctaaagaaggtctcctctccctattcccaaaaatctctctcagctaattgtttgcttacttggtaggacttgtaatagtaatttatttattggctagtttcttgcctctaagggaatgtaagctaaattcctccattaagagcaggaatcagccaagcacagtggctcacgcctgtaatcccagcactttgggaggccaaggcaggcagatcacctgaggtcaggagttagagaccagcctgaccaatatggtgaaaccctgtctctactaaaaatataaaaattagccaggcgtggtggtgggcggctgtaatcacagttactcaggagactgaggcaggagaatcgcttgaactggggaggtggaggatacagtgagccaagatcatgccattgcattctagcctgggtggcaagagcaagactctgtctcaaaaaaaaaaaaaaaggcagaaaccaaggttgttttattcatctggtatctctagcacttaggaccttgctttatgtagaggaagcactcacttcatatcttttatgaatgaatagaaaacaacaaaagaaaacatctctttaaaattaaaaattttactcctgattattgtgtctttggtttattttaccttaatgacaaagaaattgaatagtggtcctaatctttgaccaagaattgattagattaatcttgtgataagaaattttttattaaatagtcaactattaaaaaaaattaagcctaggcaatgtggcgagaccccacccctacagaaaatttaaaaaaaaaattagcttagcatggtggcatatgcctgtagttctacctgctcaggaggctgaggtaggaggatcgcttgagccaggagttggaggttgcagtgagttatgattgtaccactgcactccagcctgggtgacaaagcaaaactgtgtctcttaaaaaaaaaaaatagaataaaataaaaattacagcaatatttctaatgcaagataatttttctaaatgggaaaatcatatttataattatactttggaataatttacttagaatatttttttttttgctcaacattcagaatatagaaaatgcatagtaattctctcacacacgcacatgcacacacacacacaccagaacaccaaaacaaaactttcctgcctctaggcagcatacatttttaagagctttactgagatatgtgacatacaataaactgtacatatttaaagtgtatgattgacctgcataaattcctaaatgaatgtaaccctgaacttgccttataaagttatcaggaaaaataaactatatcaaataatgtatgcatgcaagagactaccaaatgaataatgaagattatgccctcagtgaatagcaaatggttttaaaaaatatttatagataatatcaagagaatgattgctcctcataaatcagaagatattgcttacactttgtttcatttaaactttggtctgccgcttttgtattttagccggatgtttcttctcgtgggagctcccaaagcaaacaccacccagcctgggattgtggaaggagggcaggtcctcaaatgtgactggtcttctacccgccggtgccagccaattgaatttgatgcaacaggtaaattttgatgcacaattttcttttcattgatttcatttgattttttttttgcaattggtttagtttaaatgtagccatttaatacaattatatagataagcacctcagcttcacagggaaaattatataaagacaaacgatttattatatgattttttcctacaatttttgtggtagatgaaagtattaaaagtacgttgtgtttccattggttcagatgtcttctgccgtaaactgataatatcaacccacagaaatttggggtaaacctgttaggatgtttttgtaccttttctgagaatagggagctcataggcacagaaaggcattctgctgcttctctgtcaaccaaattgaagcatgactcactattgtagaagatcaaatctctgatcatgaatatatccaagccttaggctgtgctataaaaagcagttgaggaggctgggcatagtggctcacgcctgtaatcccagcactttgggaggctgaggcaggcagatcacgaggtcaggagttccggaccagcctgaccaacatggtgaaaccccatctctactaaaaatacaaaaatttgctgggtgtggtggcgcctgcctgtaatcccagctacttaggaggctgaggcaggagaatctcttgaacctgggaggtggaggttgcagtgagctgagattgcgccactgcactctagcctgggtgacagagggagactccatcttaaaaaaaaaaaaaaaaaaagcagtggaggaatcttttgcattcaggtggacttaggtgacgtaaacatttatcaagactttgttgggaaaattatatattatggttctgataacaggagaattttagggataattttcagtgtcaggattgtggtagcaaggagaaaaatagcatgtgtaagatgagaaataagctttacatttttgccagtgaaataaaatatgcagaattctgtacgcatttatattggtatatttatatatatttgtgaaatcttagatagtccttaaggaaatagtgtgacattcttctagtacaatagtcttacaaaattttttattgattctgatttgctggctttgacagagtgctttaagataaacctgcagaaaattaatccttttttccatattgttatttcctgccagtactaaaatatattgattctgggaaatatgtcagtgaaacaggaatcatgatgtggactgttccatttgacattgtgatcagtgccaaaatggttgttagtcattaagccagctgttaatgggaaccagatcacatgcacatgttttcagggttttttttttccatttgaaattatctacattaaactctgttgttgtatttttccatatatggctaatacttggaaaactccaagagtttgtaaaaaggcccaattttaccataaatggagaaatacctgtgactcagaatatgatagttttagggcatttattgtctaacaaaatatgagaactaataaaaggaaaccacagtttagattttgataggtcgaactcttcagatgtttctgtacttaacactgtaggtttttgtgcattgcaagataatttattgcttcagataattttttgtttattgaaaataacatttgcacatggtaaaacaaattttaaagagtctcaaagggtgtacaatgaaacatacaactcacatcagtcttctcagaagcaatcacttttttttttttttctttttgagatagggtctcgctctgtcactcgggctggagtgcagtgatgtgatcatggctcattgcagcctccacctcccagactcaagtgatcttcccacctcagccccacgaggagttgggactacagaggtgtgccaccagcccggctagtttttatgtatttttttttttaaagagatggggttttgccatattgcccaggctggtctcaaaacatctgggctcaagcagtctgcccccctcagtctcctgaagtcctgagactacaggtttggcccactgtgcccagcatgaggcaattactcttaacaatttcttttatccttctagaattttcttacttctatatatgtatgcatccttgaaaaaaaggcaactcaaaaatctgatgcctccctgcaccgttctaacaatagaaatctcttgtagatatttccttatcggcatatgaatttacctcattttttgtaaatcactgatactattctattgtatatgtgtacttaatttgcttaaattatattttctactagtggatactttggttatttccagtcttttattatgaacactgctgtagtgaaaaggttatacacaagtatttgtacaaatatgtgaatatatctgtatgataaaggagatttttggatcaaaatgtatgtatatttaaagttttgttaggtattgtatactttccctcacagaagtttacacccctccagttgtgttttgaaacccatggcaacctcatttattagcatatttttaaatcttcgtcagttttataggaggagatagtatctgttatgttaatttgcatttctttaattaacagtaagactgagtgtcttcatatttgtttgtaagccttcagtatcccttttcctgtgagctacttttagtatatttgcacatattttctgttaatttgtgatttttaaaaaatgaatctcagtttatggcactccatcctttcagtgtttaggccagaatctggagctgtgtttgacattgaatctgtcagtaggtcaaaatttaactgcttcttatcagtccactgctaatatcctggtccaagccaccactgtctcccacctggactattgccctagatttctgaattagggcattgccaggaacgagatggcacacttaaattgaggtattttgactatttacagaggtctgtgcaggtacctggggattgatcgtatatcagcactagttaaaatgtgacctctaggcctgaaggcagcgattaccagaatctgaagacagaatactaggtgtagagagccacgtgacaggagctgtggcttttttcagagggcaggagccagcccaaaatgaccaggggattaaaacaatgagctcactctgcttcctccctttgattctctgtgctgtgcctcataaacagtaggcacattcccacttcacccttgcctgggctgtgtttcctgcctggaacattctttccctaaatatccactgagtatctgcttcaccatcattttgagaattgctcagatattatcttctcagtgatgaccatctcatttaaaattccaactcccccttctcaccttgtacttccatcctcttctctatttttcccagtaatacttacattgttacatgttatttatttgtttttagtgaatgtctctttccctcaattagaatgtaagttccatgaggactgttttttatctttgttcattgctgagactccacggcctaaacattgtctggtgcccagcacaagttagtgctgaataaattgaagagatgaatgtacgataagaggtttttatatagtaaggaaataactaaagtcctttagtggttgtagatgtgtatatatatatatatatatttatatgtataatacatatattcttatgtatatgtataatatattcttatgtatatgtataatacatatattcttatgtatatgtataatacatatattcttatgtatatgtataatacatatattcttatgtatatgtatatcttttgtccctgtttatgatatttctgtaatccttttgtataacttctgagacctccccagtggaaaaacaattaagacttcatttttttacattagtatttttattcaaatggtgtttatttgaatgtaagaggacaacatagatttaaataatccagtcaagaaaatgtatatctaaaatagccacattaaactatatggtattgagtttcaaggaagaaatgcttatagcttatcgcatcctgctaaactttctttatgtctctctcccaaggaactcttcatcccatcttagcccaaacatataagcatccctacaatacaaatgccttctctcttttttattatctcaagggagacagaagctgagcagatatgtggggtttctgaaggcagcctccctggggctcaaaccctggttctgccagttaccagctgttgacgttgcacgggttactgttaggttaccctcatctccctagtgcagtattctcatcaacctgctccatgggtgtggattacatcgcatgagttaatttacatataggtgaagacttctaaagtgcttaggacagggattggcatgttgaaatggctcagtaaacatgagctgtttcatgtcgctattcctcccttttgccttcttagagaccctccctattccttcatttgcttctgtatccctgctacattctcccttttcctttcttccccaactttgaagtgtgtttaaagttttttccctgaaaaactaatcaaaaactgttttcccttgaacatgtatcttttcttagtcagtcacatctttctctcttctttcctttacatccatgatttttgaatacatattgtgtcttcatcacttgtcatgcttcaatccaatagaatcactgttgggttgtggcaccgacccaacccagcagtgattctaactgcgattgttgacagcagcctatttgccagcttcaggggatgcttatggttcctcatctttttggactgctcttttacaattcaccccattggccattccctccttaaagtttctgctcttcgtctgcttgaaatgatcacatccttttatccctcctaaacttgatactattgttaaacctcatggtgtcatgaaaaggaataggccttgtagttagacagacatgggctcaaatctagcctctgtcattttttctaacattaccttgggaaaattacctgccattctacattgtataatacattccaggggtgatcacgaagagtataaattggttagtttatttactttattgtgtttctgagcccagaacagattttagtgcttaaaagtgccctgtcctcatgtttttaatatttgggaagtaatttagtttatgaaacagtctcaagaaaattagctgtaattatatgatgtgggagatattacaacactttgtcattattcacatttttttaaacttctgggaagacctttggtatgcccatgtgactttttctggcccataaaacataaggagaattgtgtcatttctgggtggcagggtttaagagctggggcattattctgccccttcccagatgtcacagggagtagtgatagttgaaatggtagaacttctgtcaacctgaggcctgtggtaaggaagacataaagcttagactcttactcatatgtgtgtggacaaaaaaaaatctattgttctttttaactacttgagatttgggggatgcttgttactatagcataatgggaactaaactgaataacacatatagggatattaaaatggaatattatcaataatcatctgctggaaaatggttattaaaaccactttctattctgcatgccagtttggtcttcctttaagtttctagtctgacttactgagtatctgagtgactaagtgactaggtatcattgcttatgctaaaaatggcccctgacgttaagttgcatttggattgggagaaactataaatagactaagtacctgatagggatgtcatagctttggggttccttgagtatagtgacacaaaactggcatgtgttttgtggcgactctggaagctatggctatggagttgttgcaaaagatatcatttctggggggcaagaggctttgaagccagaatgactcctgcgtctaccaggttttgtttcttcatatctgagccgtcacctggcggggcaaagagaagtactctggacagctgggtggacagttgtataggaaagttcatgtaaggattctcaccaaagaggtatgtctggttctgtcctgctggaaagctgtggttgtgtcctatatccttgcaagtagattggtgcttcatatggcctttgatagttttgtgagtttgaaagtttagttgagccttaggaagccgcagatgatgttgcatcaacatttgaagtctgtaattgtatgaaatattctaggctggttgctgcatagtctgtttctcctttgaaaaaatagaatagtaactatattccttcctacaaaaaagaacaaacctcagctagctctagaatcacaacaaaaattttacagtaaagtgcttggagatactacaaatgcttggcattaagtaatattttgtaaaatggtcctttcctctcccattcaccttttaagtcaggttctgccatactggtagtcttagtgcactgagtacagttctctttcttattaagctgaattttttgttgattttttttttcttactgatgttatagtatgtttgttttcctgagtagactataagctatctaaaggcagggaacacatttatttccactcaccatttattccacttccatatggtgggttgcctgtgtgtatgttccatgcaagttttgggctcttcatgaaaagtaatagaaatagactctagctaaatttaacagaacaagaatttattggaaggatgttggtaacttaacagttatctgaaaaaataagcaggaaccaagagaagctaacaaaagaacaaccagtggattttattgttgctggtactgctattgctgaatgtggagtaacaccatgagaataatttcttgtccatcatgcctctttgcatcattttatagagatttaaaacttttatagtagtgtctgtttgggtgagtctaagtctcatatctgtgaaagacctggaaagcctgtcttatcttacacaactaagaagattatgagcttgtagagggaactaaaaggtataggattaaaagggtgcctttttctccttttgactggaaaacagggtaataggaaggaaacatcctttgcaaataaccctttttatctgttgggctaattagtaattcatgaactaattttactttgtgtttaccagtgacgtccctggatgttagatagtatatcatttattaaaaggccatgtaactgttgcttgtcacgtgcattaagacatacactagtagctaattaagaaaatctggattttgcttttaaggtatcataacacaactttcttagcttttaaagaagacagatggacactttagatgtgctttcctatcctgtaacatgattttggtggtttgagttgggggtaagagagaggctttcaaaaatgtatttgagagatcagtctaaaagttattttactgtaattctgaaaagtagacataaatagattcataccaaaataaaggaggcataactggaaagtatctaactttgcctggggactttgaagaaggcttcctagattagttggtgacatttgagctagctaatgaaaaatgagatgaaattccttagatgtcgaagagggttctagcttgagaaaacagtatgtgtatgctgagtaaaagaagttagggactgataatcaagtaattccatgtgccctacatatatatatatgtatgtgggcataagggttatacgtgtgtggtggtggggttatggtgttgagggcacgatgaggaataaaactggaagtagctgaggaaagatataaatgagtttttaaaaacatactctaaaggtctagccaaataaatttaccattaaatcttaatgcatatagagtattatattagagatagaaggatctagagccccatagggacatcttggactcctggttccttgtagatttcacatgaacattgcagatgaactaatactttcagtacccgtcttattaattttcctagtcacttttttggtaaaatgatagaagttacatgaaataatgaatattatcatatacatatattcaaaatattatagacacgactttaaaaaatgtggagtttcatgatacaaagtttaatttagtagaaggtacaatccaggatagaaaagttactcgctgctttgatttttgaataatatttatgctttagtgagccttcaggagtaaaaaggaaaccttagtccaaaatttagatttgcaaaagttatctccaaaatgtgctgccctgttaatgttctttcaagatcttgactctggcttgtcatctttatttttctttttcccccagatttgcctgatagaatgtataaacaaagccacaactaagatgttttaaaaagtttcttattttatatgtttatgcaatgattgaaatattacaacttgcttttgcttttgaaatagcagttgccctcttggatttgtaaaccttttcatccagtgactcttcataatttatagattttaagcaaggtctgcataatgacggaatagtttttttcccctaaattgaaagaataatgtgaactttgatatgttgtggaattagtgaaaatgaaacagttattttgggtatgatttctttgttttagtctaagatgattgataggtagaaaactcacaagtggatgatttagtttagggattaatgatctatgtattttcagtagtaaagttattccaaactataatagattgcgatgcaaaacaatattgagactattcatgtagcaaacctagactgctcatgtagtctgttatctgttttgccttcatggctgcattcgtttcctgttgctattgtcgtaagttaccaaagataacacatctgttatctttagttctggaggtcagatgtccaaaatggattcactgggccaaatcaaggtgagaaactgtttcctttccatttccagcttgtagagccattggcattctttgtcttgtggttccttcccttatcttcaaagccagcaatagctaccggggtcgttctcatgctgcattactcgaacattgaccctactgccccccgacccttgtgattataatgagtccacccagctaatccagacttacctcttatttcaaggtccttaatttgatcacttctgcaaagtcctttttgccttacaagggtcacatatttatgtgtcagtttctgggaattagaagttgaatatctcagggatattattcgcctaccacagtgcccttttatgtattttcttttttaattatttgttatttttttctttaaaaaagagagttggggtcttgctatgttagaccaggctggtctcaaactcctggcctcaagtgatcctcccatctcagcctcccaaagtgctaggagtacaggtgtaagccacaattgatattggttatactgcaagctatgctgaggcaagaaccatgcttatataagtaggcattgctgtctctcttgttctttttcccttggcagctttggttataaagaatgcaaactagatttagaagatgcaggctcagattcagactctgatacttattaactgtgacgttgggcaagcaccatccacaatttccccatctgtcaaataagcataatacctacctctcagggttgccatgtagatcaaatgaggtaatgtcagtcaggcatggtggcctggtggctcatgcctgtaatcccagcacttcgggaggcagaggcaggaggattgcttgagtccaggaatttgagaccagcctgggcaacataatgagatcccatatctgattttttttaaaaaaggtaatgtctatgaaggtattaggttggtgcaaaagtaattgcgatttttgccattactttcaatgctttgtaaacaagaaagcattataccggtgaagaaaggattgtttatgttgtgcccatactagaactgtagggaactaaataaatacggaaaaggaaagaaataaagataattgtggatattcttaaattgattatagcttgatttgtattttaacttctgttattgtgacatttgagaaaatcctcttcttataacatgttttccttttctagggaagcagatgctactgacagtctgagccttggccatgtttcttagtaatgtgtttttttttccacccaaaaagatagactgctaatgtacattgagaaaagagaccatgtatcactgccctacgaaagtctctttgcttagaaatgaaggcttacctacctgtttaatttttttttttttttaaaggagaagctcctacctttatattccaaatacagtgaatggatgtcacctaccactaactgtttctgtcatacagaagggcagaggtcagattactcttcttcctacccagaacagcttgctggaatgcttgccatttgttcctagaagggcctggctgtaggttgagagcaaaccttggctatgccagttctgtggtcaagaaaaatgctgtggagtattttctgggtataactaggctttgtatttaatagagaatataaaacatttagctgttttctagcttctgcagtacaatttccatctcgttgcaattaaaacactcaggcagaccctaaactaacttcctttaagttttacttcctcctattgatgaattttctgtcttccagagttgtgtctaggtatctctacagttgcaactgtcctgtaaactaaaaagttaaaaagaaaagtagtttcccttcccttgttaatacaaaacaaatttatactaaggattttttaaaaataaaaatgtttctcctgatataatctgttatcccctgttacagaattacacagagagctggtaagcactttagaaatcttttagtctaattcctttactactaactgactgacagtcatacagttagtcagtattttaatgttttcagtattttactgaaaccaaactcacaagctcttttaaagtttcttcctttccctgctcactttgacctgactcaacccattctttaggacttaacatgggattggctttttttttttttttttaatccccagtaaagaggttttgtcttaaaatgttagatgctttcaggatcatttccttttcatggctagaaggaaacaaaccagcattgataaagcagtgagtattttcaaaaggcctgtattctttgtgctgcactccagcaggaccactggaattgctcatggaagaagagggagattttgattctttattcgctgtggtagtaataactaactaactcaatgaataccaatcccagtgaaatgagcttcattcctgttttcctctggttctgcttttctgactctttttgtttatttttgggaaacagctgtatcttattttatgtaaaagatgtttctggatagttctatataaattaataacacttttgcatgtccatggattatggttgcagaacttatttttgtatatataaatgatttatttttcaaatactttggatttagggaacttggtctcttggccattttaagtcaatacaggtaagtttcaagagacatctgaagacactttggaagtttataaagcaaattgtcctttcgttaatagtactagttctaatatcttaccactacttattatttgtcagagtttcttaaatcagttaacaaactgtatttccttactaagtcaacgaaatcattaaccaccagtttagtcttcaggagtatctagaatttttattttttaattagttattttatgcaatattctactctaatagtttaattctataacatagaatagaggttcctaggaaggtcagtgcttaaaaaaagaaggaagaggttcctaggaacgctaatgcttaaagaaagaagagcttgtgtgattaaaattttttcttgaattttatgaactaaaactcctttacatgtaagagatgaaaatgtaaacaaagttaattaagaggggatgtgggagcttcaaactaagcttttgtatatgaggattgaaggatatttatccacactactttttaaaaaacctttaaaacattttataaataatgcatgtccattgatgaaaatatgagaaaaccagacctacttaaatctcaccactcaggaaaccaagggccataggatatacttttgtgtgtgtatttgtgcatgtaccttatggcctgtgtatattctctgtgtgtgtgtgtctgtgtgtaaatatacaaaatacataaagttataatttactctgtctcctgttggacattctgtttgacatgcttattagtcttagttcatattacaaaaagtttttttagttaatttttaaaaattaaacttagaagtcataggaatgtgtgtttcaagatttctgatacatatttgccaaataggaaaatactgacacaagcagtctttgaacgaaatttgatactatcttcctttgcctgacaggtgaaacatatatcttgttttaatttacatttctgtcatttctggtaagcttgagtcttttttcatatgcttattagctctttctgggtttttaaattttgttttctattatccgttttcattcttgatctattatattattcatttttattcttggtctattactcttctgacacatctatttttaattaattttgaaaaagtcattttttatatatatatacatttctgttcaatgctacagctactttttctcctgacaaatctgtcctttttaaaaacagttttattgagatataatttaccataacattgacctgttttaagtgtacaattcaatgaatttttactatatttatagagttttgtaactattactacagtctaattccagagcatctccatttaccctaaaaagaaatgtgtccaacatcagtctctccccatttgtacctccagccctaagcagctattaatttactttctgtgtctacatatttttggttttggatattttatataaacagaattatatgatacatagtcattcctattgtagcatgtatcagtgctacattccatttttattgcctaacagtattcaacggaatgaataaacattttgtttataccagtagatgcacatttgagtgttttctgcttcttggctattatgaataatgctactatgaacattcatgtgcaaatctttgtggggacatatgttttcctttctcttgtatagatgtctaggagtggaattgctgcgtcatatggtaatctatatttaccttttttaaaaactgtcaaactattttcaaaagtggctgtaccattttacatttctattagtaatgtatgagggtttcagtgtctccgtatccttgtggacactcatattctgtcttttttatattataataaccatcctaatgagtgtgaagccatattttattgtggttttgatttgcatttacccgatgatgaataatgttgaacatcttttcttgtgcttactggctgttatttcttctttggagaaacatctattcaaattctttgctcatttttcatttggttgtttgtcttactgagttgtaggagtttttcgttttttttttcatattatttaggatacaagtttttaatccagtatttgataagcaagtaatttccccagttttgagggttgtctttccactttttaaatggtgtttttgtagcacaaaagtttttaattttaattggctaatatatctactcttttatcattatgcttttggttttctaaatcattgcctaacccaagttcatgaagatttatttccttgttttcttttaagagttttatagttttagctcttacgtgtaaaaatgtctgtgatctattttgagttaattttctggtacagtttgaggtatggttccaaattattttttttgcatatgggtatctagttgtcccagcatcatttgttgaaaagactatttctttgccactgaatttgcttggcatctttgtcaaaaatcagttgactgtgaatgtacaggtgcctttgatgttaaaatgtactgtttatgtactactaaaaatactaaaagtgtcaccattataaatatatcactgttgactattgtacacattcagattttaggcatactaatatctgaatatttgcagctctgagtcaatgatataccttatttttttttttttttttttttttgagacggagtctcgctctgtcgcccaggctggagtgcagtggcacgatctcggctcactgcaagctccgcctcccgggttcacgccattctcctgcctcagcctcccaagcagctgggactacaggcgcccgccagcacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggccgatataccttatttcaaaatagcattgggttacaaataaatgcatgataacagtagttgtctgacctccaaatcattttctctcaaatttcccttatagtatttattgctctctgaaaatattttatataattatatattacttttctccttgaaaagcaaggacttatctgtctcgtttaatgctatattactagcatatagacataggaggtacccatgatttatgatttatttaaataaattaatggataatctaagatatttcttccactaacctgtccatttttacctaataaataagcatactttattggatattttttttcaagcaaatttgttataggaagtacaactaaacaagtgatgtttgaagtaaaaagctgcttaagaaagtctgtgaattgtctatgaatgcagggtggtattgttttgatagacattttttctttctttttttgttttttttttagcaaaaagtaagttaaggacctgaattatttcattattcataaaagtcatagtgataagtaggaaccaagtgactaaaaccacatttagcttcaaaatggaagtttactctcttgcttttctaatgatttagcattcttgttcactttggccatttcacaaaaaggtgacataatcttgttccaagggatattcttttggcatgaaaagaagaaacaaaacattttgcttagggtaagaaggtaattgtatcttaaaaataagcactgcccataattgtccagcaagttgagtgccaaatgtgttgacaatgcctttggaaacaccggggaaaagagttggctgctaataaggagtagagtcgaaagctacgacaatccggttttctcatttgcttctgtcctcaagcatgcagtcatgggagtttgataaaatgcaaatgacaagtttccaaacctggcaaaataaacatgaaattttcaagtctctagtgatttacttgcttattaacttcaagtttctctagcaaagttttcctctgtatttttgaaagtggtagcatagagccttatgttaatttatataatacagagcaatttcttctcaactttattagagaaagagatttaaagattatgaaataaaataatatttaagatttaagttatttaaatactttatttcgataattaaataaaattattttattgtgtgagatactctttttttcttttttatttatctgggtgaacagagctaatcttccaatggggtttgtgactatggacagaaatctttctattcttggctgttgccggagaaagcatttcttccagcccttgagtttctgcagttgtctgtgtcctgtttccttttcaagtgtgtcagcatagtccaggctatctgaggaggtccaacatcatcctaaatgctgacttcagggctgtgattcaaaatatttacttcactcatgtgcctcaggatagctgccagtttcacccaggtcatgaatgaacttcttgtcagtttgtctggagagcaggctttcttttgcattctcttcacccagtctatttacacttcctctgggtgaaacttctatgtaatgttgaatcaaagattttaagacttggtctccaaaaaaacaattttgattagtaaagacaaacttcctaatgagcaaacttcttaaaaagatggtaacatgaggttgtaactctgttgcaggtgaaggcattgaaagcactggatgatgttattctttttgaagaccattgactaagttttgggtgccaatatacgccaatgcattatatccagttatactggactactttggtttccaaaaagatatgtcaaatttgtactgattttgcatgaattttctagcttaagctaaccctgatgtccacaaagacagatatccataactgttaaggcaagggatgtttttgatacttttttaaagaaataggaaacagaacatggtagctttgcaagcctatgctgcttgacagtgcccagcagcatgttgtgccaccgtatacaaatttaaagaaaagtaacgtttgttaagaaaaacattcatggaggtaaattttcaaagtggtacggagagattggataacctttcacaaagaagaaatttcacttttcaggaatataataattgagaaaaaatgcttagcatagaaggaactcaaaaatcccatcaagcccagtcttagcatggcataaaagctcttgacaaaagtgggaatgtaaattaatacagctactatggagtacagtacggaggttcctccaaaactacaaatggaactaccatatgatctggcaatcccactactaggcatttatccaaaggaaaggaaatcagtatatcaaagagacatctgtgtccccatatttattggaacactattcacaatcaccaagatatggaatcagttcaggtgtctaacaacagatgaatggataaagaaaacatggtgtgtgtatatgtatgtatgtgtatatatatatatgtacatgcattatatacattatatatagtatattttatatatatatatatttagtgtgtacatatattcctgtctcctgtctgtgttcaggaatatgtatacacactggaaaaatgtggtgtgtgtacgtgtctgtgttcagccataaaaagaatgaagtcctgtcatttatggcaacacggatggaactggaggatattatgttaagtgaaataagccaggaacagaaaattaaacactgcatgttttcagtcataggtggaagctaagaaaaagttgatgtcatagaagtaaaatgtagaagatactagaggctgggaaaggtagggagaatgggaaaatagagatttgtttaaagacacaaaattacagctagacaggaggagtaagttctagtgttttctaccactgtagggttattatagttaaaaataatgtattgtctaatttcaaataggtagaaggaaggaatcgaatgttcccaacacaaaaaaacgtgctaaatgttcaaggtgatgaacgtgcttattaccctgacctgataagtatacattatatgtattgaaacatccctatgtaccccatgaatatgtaaaattattatatttcaattaagaaaaaagggctcttggccaggcagggtggcccacacctgtaatcccagcactttgggaggctgaggtgggcagatcacctgaggtcacgagttcaagaccagcctggccaacatggtgaaaccctgtctctactgaaagtacaaaaaattagctgggcgtggtggcgtgtgcctgtaatcccagctacttgggaggctgaggcaggagaatcgcttgaactcgggaggtggaggttgcagtgagctgagatcgcgccactgtactccagcctgggcgacagagcaagactccatctcaaaaaaaaaagaaaaagaaaagaaaaggctcttgataaccactcccttcctgaccattctctctagttatagtgaacaactcacaattctcttaaaaaattcaagattacccactcttctgcctctttgcacaaggttttcttttggcccagaaaacatttcctcacttgtactgtacccttactttcctataactctttacgggtgcctatactattttccaccataattgcttgttcctatgattatctcttgtgttagagaaatgttcccataagaggcagactaccatttcatcatgggttagcatcatgaacagacaaacacacctgaattttcagttaggatttgaatccagagtggagggaataaagtttccgggcaagaggaccttggacacaaatgcctgcaggtggaaataagcatgacttgtttcagagactagggacgaaggataagagaactcttccgcataaaaataagtatatcagccaggcatggtggcttacacctgtaatctcagcactttgggaagctgaggcaggttgatcccttgagctcaggaggtcaagactagcctggacaacatgatgaaaccctgtttctacagaaaatacaaaaattagccaggcatggtggcatgcatctgtagacccagctactgtggcggctgaagtgggaggatcgcttcagtataggaggttgaggccacagtgagctgtgatcacactactgccctccaaaaatagaaatattcctaaatttgaaattgagggagatgtaggggattgattaaataaagtattctatggctgtataatgggatactacacaacaatgaaaatgatactataggtctgcctttataagtgccatattaagggagaaaaacgtacatatatttataaaatgataattttaatgttatcttaaatattgacttaatatcaattttacatataaaaaacatgcatgtattcatgaaacaagtctttaggatagatactaatgtgttaacagaggtcatttctttatggtggggttgtggtatttagatctgtctttatggctttgttttatgttttggtttgttttgtaatgaataagacatctataattagagtaaatacaataaagtgttaaaagggtaagaaggtaccattggtcttgtacatatattttgtacttattgattgctgtgtcttaaaaattattgtgaaaattttcaaacttatagaaaatttcaatttcagtaatacaatgaacaacgaacaacacacttgttcacctagcttcacccattgttgcagacattgttacacttatccctaaatacttgagcatgtatctcctaaaaactaggacattttcttatgtaagtacaatatagtcatcacatgttagaaatgaatcattattatgaagaatattaacagtaacaatgtaattattgctgaattaaacattattactgttacctactctagttcacaattcaaatttccacatttatcccaataaagtcctttgtaactttgaaaaaaaattgtctggacataaaattcaatcaaagatcacatcttgcattcggtcgacatgtcttagtggtctcttttaatctagaagtgtttcctactctttttgtctttcatgatattgacaattttgaggactctatcccaggtgtcctgtaggcaagtaaacttatattggtaagaatatagtgatgttcgatctatcccaatgcatcattttgtttttgacactggaattttagtgtacagaaataattttctcaatagtgagggctgaagtaataaaaataaatgtttgattgtagtgtgccgtattgaattcttttttctaccaaccaaatcaagtttcctggattctaattcttgcattgttatgtcttaggcacacgtctcagtcttgtcttttatagcattttacacaaaggtgtttcatagcatttaattttcataattatctttatgccccaccgaaagatcttctgggaataggcgatcatacgtatttgtttaatagttaattatctaacagttgagcaactggaaaactttatttacaattgctttttcaatcatgtgtattatgataatggggctaataataacactgagacacttctgggtcatcatgtatcctatgtttctgattacttgaaagtctctaatgtatataaactgtatatgagaaaaataaccagtggaatatttgattaatcaaaggtgtactatttctcaacctagctggggataaaaataaactgttatattaagaatagtatattttgtgtcttaccactcacaatattcttttttaggcaatagagattatgccaaggatgatccattggaatttaagtcccatcagtggtttggagcatctgtgaggtcgaaacaggataaaattttggtgagtcttctggatatttacttacaggtgattttagtcagtttatgtggagacacagaaggttttatattttcaggctgatagtaaaattcagtatgctcaagggcacagggtataacaacataagatagctctgatcaaaggccactctgtccaaggaggccatctctcttgcccttcttgaacaggctttcacattttttcacccttattcctactttgttttacctgccccacttgacagttcctatcagtttatttccacctagccaagtataggaatagtgtggctttggctaacaagtgctttaatacttcctctctctctctctctttttttttctttccctgagacggagtcttgctctgtcacccaggctggagtgcagtggtgcgatctcggctgactgcaacctccgcctcccagggtcaagcaattctcctgctgcagcctcccgagtagctgggattacaggcacctgccaccaggcctggctaatttttgtagtttttagtagagacagggtttcgccatgttggccaggctggtctctaactcctgacctcaggtgagccaccgagcctggccacttcctctctttgaaaatacgacacgatgttgaagtggaatacagaacaaagaaaaaaaaataacaaccttccttcacctcatctccccctatgccactgtccattcctctgctcctcttctcagtttctgaaatgttttctatggtaaccatcgtagttctttacttcacattccctttcctatgtcatcattgactttcaggtcactgaaatccactagcatttatacatatgtgcatacatacacaccattatgttttgttttctctgctggtatttatttttatctttcttgcactgtcagcattattcagaatggtcaacatcccttttttttttagaactaaatttttcttctcttggtttctgtgaactgtattttcctggtttttctcctatcttactggctgctcttttgtagtctcctttaatggctgctcttaacgttcagtttccaaatattggggtatccttgatctctatttagcttcctttgcttcctctaactacaacttttacctagaggttcctagcctaacccatggctgtaagtataatccccaaatctatacctctagcttttaattctccctggatccttaaaggcatatttccaggctacctatttggcttccaaatgaacatggccaaaataggactcttgtttccttccatcaaagaagaaaaacaaataaaaaactattattatatatatttcccaattttttaggaggcctgggtttccaccctattcactagtgagcactcacaatctgcctcaaaaatatatctcaacatttatcagtagatctacatgtccgctatttctaccctgcaacaagccaccatcattacccccttggaccactgcaacggctcttctcatcctgctgctgcttctcttaccctaactgcaagaaggaccagagtgaaccagagcattttaccttcttgattaaaacagtcaagtggctttctgtcactctctgcataagtatgacaagctcatactgccttaaaaacatctccaaaaacaagtcactggctatgtctttggcctcctctcactccatctcacatactaaagccaggcttatctttatttcttatacattccaaattatttcagttagtaccttagtgtttgtgtttcctctgcttgtataagttgtctttatgatttctacttggctagccctttgtcattcagatttcagctgtcactcagatttcagagactgctccgcctattttaattatttacgtagtatttattgttgcctttattttttcatctaattatgctgcatagggaaggatttgcttaggaggtgaagttttagcagactttaaaggatgtgccacatttcagcaattggaggtgaaggatggggttaagagtggggatgttctaggcagaaggaggtgcaaagaagcaggagtaaggaaaaggagcaagccacccactctggagcgtcaagtacgtgtagagaagtagctgctatgacctactttcactgttttcagggtatatatacaataagtcagtattgatgttctgcagtgcttatgttagcactttgcttcaaaaagtattatagaaaatcaattaaacctttttcactaaatgaattgttacacatttggtagattactatgttgttaaagcattcattactctactgctctatgtggtattacagtctagaatgctgaaaacaaaaaggtcatggtttatttggaaagtaaataaaataagtactgcgcattattttactctcttaataaactatttgctgtataatttagggggtatattccatatgcatgagtgttacttagttcaaaagctagtttggtctctacctttagcatagcatattacatcaagaaatatactacctgaaataacaattttgctaactattttgaaaaaaaaaaattggactacaaatatggccttcagaataatgtgagaaaaagacttcacttaatatctttatttaccactatgataagaaatttaaggtataggataggtttgattaatttctatgaatgctttgaaagttggccaggtgtggtaggtatggtggctcacaattagcgctttgggaggctgaggcaggaggattgcttgagttcagttagagaccagcctgggaaacatagtgagaccccgtttctataaaaaaatttttaaaaattagccaggcatggtggcatgcgcatgtggtgccagctactcaagagggtaaggccaattatttgagctcaggagttcaaggctgcagtgagccatgatcacgtcactgcactccagcctgggcaacagactgagaccccatctcaaaaaagagaaagtggtattatattctgaagtagtatagagcatctgaaacactaaatttttagaaaatcttcgtgtcgtggactaaacctttgattttaggcctgtgccccattgtaccattggagaactgagatgaaacaggagcgagagcctgttggaacatgctttcttcaagatggaacaaagactgttgagtatgctccatgtagatcacgtatgtataggatattgtaccagcttttaagaagaggggtgggaagcctagtttgtgaaaaatatgtgtgtgtgggtgtgtgtgtgtgtgtggagagagagagatattaaaagatatagacatattatgatgataacaaaatgaaaacaatcctactaatgtaaagatattacaaatgtgaagtaaacaggtttactttttctaagaactcattttcatcttccttcgttagtataataatagttactacctgattttaagaatctgtatttttgatgactaacagtcaaaagatgcttagttgaacttctcttaacagagaagatgtagaccccacaactaaagattctgattcagtaggtctaggtcaggcctgggtacctgcacttttaacagactctacaaggcaattctgatagataccaaagtttgagaactcctgctttatattaataatgatgttgaaaataaagaatattatgtcttaaagagccaaagtttatataggaagatgaacattgaactcaggagtcttgactctgaattttcctgctcttaatcagaatttctttgttaacctgctaccaagcccacccctttttggtgatccagaggattttatgctctttgctaatattacttgaaatttcaaaaggaattaatatcatggctaaagatgacttcaagcaattataattttgattatgcttttccaaaatctctacatcctcttctctttggagattccagtccttttgtgccccgctaccctttgttgaattggctactgctttagatcttccttgtaccagaagcataaaaataggttactgaaatgcagtatagtgtttatgcctagagcccttaggccattattttttgtgttccactggtcaccacatagtttattagagaaaattagtaacaaaagcacaacatgtaagactcttactcctacatttgttttgtccatgttaggtgacctgtgacaccaggtcaaaggaactattctgtcctccagattctaagtagttgaacctacaggaaactgcagattatttcaataaacacttattttcttagcccaacactttgatcctacctgttataagtgggaagtgaacattaaaagagtgatacctactcagatctgtattgtgtgttaggaaagagaaaaaatcaggttagaaagcatacactgcacaggatgagggaaattgaggctttatcctcagtgcttggatgccatctgtactgccatctttatgttggtattttggttatggtactgtcatcttcggtggtatgtagagaatctgaagattaaatttgtatttttaatttctatattgcaaaaatgttcctatttgaaaagataattttatagctacgaagaatgagttaacccttgtttgccaagtttgttacttattaattatatgatgtacacacacacgcagtacactcttattttcatttgatgcatgtgggaactgaggttcacatagttgaagcaatcttatttccacatctcatggggttgagagtggggatattctaggcagaaagaggtgcaagaaagcaggagtaagcaaaaggagcaagccacccactctggagcatcaagtacgtgtagagaagtagctgctatgacctactttcactgttttcaggatacatatagagtaagtcagtgttgatgttctgaatggtcaaatgaggatttaaacccaagttgttctattccaaaagaacctttcctctacattattcacaatagaaaatgttttccatttcagttgcttctgtattaagcacagcttttctacaaagaatacctcctgctttcatgacctaggtttggataattcctgatatgtaagaatacatggaactctcctgaaaacatgcgttctaacaatgattcccttgttcacagaatgcttttatttggtttaggcacagaaattataaagtcatttaaagccatattttctaaggtatttaacatccaaatcaggtcaatgaactgtggcttgtgggcctctttttgtgaataaagttttattggaatacagccacacccatttgttgatgtgttatctataatcatctagtacagttgtgagagttgagttgccacactatgtggctcctgagcctaaaatatttactgttcggctttttacagaaaaagtttgctgaaccctaatctaaataataaaacctcaaatcttaggaaaagcttaaagaacagtctcaaaaaacagaaaagcaaagtgcatgcctttgtttctaataggcctgacactttcagtaacccttgattattgtacatgctttttgattcaacctttgaaatgttaagccacctataataggcctaaattgtgaggggcatcttgttcagagaagaagactcaggagcagaagtctgagaacctgggttatattctgactttgtgctgacaatccacctatagctatgggtaattcacctaaccactctgggcctttgtttcatcattggtaaaacaccaattcacacaaaaaacttctgaggtataaattcagtgttttttatctgtttcatacttcaataaattatgcaaacgaataattggttttatgagatgatgtctgttttgtaggactacactgctaactttttaataactttgcttgtcttgtgggttattttatttatttgtttgcttttgagtttttgttgttgttgttgttggttagttagtttggttaattggtttgttctgtttttaacctgacttatatggacaccgtggacaaggaacttcactgtctgtcactaacttaccttattactgattacatttgctttcagcttttcataactgcatgataaaacctcagaccttaggagaagagcataaaaaacaacctcaaacaacaaaaaagcaaaattacttggggaaattaagtaacttgaccgtggctaaccagctagtaaataagagagtatagacctgacaccacatgtgtctacaccactacactgcactatgtcaaatcaacaatatacttatcatttcctgagtaatgacaaaggacattatgcagtagaccagatgttcttctgttctaaattgcctagccacttttgttccttctgtctgctttctgatgctaatattatttgaacatagatttttctcagtaatgatttctagttggcttttcctttccttttgtcattactcagggaatgataaagatattattgatttgaaacagtacagtgtagtgttatagacacacctgggttcaggtcctactctcttatttactagctggttggccatggtcaagttacctaatttccctaagcatcagtttccctatctgtacaaattattgagtaataatagtatctcttataggattggtataaagacttaaaaagttaatgtcatgtaaaatgctttagcataatacctgactcagagtaaaggcttaataaaccctagctgatcttactgtcagaatcaataatattactatttgtaatataattaccagacttaacaaatgggagaagtattaaccatctgcaggaataagtaccagagcctgcatcaaaatagtttatattcaacatgaagtctttaaattggcaaaagcactcagtttaatatatacctgttaagaaaattttaagagacagtcatggtttttagctggatactctgggaaaccaaataaagcagataattgtacagtatgataatcaaaaaaaggatgtctttataaatagcttgaaatagttccccagatgcaacttgaataaaggaaataaatagccgacttgctctaacttgaggttagagcagaattccttagtctgattcactggatgctggaaacccctgccccacattttcccactccctcttggttagaaaaatttacattggtttagcattatactcttgaggctattttctttcaaaaaaaaaaaactttaaaaaaatttagatattaagtgtgtaatctttgggcagtttccaggctttaaaaatgggttcaaaatttctgatgggattatttagcagaagttcttagaagtttgtccttgtgactgaaaacagatatttttggttcctgtatttgggtggcaaacaaagtaacagtacagctttaatgtatttgtaacattggccacagtgagtctttgataactgaaggatagtgttttccattgttctctgttatcctcaaagtaaaataaggggaaagtgttcagattcatccttacatgtgttctaggtactgtattgctcatgattaaaattaatttaaattaattggctaattgttcagaattaatccctttctatgagaacaactaaaaagggaacaactacaaaagagtacaactattgagcctactatggttggaaaatacttgaaagtatcatttaaagatggttactttaattagatctccgtactaaacgtgggaggatagctttatattttactttttgaagagcattaagttctggtctgtccatttcctgaaattctgagctatgttattcatctctgttgttggctctataatgtatgtatctgtttgctgctattcataataacaaaggtcttagcgaagacctagcaatcttagggtaataggaagacagaggaatttcatattggaatttttaacttgcagatcacaacttgttagtgttttatgaaatcagtgtagtgggtcaaaaccactatagtttttctaaaaaaaaaaaagaatgaaataaaatagaaaatgtcagagagtattctatataataatacaaatattgtttggtaagattttaagttgtatctatatattttatacacacaatgggtgttgggttgtgatataaattataatctttttgtggattgtggttaactaaagggtttaaaatttatcattttagttggtttctttgttctctggtgactggttcaggtatttaatcttcgtttccgtatctgagtaaatggtgctgataaacatgcatactctcttggaatgtggtaataactaagtgcccgagtgaatgaccactctcaaaaattggtacattatcttatgattctagtgatatcagattttctcatgttttgttttgtgttgtttgtttttgggtttgtgtatatttccaatctttttattttagaagatattgatgctgatggacagggattttgtcaaggaggattcagcattgattttactaaagtaagttcttatttaagactgaatgagattcacatctaccttattgactagactgtggttaaaaataaactggtcaatacctcaactcctttacagctgttagctctttaatgaaaacagttaataaaacgatccattcattttgacattctttgtcttatattattccctccctagtaaacattgcttatttgaaatagggagacatcccccatcactctgggaatggaggaaagtagacactctcctcagtaaatgataggtaactattatgacttaatattaaaatttccagttatatgaatttatagcatattaaagttttctatttttaattaaagttgtttttcttacaaaagctatcaatgagagctttattacaaaattagagttacataaaagctgggaaacatgtatgtttgccatctattatgtgcctataggcactaagtgaagctgacttcacttatgtaatgtgtaataattgtaagaaatctcataggcagggctctatgtatttttaactaaattaatattctcttcagaattgatatttttaatctattttttgaaaataagacttccatttaaatgttcaaaggtaaattttctgaagtacttttctttatttacttttcttttgtgtgtttatttattttggtggtgggggagtatgcacattttgaatatcaaattgagaatattctttctagagaagtctaaaaactatgttgatggattatatgtagaccttccttagaaagcttatatgtacgctttcttagaaatgtgagcaaagaggagtgccttaaatgtatgaaaacaactgaaattgaaataatatgatgcataagaactaataaagcattttcttattttttaaaaatttgtaggctgggtgcagtggctcatgcctgtagtcccagcactttgggaggctgaggtaggaggatcactgtagcccaggagaccagcctgagcaacatagtgggacaccatctctacaaagaattaaaaattagccaggcatgggtgacatgtgcttgtggtcctagctattcgggaggctaaggcatgaggattgcttgaactgcagtgagtgaggctgcattgagccatgttcatgccactgcattccagcctgggcaacagagcaagacccagtctcaatgtttttttaaaaattttattttatctgtatttgtattttattaattttttttctagactaggtactgataattatagttaactcttcttactaggtaacttgtttttaatactctaaatttcatactatattactcaaaattcagaatgtaagccaaagagagataaagtatattaataaatgttaggtttaaacttgtatgatacatttccaaataggtattatatatttttaaaatatataatgtccatcttttctgtattgatgcctatacaaccataaccccagaagtactctcatactgtgaaagtcattgctaaattaggtattcactttcttaaacacatttctgagaaaagggtgtctttttagggcagatgacttagaagttcttttacgtagccaaggcaaaagattgtctattgaaagcttggaagggctatatgtacatttggaggggaaaaaaaatttatcttacctccagcaagaagagatttctaaaatattgtgctgaaacacaatatacctaggattagacacttttagatagttaaatataagaaatgctaggcaagcataatttgtatatgtataatacaccctgaaaattttattctcaacttcacttctgtttagatctgagacactaaaaatatttcctttagcagaaaattcttcaatgattatagaaagaaaatttgctgtatagtcacaaatttaatatacaaaattaagaagtgccttaaaaaaattgtaacctgataatacttcgcattagtcctcatttcaaatatgtgaagcagccaagatccacaaaagtgtgtattttcatgtattgaatgaatatattaaaatgtttcttttaaattttattttagaaaagatacagtgaaaaccactgaaactgagttagatgaatttgagatttgactttgtttgctttaatatatactagatagatagatagatagatacatagacagatagatacatagacagacagacagatagatataaatctcagcactttaagaggctgagctgggaagatagcttaaagccaggagtttgaccagcttaccagcctggataagggaagactttgtctctacaaaaaaaaaaaaaagtcttattaaattttaaaaaatataattaacctggtaatgatataaagatacaatactgtattgttcagtcatgtatacatatacatatatatcttatgtttttcattgatttctattttgagagatatttgttctttaaatatatatctttttgttgtgtgatttcatctaggctgacagagtacttcttggtggtcctggtagcttttattggcaaggtaggttaatattttttaaattacaattggtgactatgtgtcgctgattcacctggctaattgtatgcctatgacattttacaaattattttaaagaaagaaatggaaatacaattaaagtatataaacactccattttacacagtgttttttaaaagaatatatataatatatattaaatatgtgtatattcctagaagaaaataaactgaatatttaaaaagtaaatacatacttttatgttaaatatattttaaaagtaattatataaagtaatttatttttattgtgtgtgatatatacttctccatgtctgtactctaggggccatgacatagtcattaggcagtgtgcgaaaccaatctgtataggccaactgtggcattctaaaagttgaaggttttgaaagtattttgaagttgctcattaggatatttaagtcattattttattattactgatattgagaatgatctctaagtgtttggggacttcttaaaaattgaagctgggcatggtggcgtgggcctgtaatcccagctactcgggaggttgaggcaggagaatcacttgaacccaggaggaggaagttgtagtgagccaagatcatacgactgtactccagtctgggtagcagagtgacactctctctcaaaaaatatatataaaataaaataaaattggaggatcttaataggtttttaaaaaatattaaactggcattgatataaagatgcattattatattattcagtcattctgggaggcctaattaaattaccatttgaacatatgtacaatagattattgttgacagtgtgaatatagataactaaaactttatttgctttatgtttctttatgtatcattagagatacacaattatttatctcatcaatatattgacatgtttagtttctgctaaaaagtgccatttatgaggtgaactattttgtattagcattctgatattcaagcattgtcagtgtttggaagaattagaaaacctttgactggattgatttgaaagtttcaaattttactctattttctacactatgctttcctgacttgcttctttgtagaaaacatgcttgcttttgccttgtggagagggaagctaaagaaagagatttgctggaggatgacaggatggaaggagaataagaagaaaagaaaactaggaataagtgaaatattgaaagggaaggcaaaggagggaataaaaaaatagaaaattcaggcatcacagacagggatcagaatgtgagacatagcaaagctgaaaaattggaatttctatgcattatacatctattgggaaataaaatgatttagaaaaattataattgagttttactgttttaaaacaaaaatagcagttctaaagtacatatgagaaaataggggatattaacactttatagttagatatagaaatatggatttatttttcttctttattgctgattatgtcattcagtggaggggaaggaagtatctgatgagcatgcctgggaaccaaaactgtcaaggaagctaaattttgtgattctcagttaggactacttgttaactctgtctttttaagagatacagctgtgaaaatgtatgacctttttttttaatgccatgggtattgcataaataggaataataataaataggaatgtgtaataattaggacacagtaataaattaggacagagaggtactattaatattatatttattagaattttattacaagttgtctgtaatatatagctagcagactcagtgaattggcaaatagtattttgttttaataagattaaaatcagcagatgtcaccctggataagtacgttagaatgaattttttcacagatctcagaattgtcgttgttagaatggagaaaagaataatgttttattcagaagaaataatgaattttcctctgttcttcaattcaggaaatgtttattgaatttcatatgttcttggtaccgctgaagcccagatgataaagtagtgacctggacagagaaagtgcttctgtgctgtagatccagtctctgtgactgaacagatgggaacaggactgaaaatgttagctgttacacatttctttctaaaacagcagaaatgataagagattactgtgtccatattgtggagacaacacttgataaaccagctatcctttcttggcatggagggcaggctgatttttgtgtagtcatctagatttcttgtctgcttaataacaaggttgtgaacaaaggtgaactcatccattcaggttgtttcctaaagatgtttaaattactagttaaaaaatatcaattgaaccaattattctgattataaaagtaacagtattgtttcagtaaatttttcatgttttaatggattagttgggtgatagcctttgattttattattccgtgtatttaacattgctttctagtgatttaagacaagtcctgttttcttaaatttttattagcagagactacttttaagtactggcttaaacagaaataattttaagttaagaatatccattttcaaattgagtatgatcaaggagagttatgtacggctaataattagaagtactaatatctaatattgttttccttcatgcaggtaccatacattatctgtatcataaagtttccatttgaaggttatttattttatatatacacccttttttaggtcagcttatttcggatcaagtggcagaaatcgtatctaaatacgaccccaatgtttacagcatcaagtataataaccaattagcaactcggactgcacaagctatttttgatgacagctatttgggtaggtaaaaccaaaatttactcatttttggaactgtggtacatatatcttatatctgagtatggtcttttaagtagaaaaatattttatgtgaaatagattaggattttttgaaacatacagaatatacaatttcaaattgttaatgagtactttggttatgttacgtttcagtaattgaaattgaagacagtgattatttgtgcagtgataataataatagctagcctttaagatatgcttactgtgttctgggcattgttcaaggtgacttggtttgtattcactcatttaatcctcacaagtcaagcatactgtattattctcattttgtaggtgaaaacactgaggcactgagacgcaaaataacttgcccaaagtcactcgcttgtaacttgctgttcagagattcaaatggagacagtctaactcctgaagttttcttcatgatgttaaataaaagttttggtctttaggacttattaacatgtgttctctctttcaatttctttatgatatattaaaacaagtcatatatgacagaaatagtacttgctgattgagagaatttatttgttctttatgatgagttgtaaatttggtgtttttaacagactcctttgtaaagttaataagacaattgtagttttgtaataaaaatagactatttgagtatttaactcagtttcatttaaaattcatatgtcatatatatatgaatctgttatgactaggggacaaaatattgcataagtaaaggagtttcttgaaaatattttcaaggaatgcttactcagcaagcctgctgaagataacgtccttgtcctgatggttctcccctttggtttcctgtttaggttattctgtggctgtcggagatttcaatggtgatggcatagatggtatgaagtacttgaactatatctaatctttaaaaaaattagattaagtatttgaaacatgtggcattgaaaattttaagcagtttgagtggctgggtgctgtggctgcagcctgtaatctcagcactttgggaggctgaggcgggtggatcccttgagccctggagttcaagaacagtctggacaacatggcaaaaccctgcctctagaaaaaacacaaaaattagccgggcgcggtgatgcacaccagtgtctagcttctcaggaggctgaggtgggaggatctccagagcccagggaggttgaggctgctgtgagttgtgattgcgccactgcactcccgcccgggcgacagagccgagaccctgtctcaaaaaaaaaaaaaaaaaaggaaaagaaaataaaattttaagcaattttaaaccattgttatggaatataacagaagaaatgaggaagatgttagcacactggtgagagtccaggctaggtctgtgctgaacttcctctagtggctgctgaaattgagacagctacacttggcttcagtgcctttcctttctgcttctttttagcccccaacactgttagtgatttccttagcattttcctccttgtcttcagcaaattcattcctctgggaggaagaattagtgtcttctttctttaggcatcctttgttaccttctgggccatctctgtacggttattaccccatcctctcattgtccatccatcttccttcagagctccgtttaggaatcacagtctttacctgattttgatcacatttttgtgccacagccacttctaccccacttcagtttgctctgtattatttttcattactgtactactaaactaaatgtagtttttcttcattcttaggttactttatcttgtctattcttgtttaacaatattacaaatgacttgagggcttatttgcatatgtttgagagccctccagaatttgtattttgtaaattttgattttatagtttaaaaatgctgggctatttattacggagtaccaatttttctaaattgattgtttgttttgaactgaagtagtaaaacttaaagcttgctgacatagtcacttctggtctgcaacttccagtgttgtcctaaaaaatgaataatttgtttgtttgtttgtttcagactttgtttcaggagttccaagagcagcaaggactttgggaatggtaggacagttaaaaggtattttttaaaaaatctctaagttatcttctattttaccagatttcacatacttctatttttccttcacaggtttatatttatgatgggaagaacatgtcctccttatacaattttactggcgagcaggtatgcttccaaaatatgatcgtcctctcccactataaaagcagtatgtactcattggagaaaatttgcgaaataaaactgtaaaaatgaactataatctcatcaaatagataattcttccaactcttaccattttggtcaaactattatcatttctcttttgagcgtgtgtgtgtgtgtgtgtgtgtgtgtgtgtgtgtgtgtgtagtatataaacaaaaattggtttactctgtatttttcattttgtcttgcctttttcactcaatattttatcatcagagtttctaatttcttaaaactttccttggcagtatcagaatggtttaatgattccataatattcaatattctagatataagatgggctttaaatatttcatctttgttttaaccaaagtaatttggatattttggcttgtttttgtttccttttttttttttttttaggaaatgcaaaatcacatgcatacaaaaccacaaagacttcctttttctttactgaaaagaaaaaagagaaaagaattctttaaattcttttttaaggatgatcaatgccttataattttattagatgcaacagaaagcatggcacagatatgtgtattatagatattataagcgaacttcatttttactacatgaaataagatatttctcagctaaaaaaatgctagtactttttaagtattagacatttctctgcgagtacaggcattttataatattctctgttgtatgtctcaaagaattataccataagttggtaatgatgaataaacatttaaacagtaggtagagaaaaatctttctcaaagtttgcagatctgggattcaagcctttttgttcagttgagattgttgggctttgggataggattgacaggctgactgactagactcatggtccccagaaacctcctcccatttgtatggcagtcaagattgatgcacaacctggagggccctgcagttgacaggcagttagggttgctgcaggggtggtccctttgttccgttttgacttctccagctcaagcagcttctcctgtctggtgaccatgtatgagtctggatcctactgcatgcactcaatgatacttgctttattcctccttccactattgggaagtgggggtggctagagaggagtgggaagcgtggcttttagatgaggacaaacctgggttttccatgctcaatctgttattgcattggataaggtatttgctgctgaaaatctgtttcttatttataaaaatagggatgctgacaacttcctcatgggacagttgtgagaatcaaaagaaaacattcgaatcatagtgcccgggacaaagtgtgtctcagtaaatgccatcctttctttacacttccaagccaaacaccataggtgactaaggcccatgaatattattctgttacatagtcggcacatcaaccttgtaccccaaacacagtatattttatttcacaagctctgaacttgttatttaatacagaacacacctttcattttcccaattacactgtatcaacccaaaatagataatgcaggaatctcccttatcattctcccttgatatctgagccaatcaaatttgagaagcattgctaactttccttttttggtttgttgactcatttttcaccttactttatatttaatctgtcatctcttttagttttgttttgcactttcagctctctttagagctttcctttttcacatttatttacagctaagctgctcatcctatgcaagcctgtggtctcctgtggtagggaagaggacatttctgctccctgtgcattataagctcataataaacccaaacacatttgtactgtgtgtgattcaaaagcaaaatcatgtggcaagtaatctatagagatatgacacaaaaatgagctcctttccatatctttccaaacagtaatttttaaacagtagtagtagttacacataggggagccaattattatctgttattaataattattatctattatcctcatgacataggcatccatataaaacttgttgggttcaatcacaacatttgtctgtgactatatatctttgttagtgtgcttgtgtctggtatgttttgggaagtggagagaaagggagatagtagggtaggcctgagaaggagaattgatagtccttagacttaaatgtcatatatcaacaacactggaaggatatacatgtaatatattgtgtatatacatgtaatatattgtgtccatgatctaggaaaacaacaagcctcattacctgattgtcattgtgttggtagaataaacaaaagacaagacatttagattgaagcactatatgcagagaaaaaaaataaccctatttggtacatatattacaaatgttaattgtctaaactaattggatgaaatataaacatttcattttcatctttttatccagatggctgcatatttcggattttctgtagctgccactgacattaatggagatgagtaagtttaaaaaaaaatgtttccagaaagttatcttctcatgtttacgaatactttactcaaactaaacatttttttcttctgtttttgtattccttttctgctaatctttctgtttaaggaaacaatttgaagcaaccttaatcatgaattctagaaaacctcatatgtttgttctgttttttttcagtagcttttataacatgaacaaataaagtaattttatgaattattcatagtttcttaaaagaattaaaggaagtttcaaatttgaaatgagtgctctggtaatcattttgtgtttcactgtgggtgtgagagatgcagaaagaggaaaagtgagttgtagtaagaaagaaaatgcctactaagacatgaaatttgttcttgctttggtgagaagtttctgttcttctagttatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatggtaagatcaaagtttagcagctacaggtccctgattatctgtgtccacctggaaaagttctgtaagtccatctgtagaagtctacacgagcaaatctccttcctggaaaggtggattgtgtgtaagtgagtaacacaccaaatttaaagacagtttgctatttttctttaaaaatcagagcaaagatttcaataatggactctcatgagttattattcacttggcctcaaattagaaggtcagaatgattactttctgaaaggaaccttcattaccctggtgcctactgctagctggtatgtgtttctgcatcctgcttagcagcagtgccctcttctgttcatttggctacaagtgttaaaaaaaaatgcttccaggcacattgtcaaggcaatgctgactaatgcatacctcaaaggtatgatttgccattaatatttttaaagccataactttgttgtagctgtccaaaatgttctaagggatgttatatctccctttatggtggcatattaaaagtataagcctattcgtttataatagtaccattttaatagttgtcgatatctttaaaaagcaaagttagcttttactttagaactcttttcagaaacctgaaatataggttacaaattaccaagattttttttttaatctgttaaaaacctttctagagatcacagaatggatagttgaactagtttgtgtaatcaacagtatagtaagcctatgcccccttaaaacctaaaggaaaggtatacattaagaagaaaactttaaaaatacagatgacttgttgtatgtctcaaacagtagtggaaaggtaaatgttgtttgccctcaagatttcacacctgtcttgtgggtaggtgctgtcatttactagatgtgtcatctggaagattaaccgtagtcatttctttttctttgtttctttcttttttttctttttttttttttttttgaggcagggtctcactctgtcacccaggctagaatgcagtggtgcaatcatggctcactgcagcctcaacctcccagggtcaagagatcctcccacttcagcctcctgagtagctgggactacaggctcccaccacctagcccagcttattttttttagtagagctgaggtcttcccatgttacccaggctggtctctaactcctgagctcaagtgatcctcctgccttggctgtgcgaagtgctggaattacagatgtgagccactgtgcctggccaacaggagaagtttcagtggtagggaacatctactcagaggtacatctgctacctaaaatagaggcttaaagatttttaccacaaagagaacttagcataaatcaaatggagctatggtatgaagttcataataaaatgtgaaaagaacactatataacagaccaaatcattacttaatcataacaaaagctacataggaaatacagggctaagtttgaggttccatcatgaataaagttaatgaattctttgctatgtagctgggcctctgtctcccaggttttctgggaagcctggtcatgtgtgatcttcaccttgtcttgatgttattccagttactttaaagaaagttttctcattactgtgatctagccaacatctcttccagctttctaagtttttgttataatgtgtcgtctgtcagtagaacaaatatagacaacagctttaaaaaatgtgaagttttacaatgattttacaaagggctaaaatatagataaaatcatccatagaggatgattatggtctcccaaggtttctccttgggtcttactgtagcaaatagtagattgtgaatgataatgtctttagtgaaaaattatctgagctgtatttatgtatagtatttagtacatatgtgcaaatatagttacattatacatgtatatgttctattagttatgttagatcttttgttgttgttcatacatgaagacattaagtgtcattgttcctgtattcctatattcctctctttccacctacccccaccctaggcatcatcaagagggatattgaaaacaaaacaataaagttatgttccaaaattttatatagccccaaggtaattatgtgcagttttttatcagtacttttccagaaaaagcagaggaaaaaaaagaaaagcaggaaagagcatctaaaatgatcaaaggaagaaatcaattgcatgaatgtgtaggattttccagactcgacagatgatagcgaagagagaagatgattaacatgtataaaataatgaaacgtttaggaaagttacagataatttttattaaacagtcactcaacgttggagccatcttttgttgcaaaattatgttttaatgaatactttatttattatttgttgagacagggtattgctctgtcacccaggctggagtgcagtggtacaatcacagctcactgcagactcgacttcccaggctcaagcaattctcatacctcaccctcccaagtagctgggactaccaatgtgcacctctgtgcatggctgatttttgtattttttgtagagatggggctttgccatgttgccaaaactggtctcaaactcctgggcttaagtgatctgcctgcctcggcctccaaaggtgataggattacaagcatgagctaccgtggccagcctgttttaataactactttattaatgcatatgtcagtagagaagttatgcttatctttggtttttttgtttgtttgttttgttttgttttttgttttttttttagactgagtctcattctgtcgccaggctggagtgcagtggcacgatatcggctcactgcaacctccgcctcctgggttcaagcgattcccctgcctcagcctcctgagtagctgggactacaggcacccaccaccatgcctggctaatttttgtatttttagtagagatggagtttcaccatgttggccaggatggtctcaatctcttgacctcgtgacccacccgcctcggcctctgaaagtgctgggaatacaggcgtgagccaccgtgcccagccgatttacctttaaggcttaaaaaaggataaaaagaatacttttacataagttaggtactcatttttaaggataacaaattcttagttggtgtttactgcaggccaggcactcttctaggtggtgaaaatgagcataaatcagagtctactcatgtctttaagaaactcagcatccaatgggggcagcatatatgtttaaaaaaaaaaaagtacctcaatgtgatcatcacagtgtttgagatcccaggcttaatggtctcatataaaggatgagtgatcaaggcatcgttgatgtttcaggggagccaggagatgatgaggcatggcttattaaggagctatgagacagctcgtgtacattaaggaaattgaggcaatttgttatgactggtacgtagggtctgtgataggcaagatacgacatgtccttggtctcatgaagcttatgttctatagcttacttactttgtgtagtcatagaataagtaaacaatggggaaatccagatagtgataaagatgatggattttttagaaggcaaggtaatataatagagtttcgggatagagagggtgatagagaaagtagggggtcgagaggggtggtgcactgctgcgtagggtggctagggaatagcttgctgacagaatgacagctgatctaatgacagaacgacattgatctatcatttggacaaatagaaggaatagagttgtaaaagctctggagcaaaaggcagagagaatagcaaatacaagcccatagttggaagctagcttggtgtgtttaataaacagaaaaaaaggccaggattgctggaaagagtaaataagggtaaaaaactggatggcgtgggggtggggatggggagaggaatgagatttgcatggtaaacaatggaaataccaggtagggtttagaacttactctaaatgctttgggaactaattgaaggattttaagatggggatgggtgtgacatgatatggtgaatgtttggcccttttgaagagaaagttacaggcaagagtagaagtgggaggccacttaaaaggctgtttaaggccgggcgcgtggttcacgcctgtaatccccccactttgggaggccgaggtgtgtggatcacgaggtcaggagatcgagaccatcctggctaacaccgtgaaaccccgtctctactgaaaaaaaaacaaaaaaaattagccgggcatggtggcgggcgcctgtagtcctagctaatcgggaggctaaggcaggagaatggtgtgaacccaggaggtggagcttgcagtgagccaagattgtgccactgcactccagcctggggaaaagagcgggactctgtctcaaacaaacaaaaattaaaaagaaaagaaaaaaaggctgtttaagtgcaaaatgcggcaatgacttgtctagggtggcagcagcagagagagaagtgggcagattggtaatacattttagaggtagaaaagataatttggtgtttggggttttttaaagatttaaaatgttattcatttatcttctttcagtgtaagttgagcaagatcaagatgaagtcacaacttacgaatttctgagcagattggcttctgttcagaaaaaacaataccatccataaataaattatctagaattttgagagtgaaaataaactttagatgaatcttttgatgtgtcctcctccatcccctacccctagttttaatgaggaagcatttgtggtccagaaagtttaagtgattggtttaaggtcagagccagattatctggccctaaattaatgtcttttctgtacagttttgcttgagtttccttgaattagattattgcttatggataaagagtaccctactgaactttgaattagtatttatcatgatgaatgggttctataaatattaagatctgtacaaataattacaagtactgaaactttcttctcttcatccttgccctcttccccccttctctcgttccttcctcattcttccctttcttttcctcctccttacttctgtcattctccttccccctcctctttttttccccacagatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccaggtgctttcttatcaacacatagagcccttagatttttcagtcctaatagcaaatagtattagttactgttcttgatttatgttataaattattgcaattcagtatttcatatgttgatcaaacctctaaaatattcaaggcatcattcccgtcacctaagggtatatgaagaaaagtcagctctctttcctgggagtgtacagtgtactctgagtttctcctgtagtctttaatgaaatgagaagagtattacagaagttataaacaaaagttaaatgctcattctaagctgttttaatgttagctatcttttttatttttttaattatgtagaatatatgtacttgactaatagttgtgattttttttttttttttaagacaaggtatgtctctattgcccaggctggagtacagtggcacaatcttggctcattgcagcctccacctcctgggctcaagccatcctcccacctcagcctccttagtagctgggactacaggcaagcaccaccatgcctggctaatttttgcatggtttgtaaagagtggtttttgccatgttgcccaggctggtcttgaactcatgagctcaagcgatccaactgccgtggcctcccaaagtgttgggaatacaggcgtgagccaccgcacccggccttcattgtgatttttttttcaagtatattattttatttaattctcccattaatacatgagttaatataagctcatttttatagctcattattataccatttctgaatgtaaaaagagactgagaaaggcagtttacccaaggttgcccactgcataggtccagtagagcaagcaagacctttttctggttcttatacactttggagcattataaatggatctaggatcaaaacagatcttttctttaaatgaaatacagtgtagaaaatttagatgacctttgtgttgaaacacttaatatgagctcaatatacaagtgtgttggtctgtttccagaaataagacatgaagtggattctcataaattagtagtattttagagtttttttgttataaatgcaatatatttgttatagaacttttagaaaatacatcaaagcatatcttttcaatgtttttcctgtgcagtcacacacatttttttaaaaaggaaatcatgcttttatatgctattcatagtgttttattcaacgtttcagaaacatttctttattattcttctaaaacatgaattttctgtttccctttgtaacaaatagctgcatcatatcttatttacctttttttgtggcatttttatctttctttataattcttttgcatatctctgattatgtcattaggacaaaattcaagaatcactgtgtcaagtgtgtgcacttctttttttaaggttattaatacacatggtcaagttaccatcccactccctccacaggaaggtttttgtcaactttttaaagcactcaccagcagtaaatgagtcattgttttcccatacttgtgcttcttttaaaataatttttaactgtataacaggtggacagtgtattttaactaacagtttgtgattctagaaataaggcatgagtttgattcttttttttgagatgaagtctcgctctgttacccaggctggagtgcagtggcgtgatctcagctcactgcaaacttcaccgcccgggttcaagagagtctcctgcctcagcctcctgagtagctgggattacaggcaggcgccaccacgcacagctaatttttgtatttttagtagagatggggtttcaccatgttgatcaggctggtcttggtcaggctggtctcagtcaggctggtctcgaactcctgacttcgtgatctgcctgcctcaacctcccaaagtgctgggattacaggcatgagccaccacacccggccatcaggttgattcttaactatacataaataaaaatgattatttttactaataatctaatgtatagttatgaggttgattcttaactatagattattagtaaaaataatcattttcatttgtgtgtatatatatatacatttgtatatatatacatttgtgtgtatatatatatacatttgtatatatatacatttgtgtgtatatatatacacatttgtgtgtatatatatacacatttacttctgtgaatttcctttttgtgtctcttttttcttctttgctactgggattgtattttgcttttctttcattcattcattttttttaaactttcacagtgccttaaatgttgcaaatattaacttcttaactcttttatgtattttctagtttgtcagatttgcattttgagcataaagttttaaacttttatgttatttaatctgtttttattttttttttcatgtgattttctgtttagaaaagacttcctcaaatttagcttgggtatactgtgagatagagctctcatttgactttttctgaatcgtgaaccagttgaacctgtggcatatgaaaactaatgcatttcattcttgctgattcgagtgctatctgctatagtattttatatatatacacacacacacattatatatagaaaatagaaaggaaattttacagtaagattgtaaaatccacaggcgtctataaagctttttcctttggcagtatgtatgtttggcaggtgtatgattatcattgctactttttactaaatattcatttaaaagatttatatccacctagatgaaagtctactttatgataagcattttccactggtggtagtttgtttacagttttcatatattttagccttttatatgatgtcttacaacctcttaatagttttgagaatttgttcaaacctttttatattcattgaaaattttatagaatggtatatacattttaaaaaccattatcattattaacatgtttttccactctttcttaagacttaattgtaggagcttttggtgtagatcgagctatcttatacaggtgagcattttctgtatcctgcggtataggaatattctgaattatttgaacgttttttaattaagtgtcagtgtttgaattttagtttaattttcttgaaataatgataaaatttgctctttctattcatgatttgctatgggcaaatagtattatttttattggtacataataattgtacatatttatggggtacatgtgatattttgatatattcatacaatgtaattatcaaatcagagtaattaggatattcatcatctcaaacattgatcatttatttgtgttgggaacattcagaatcctgtcttccagcctctcttctagttattttgatcttttgttttctttggagacagagtttcagtgcagtgggaccatctcggctccctgaaacctctgccccctgggttcaaacaattctcatgcctcagcctcccaagtaggtggggttacaggcacatgctaccacaccggctaatttttgtatttttagtagagacagggttttgccatgttggccaagctggtcctgaactcctggcctgaagtgatacacccgtctcagcctcccaaaatgctgggattactgttatgagccactgtgcccagccagctattttgaaatgtacaataaattattattaactatagtcaatctacggtgttattgaacactagaacttcttttttttttttgcccaatctggagtacagtggtgcaatcttggctcattgcaacctttgcttcccaggtcctagtgattctcgtgcctcagcctcccgagtagctgggactacaggcatgtgccactaccacacctggctaattttatgtatttttggtagagacagggtcttgccatgttatctgggctggtcttgagctcctgggctcaagtgatccaccagcctcagcctcccaaagtgctgggattacaggtgtgagccactatgcccgccccttctttgtcttttaaattatgttcagaggtattctcctgtagttttaatctctctaaaaattgtctgggtttacattttcctataagaagcaggaaattaacctcatgcttatgtcttggtattctctgaccacaaggtcagtatgtaatgaaaccccaaatgaatatttttattagagcaatatgtatgaatttatatatttctatttcccaatttcttatatatccccagttattctctgtatttcatcaattcctcatgacgtagaatatcagttggcatcccaagtagttaagatgtttatatatctatgatctgagtttatacatggcaggaacactaacattagtgctatgtagcggagtttgcgatgggtcaatttaattgtagctatacaatacttaacagatttcagatctttatcattttgagacaggcacattgacttgagccagctgtatttttgtataggatttaaacctgtgtatctgaactcaggaaaactgtatttattttaatttattgtttttagtttttaaaattgctgttaattgtataatgtacgtggtaaaaatgcaaacactataagaagggtatataaaaaaaagttttccctcacaccagctaataatttatttgtttcttctattagaaatattctatgcattaaaaaatcatattatgtatgtatgtatgtatatcagtagacattctttgtactttttgggtttttttttctctcccactaaaactatatgttggttatgtcttagaggtcatcccactcattttctccacggtagtgcagcgaattcggtagatatctcacaacttatttagccattctgctttagtgactgaattcatataggccagccattgtcccactttgtctggaactgagcgatttcccaggatgcaggagtttctgtgctaaaattaggacagttctgggcaactaagacagttgatcacctacggttatgttgttcctgttccttttactattacaaacaatgcttttagtagacatggtactatatatgtagtgaatatgaaccaaaaatatttcaatcaacctaactttttaaataattttttacttcatcttcttttccctcccccgctagggccagaccagttatcactgtaaatgctggtcttgaagtgtaccctagcattttaaatcaagacaataaaacctgctcactgcctggaacagctctcaaagtttcctggtaagggtatttgtttaataatagttattattgtgattattgttcaggcattgtaagaacaattgaaaatgaaggtggtagggctgaaatattgctaaaacagtttctgtgagtatactgttttttctattctttttttatttgaagcaaggtctgcctctgttgcccaggctggtgtgcagtggcacaaccatggcttaagtgatccttccaccttggcctttatagtagctgggactacaggtgtgtggcaccatacccagctaattttttaaatttttttagagatggggtctccctatattgctcaggttggtctcgaagaccgctgtgctcaagcagtcatcctgcctcagcctcctaaagtgctaggatttacaggcatgagccattgcacctggccttatactctattttcatgttataaattggattatagaaatagtgctccaaaaaggatatctaaaggctgtaaagatactctataaattagtatgaaattaatttttaaagaattatgcgtggtcaatgaatattttcaaaaagaaagaaaagctaataagatctcagttcatttatatgtaattccaaacaggcccatgaacacttacatttttaaaagatatcttgtttttctgatttaatatctatgaacagttgtatgaaaaaaattattttgctctaatatattaattttctgcttattcctttactagtttccaaagaaaaatataataatttttcataagttaaatgtctgaattcttctctactccattctttctctcatctttgtcatttgtatgctacttcagtaatttttgctctattttcattatagatttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccaccaacacgcccggctaattttttgtatttttagtagagacggggtttcaccttgttagccaggatggtctcgatctcctgacctcatgatccacccgcctcggcctcccaaagtgctcattatagatatttttttaagttgtctcgtgctttacttcacagtatttaaaagcaaaatgtagaaaccagtatctttctcatacatatcaatataaatataaaactaatgaaaaatcttgacccatatactaccaaaatcaccatgagtagtcattcatgagttcccactttgggaaacactattcatgttccttacttacacagacgagttgcagagaacttatgatcaaggagaaaatgattggtgcctaaaaaagttttacttcaaaagagccaattaaagatattgttcctgaatttgtttttgaatatttttgaattattgttatagttattaaaattttgaaactttcatttctttaattggattacatttaaaaattcagtaatatttggtcttcatttttattgaactggcaatgaagttgttttcaagattttgctgtaagttttactgcttttctaccctgcatacctctgtgaagttgccaataatctgcttctaattatgttagtaattcaaaggcttcaaatgcactaactagagcagtaacatcatatgatttttgagtatggcacatagaaatacattttgcattataaacacataaaagtaattaaatcaagcatttcagaaaatcgtacttacctttgatacctaaatcagttttatttatttattaaaaaatttttcttaagatgctgaacacaacccattaaactggtttcacaacctgctaataaattgtgaagaacactgctgtaaaggaggttgctaattaaagaaagttttggtgggtccttttatcaatgagacagtttttaaaatctgaaccgttggctaggcacagtggctcactgtaatcccagcactttgggagaccaaggcgggcgaatcaccagaggtcaggagtttgagaccagcctggccaacgtggtgaaacactgtctctactaaaaatacaaaaattagccgggtgtggtggtgcatgcctgtaatcccagctacttgggaggctgaggcaggagaattgcttgaatccaggaggcagaggttgcagtgagccgagatcgtgccactgtactccagcctgggcaacagagtgagactctgtctcaaaaaaaaaaaaaaaaatctgaactgtcatacccctcatttagatttatcaataggttctataagcttgagagaaagttaggacattatttttctttttttcatcaaggtaccatgaaaggaaatgtgcttaaattactgaaggatgagttaggttagtgtatatagtttcatgtttttagaataatattaagacatgaagaaagatgtaaggcttcacaatacaaactatgtagtagaaagatgagatgtgggtgataataaaaatatgtctaaactgaattatagaatttatgtatgttttttatttttccacagttttaatgttaggttctgcttaaaggcagatggcaaaggagtacttcccaggaaacttagtaagtgttctatgaaaaatcatattattttaatgatactgcatacacagcacttaaaaaatattttaagatattcaaatagttacttgaattgttattataattttttatttgaatgtttatgcttaaagacatttaagatttcaacataattatattctttggtaacccttaagctaattcaaaaataatacacttatttatggacattatgagctaaatagcccacagaatggtaaatatgacctttagaagtttaagcagttacgaatgtgacataatgaactctggggaaatatgaatattatggtttataagtagatgatctgctgagaagtctgtattttatgtctttgagcagccccaagcaatctcaggagtagaggtggtttagaaatagtgagaaggaggagaaaaagttttggtcatgcaatttaattcacacagcaaactctactcttcttttcctaaaatggttgatgtggtcctgagagcaagataggcaagataggagtgttaaataattattgccagggtttgtcagtatgttaatggcaagtggtaaggaataatagtaaagcagagaagaaactgaaactgttgggtgtgtgtttgtgtgtgaaagtttacatagggcagccaagtaaggtctccctaggagaaaacttttcagtagagacctgaaggaaataagggagctatgggatgtgtggaggagtgtttgccacagaggaactggcagtttcagcaggcctgaagcggaaaatgtgctcagtggttgagaaacggcatggaggtcaatatggcctagtagaacagaacatgaagcaaaataaccccgggtattcacccaaatttgaaataaaggtcaccttttagagaaacttgcgacgcgaattctggttttaaagatttgcactctcttaaactatttaaagaactgaatcttacaaggcagtaatcctaattgctacatccttttacaatgattcttgatgcatttaactctgtttgatcacttgcttcctgaaggcatattcatctgacagtttgatatgatagcttcactggaagcaggagtttcaagtggggcaaactgttcattcatcatagtgtttaatatgatggtatgagtacatatgagcaaatacttcttaatcaaaatcagcaagactcttgctacttgaatttatgatggaagtcttaattcacatgtttcatcctctggatttcctcctctcagcttaaattaaaagatagcatttctcctgtctgataattggcttactactatcatttttttgggaattatttatgacattactttagggaaagtttgattaattatttaattattattaaatattttttcagaattaatatgttgtagtctcattacaatgtaatgacattttaaattaattagaagcaatttacttcttaaggaataaagatctctgtttacatgaaaactctagagtaggatagatagatgtccataaagaatatgttggttataaatcctttggtttacatagatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggtaagagctaacttttctgctaccttgttgttcctttttagtcattagttttttatctaaatgattttcactttctgtaaattagtgttagatcaaaaggaaaaacagaaaaatacacaaaggaaatttagctttgtaaagtgtcatacctgaatgatggacttctacttctggcagattggatattccaaatggcctttccacaacaatactactgaacaaattatgataaacatatttcttaaatgcaactgaactttcaagacagtaaaagaaatcaccagagtccaaaaaaaaaatgagcaatcaactaaaaaactccagtggcaaaaatctgaattgtgagttataagcaaatatatgagcgagagttgctggcaaaggatgaagcctaaggagagggcaggtggtaattgcagacaccagcacaggaattccgacagttgtataaggctaagtgttcttacgacagaggtgcattctgattccagcaagagccaaatgtaaaaccttgctgaaggggagcaatccagtatgggccccaggatttccataggttaagtttgatcaaatatgaattcattaaacacacacacacacacacacacacacacacacagaagccactagaagaagcatcagattttagacccacaaagaccagctacagagcacaaatttgtataaaatgtttaaagaaataaagggcctgggcacagtggctcaagcttataatcttggcactttgggaggccaaagcaggaggatcacttgaggccaagagtttgagaccagcctgggtgagactctattttatttaaaggaaaaaacaaaacaagacaaaaacatcagtaaatatttagacaacaacataattaatgaacttgatttaacagacttatatagaacctacacctaacaactaaagaatatgaaaactgaccatgcataggccataaaggaagtctaaacaaatttcaaaaagtaattttatagaatacatactatcacagtgcagttgttagaaatccataacaaaaagatcaactgggaattgggaagtgtgatttttaaataacttatgggtcaaaaacaagatcataatggaaatttacttgcaaccgtattacaatgaaaatgtgacatcaaaatgtataggctatcacaacagtagaatgtaaagataaatgtatagccttaaatgctatttaatttaaatgaaagttaagaaaaaatgaaggtaagaaagaaacaccacaaaattaagaattgagatgggacattacagataagggaggaattaacagaatattttgaataaccttgggccagtacataggaaaacttttagacaaatcatggaaattcttagaaaaacaatacaactgtcaaaagaagaaacagaaaacctgaataatcctctaaacacttaacaaatagaattggccattaatctttacaaaacgacaaagcccagatggttttataggcaatatctatcaaacattcaagaacaagacttctcaattttaaatagctctttgaaagaaaaaaaaaaccaaaatatttcaaagtcaatctgtgaaactagtgtaattggttcctggagtggtcaaggatagtaccagaagggagaatttcattctagtcttacaatagatgtaaaatgactaagccattataagcaaataagtcttagcagtttgtaaaaaaagatacataaaccaagttggatttatcctagagtgggttaatattaagtctaaaaatgtaatttaccacatgaatagattaaagaagaaatatgtgactgtcttttttaagtgcaaaaaaggttttagagtaaattttaaaaacttcaagatttaagaagcaagacaaataccccaagttatgactatgaagaaatagaatcttacatttaaacaaagtccaccaatacctattaattggtcaagatgtgaattaagaattcttatacattgcggacggcagtgtgaattgttttgaagactggaaaataatgtggtactacagaactgacaaatatacttgtcactatatataagaataatcacagcaatttctgtaatagcaaaaacaaaacccataaacaatcaaaatagcctttgacagaatggataactgaatgtatatttacatgatgaaatagtactcaacagtacaaaattaacgtaggctacatgcaatagaatggatggatcttaagagtgtaggacagaaagcaagtcacagaagactacatgtaatcctattgagaaggaatgcagagggaggaagagaaagaagtatttgggtagcttaagcagtatcaataatgttcttattatgttgggtgtgtgtgtttgagtgctcatgttgttaacatgtctcgtactttcgtgtgaatcaaatagtacattgtaaaacaaaaattgactaaaggctcttacttgataaggataatcttcttttggatattctatttctacataagtataattttccagagaatgttgttagaattgaaggctcagggatgaatacagctggctttgtaatgtgcacttatggatttctccagataatttaggttgacgttatcattaattcaaagcgtttccatttctaggatgaatctgaatttagagacaaactcactccaattactatttttatggaatatcggttggattatagaacagctgctgatacaacaggcttgcaacccattcttaaccagttcacgcctgctaacattagtcgacaggtactgtactcagtttaccactaatgtgatattttgttatttttttttacaattcatatttttaaatattagaggagatttcctttatcatattgatagatgtttagtcaaagtcagaagtttaggaatctgaattttctatttttttttctttttggtttttatttttttgggaatctgaattttcaagtcagagatatttaaagccactcaacatggagatatacagagaaagacatttcatatacatgaaataggaaaataattcaagaacagcaaagtgccagtttgtttacatagtattttagtattttgctaaatatatttgatatctgttatttttgatattttaattttaaaaagtgcatatatagtaaataaataattcttttcagaaaaccaaagaaagcaacaaaatttgataggtggtattctagttttagaaaatcttatgtgtaatgtatttaaatattgttaattctagttactatttctcctttttaaattacatgttcatgtttttacattaatatttcttccttcataactctttgccctaaatttagtttatcattttttttttgtctttctgagatcccataagctcttttttttttggtttgttttctgtatatgtgacagtagcaaaaggcaaattaaaatatttttaaaagtcttttctaatttttatattttaacaatttcatatttcatcctgtacattaataatcatagtatatgtgccattttctagtattcattaacatagaacttataaccatacttctgtgtttatattctttacattttttatttttaatgaatgcacaatattatgttgattaatagtttaataatgaccatctgagcctcttaatgtctgtcattcagtattatactttctttgaaagttaattgttacttgtcactttatattatgtgctttcatatatgggttatggttattttctgtttatagttttataattttttagaaatcttttattatcattgttatcactacttttgattaattttccaaactccccatccaatttctttaatgccaataccatgttaaaaccagctaatcaagtaggctaacttttgaaacccttggagggcaagaataactgcagtaatatttgacttcctttttttcccacctattctcattcttcattgtttgaaaaaaatttgttttggtctcctctgtgtcctacatttgttccatcagtgacattattaagttttaggtatgtttctttctgcgttcttagctttgttattcgctcttgtttttatgttaattacttaccccaccattttcatcatttccttttctctaaaatggatgcttcatttcactggttacgttacaaactcttccatgcactctctctttgctgtcaaatagaaatacaaagttttaattgtaatttttaatttgtaatttttaatttgctggttagcaacatttttttaaaaggtagaaaaggtataggtgaaatttattttaaaaatatatctatattagttttctagggctgtcataacaaagtaccacagaatgggtggcttaaacaacagaaattgattctctcctaattttggagcctagaagtctgagatccagagtcagcagggctaatttcttctgaggcctctcttcttggcttgtagacagtcaccagtcaccttcttgtgtcttcacatggtcttccttttgtgtgtgtgtctgtgtcctaatctctttttaagcatcagtcattggattagggcccaccttaaagacgttttaacttaataacttcttgaaagaccatattgccaaatacagttccattctaagatactggggattaaggcttcaacttatacattttggggggacacagttcagcccttaatgatatttaaaatattgtcatttttacatggaatcacttaaaaattatcagtggaatattttgcattctgttttttactgtcttcaaaatccagaatgtattatatacttttaacacatctaaattcaaatatttaggttttattagaaattttttttgtatttagaatccatgtaattcacagttgaaaaagtagattcaaatactcaagttgttctaaacatactaaaagttttgtagtaagagaattaagcatcagcttttaacattaaactaatttaaattaaataaaatttaaaaatcagttcctcagtgacactaagcccatttcaagtgctcagaagccacatgaggcttgcgagcggttactatattggacaatgcagttctagtgtttccctttctgctccctaatcctttggtgttagagatttagtgctttctgcagaaagagttgggtttttttctctcatttttttcattcaaatacacattaagttttttttgtttttgttttttttttttttttgagacggaatcttgctctgttgccaggctgaagtgcagtggcgcaatcttggctcactgcaacctccgcctcctgtgttcaagcgattaccctgcctcagcctcctgagtagctgggactacaggaacccaccaccacgcccggctaattttttgtatttcaggagagatgagatttcaccatgttgtccaggacagtcttgatctcctgacctcgtgatccacccaccttggcctcccaaagtgctgagattacaggcatgagccaccgtacccagcctcaaatacatactaatttcttactttgtgcaagatgtaatatatataactgtagagacttggttttctgagcatggaagacattgcttttccatttctgaaactatctttcctgacagcatattttaatactatggctgcttcaatgccagctaagtcctttttttcccctatagagtgatatcagccaaatatctctatattacagttttattaatattttatacatatgtctcattgcaaacttaagatactcatctaacattctaactgggaatgttatacataccttatcactagttaatttgttatctgtaaagtccacactttgatctaatcaagcgttgatttatatttggcatgatgtaaagaatcaccatatagttcttctaatagtccttttttaaaaaggcttatagcaactgcttatatctaggtaattgaattaattcacgtatatttttgtgtttccttcaaattaaaacgacagttacgaatctttgtccaatatatagccacttgcaagcctcatgtggcttctgagcacttgaaatgggcttagtgtcactgaggaactgatttttaaattttatttaattttaattaatttaacgttaaaagctgatgcttaattctcttactgcaaaacttttagtaagtttagaacaacttgagtatttgaatctacattttcaactgtgaattatatgaattgtaaatgcaaagaaaatttctaataaaacctaagtatttgaatttagatgtgctaaaagtatataatacattctggattttgaagacagtaagaaacagaatgcaaaatattccactgataatttttaagtgattccatgtaaaaatgacaatattttaaatattgttaagggctgaactgagttcccccaaaatgtgtatgttgaagccttaattccggacattccttgtgacttggaagtttacaatcatcatcctttttttaaaggactctatctttcttttcctttaaatccttttctctcttctttttgtctgcttctgtgcttgaagccctttggatgttaccagtaggcaaagcaaaaatggcctcatctttattttccattcttttcttaatttttatgtttcttctttcacatcctatccagctcctctgcttttttcccactgtttctctcttttgggtgtttccattttgctctagctggaacattctcctggccagatctagtggggaaaaagttcaggtctttgtttttttcacctaccctgattggttaactataatgcttcaagttccttttccttcatctttttccaaatgaccatgcaatgctggactcattttatccagtttcttttgccccttggtctctctgcctgtctgaattgctgctgaatatctacagctccttattcttttatcctctgcagccctatttcctgatattggtagaggcacagtccataatgagaaactctagaagggagtctattttgcccaacatctcacaacttaactagcagcagggtaaaaatgaagcctcatttcttggctattactttcttttctacaccagtcttcattcaaatatgataacagcttaatctgagataaaactgaaaggttccaaggaactgtatcatatcctatgaatctttttcttctttctctttcttgactggctacactgacctgcttaaaaataagtggccatggtctcttttgcattcaggtatacaacaaacaagctgatgagtatctgaaaatatatacatgtgtacatataggcttaaccacatagatattgataaacactgcttatgccacctgcattggtatttttcatgtagaaaaataaaatgtttttttctaggctcacattctacttgactgtggtgaagacaatgtctgtaaacccaagctggaagtttctgtagataggtaagttttgcttgaaataataatgtagtaagaaatttaaatggaagggcacatttttctattcaaaggactaacatattttaacgagaattagttatcctggagggtaatgcctgattttctataacactaaaactatcaatattgagcttctaaagaaaatatccactgtgttttcactagttgcctaggttgaaagagttattaccattcaactttgggtaatatcacaaaataatattgtatcattttaaagatacacttcatcataaacattctttgaactcaaggaatatccttaccattttgtaaggcatatgaattataaagaatattgtgagaattatgacacgtgattaatttagcttttagaaaaatattggggaattacaaagtacatgtaattcacttcagtaatagatatgaatgatagtgatatattagtggcatcaatgtttatttttattgagagaagcattcgatttgcacccagtgtgctattttctgttttctatcaagctgtgaagtagtcttaaaataccttgagacactgttgaacatgtcagtgctgtgtatttatctcttctttctttgaacagtcatactttccccatgtagtctttttttctcagtctggatttgtattgttaacttgtagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagtaagcaggctgcctctttaaaaattgaaatgcactcacggatcttattaacattaatgagctgttcccctatttagtgaagcacaagcttagctattctacctaaggctaaattgatagacaatggagtgcctatcttacataattccttttaagcctaatactttgcataatgcattgatatgacatttttagaattgcaagctaagtgcctggaaacaaggttagatagataaagtgtctaagcctgtccatcaaattatttgtcagaggctgtatggttatgtatggtagtcctctagggatctttcagaaacacttctgcatttccatgtggcaattgtacccaattctggctttttccttacctcctggtttgctcaactagatttatttgcttaggacaagaaactgaaatatccaactgcgtgatactttatttcctttcatatccatttttttttttttttttggtctatcaaaggccttagcaagactttcctgtgcatttaagacagaaaaccaaactcgccaggtggtatgtgaccttggaaacccaatgaaggctggaactcaagtaagacaatttaattaaacggatttttctccctggcaaatagaaaagcatattgttgtctgggctcatagtaatttttaaaaataaacacttcaaaacaatgtccttaaattggtttcgatataatagttaaatgattagcagagttttgcttagttttaactaagatacgaaaacaattggttgtgctcctacacggtttgcaatcagctgctctttatgcctccttcactttagtgaatggatgagaacgtggtttaaactaaggactgaaataataatttttgctattttacactgatgccttaatggatcctgaaaagctactctggcaactaccaagactgtcaatcctaggtgagctagattccatcacaggccccacacagaggatcaaagtgaaggtcagttaaatcaggctccccttcagatggtggagcagggtgcccaggagcttgaaaagaagcagccaatggcttgctttccgaatcctctaaaaagtaaacaaaatataccttgtagaatttctagtagcaaggacaaaatggcagcatatgctgtgtgactttttcaatagaatttatttaatgacttattgatactggtactttgaagatctgtggtaatacaggtctaaatattccatatttctttagtatgttttctattacaagtcattagtatttctagatgtatggtatcttagggatgagaacttgaacaaattaccctaagttcagtttttcacgtgtattcaatgttttattaacaatgagcatgccttttattttctcatattctcattctctctaactttctggttattatatagtttctgcttattacaagtagccagctccaggttttgtggagtgggaggcagaacccaggaagtactgtttttatatgtcatttgtgtgatccccaagaagccttcttttttgtacctggtggttcaattgttttatttaaaatctaccaattttctgcctgcaggaattaggatatttggtgttgggagtgttatgagaggtgtgtggagaaattctggttgtggccctactcatgccttctttagccatgttcccttactctagtaaaccatccatttcttctttcctggcctatgaacacagcacatactttggtggttagcttcgtgttatcaaattattgtacccagttgctagactttcactggatcaacaaacatttacttttgcactttttagaaagatggttagtattataaggaggtataattatgattaataattgttgttaaataggctctcttatggattggtccaggtatattaagtaaaataggtttgatagaaaataagatttagttatctttgttcagttttattgtaagctcagaaaaaccccattttagaacattattttttatttagacattggatttgaaattttgctaattagacattgactagcattactatcttttcctctctcctttagctcttagctggtcttcgtttcagtgtgcaccagcagtcagagatggatacttctgtgaaatttgacttacaaatccaaaggtatgaaaacaacttatattcacttataactatcaaataaatattatttgttgtaaatatactatgtaatatactttaaatataaagtagcagattaaattttattgcttgactatagcattttaaaatcaatatttacattataagaataattttattgtcagatttgagtttgtaaaacaaaatttaaaatccagaaagaaaatgttcatcttcttggaattaagtgttaatgaaaataactattttgaggtataagctttacacttgtttcgtttgttaatttttagtttcactgggtttgcctctgtatgttcttggttgttatgcataattcatttttaagtttttttttttctttttcagctcaaatctatttgacaaagtaagcccagttgtatctcacaaagttgatcttgctgttttagctgcagttgagataagagggtcagtatgaatacttagttgagtatctcattctcatgattgctttttaaaggtaactgtcaggccttagccttttctggacaatagaccctgcatgtttagtggtggttttactagggcattagcttctgtagaaataaaatcctaggtatgttccaaacccccaatactgggtgatcctcaaaaggaacaagacatggcaacaacatgcacaaaataattttgttgaacttttacacaaattgtcaattcacctgttacgtgtacatttcataagagcagtttttgtgcatgtgtgtgttcattagttttcttttaaagtattttttaaaattaaatctaattttatttatttgagtaatgaatatggggtacttttgaaaatgaactgactatatcattttgatattcatggtaggttttctttggtcattgtttagagtctcgagtcctgatcatatctttcttccgattccaaactgggagcacaaggagaaccctgagactgaagaagatgttgggccagttgttcagcacatctatgaggtttgcagttgttagattttactcaaacctcgtgagcaagccaacgaagagaggaacaactaagctactttaaaaaaaaaattctatgtaatttttatgtaaactctacattggttaagtatgtgtcagagatttctttgaatattttccctatacataaattcatttttatttgacaaatagacttgtttaaataaagcagtttatataatttgttgtttaaaataaattagttctacttgaataaagaaatgtcattggtactttctcatgggcattttgtagttctggctaaaaattgaaaatacctatggcaaataatcaaaactatttctataggaagaaattttctttgtcatccttcattaataacttttaaatattttgccttttgtttatacatacatacatatatatatatatatatatatatatatatatttttttttttttttttttttttttttgaggtgaagtcttgctctgtcgcccaggctggagtgcagtggcgcgatctcagctcactgcaaactccacctcccgggttcaagcgattctcctgcctcagcttgctgagtagctgggattacacgtgtgcaccaccatgcccggctaatttttgtatttttagtagggacagggtttcaccgacaggtttcaccacgttggccaggctggacatgaactcctgacctcaagagatccgcccgcctcggcctcccaaagtgctgggattacaggcatgagccactgtgcccaaccttgtttatatttttatcctgacacatattactctgtgttagagacaaatgttgagtttgatcatttttgcataaaaatggtcacattgtaattagaggttaactgtggaaattgctgttatttaaaacctattgctaacatgatttctaaagttgatgtaggggaaggattatggaacagatttttgcccaaggtgtagatacattttcttttttctccttagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaaggtaatatgcttaatagcagctcttcattacaatgatatttcattgccttctttctaaacctgtaaaagaaattcataaaataaaacaactattttaatataaaacccactctgcaaaaaatggtttagttcataagcagtacacttaggataagttcatttgtataatgggtaagaattgattctgtgatgtctagtgaaccacatcttcatagagtgcttactgagcctcatgagatgtgtccttcagtgactcagtttgaccttggctccatcacgttgttgtttcttcagggcataatatcacatcaagggtgttttgttgttaaaatttctacctttgggataagctataccattttactcatgattatcttgacttttggatatagtcatctccatcatagatttgcactagaaactattacacaatatgatctaaggaaaggtgaagaaacaaaataaaagatatacccatgattgacatcacaaatgtactgtggaatttcaggccatttctgtatgtttcatcagtttccactctagctaagcaagggctgaaaataatggttagggagagctaacttttttggtacatattaaagactctaatctttattttctgtccttactgctcactatatactgagtggtaaatattctgtcatactaaattttcattcactattttttaatcatatctaagagtttatatcaaaatgctgatgtaaaatgtttttcattatcatttaccaccattttattaatgtgattgcattagatctcatctttgcaaacaactgaaaagaatgacacggttgccgggcaaggtgagcgggaccatctcatcactaagcgggatcttgccctcagtgaaggagatattcacactttggtaagtgccatttcaaatatgtgcaccatagacatttaaaaatatgtgactatagaactgacgccaaagaacatttcaaaaataacaacagctgtgcttgaacaactacatttatttttataccatgcattcctctcactttcctttttcctagtcagattaatgccatattttcttcaaatgagctatttttgtagatggctaataaaactagtttatgtcccaactttgattctcctactctagttctttaactgtcctctttctgggcctcctcctaatctctgaggctttagtacgatactaaaaaatccagaaggtcccaacaaaaatacattggaataataattagcacttgattaacctttgttgagttagcctatataatggctataatgtttttaaaggcaattgtttttcttttttcttttaattaacaaatctccagatctctagtagagaacctggtatagtgttttttgtttgtttgtttgtttgttttttgacacagagcctcactttgtcacccaggctggagtgcaatgacacaaacacagctcactgaggccttgacctcccaggctcaagcaatcctcccctatcagtcccccaagtagctaggactataggcgctctcccccatgcccagctaagttttgtattttttgttgagatgaggtttcaccatgttgcccaggctggtctcaaattcctgagctcaagcgatctgcccacctcagcctcctaaagtgctgggatgacaggcatgaaccaccatgcccagcactgtttatgttcaatagtgatcactagttacttttacatcaccaaattctgtggttcttgttagtcctcaaccattcaattgcctagtggctttggttcacttaatcacttccttctgttgactctcatggctgtaaataccatgtggtgtagatgctttgatttatatttccagtctgatcttctgcattgaacttcagattccaatatccaactgcctactagaaactgcttttaaatatctaataggaatctcaaacaattctaaatatatacccttgggttttcccaagtctgctctttccataaagttcttagttgattttagtaaataccaacttcattctctaacacctggacctcatgcttgactcctctctttctctcaaatctcacgtcttgtatttcagcaaattgcatcagtattttctttcaaaatacctagaatctggccccttctcaccagtttcatcactaacacaacctaacccaggctcctttcccttctcgattggactattgccagacccctggttggcctctgtatttctgcctttctccccactatactttgtatgctatagaagccccagtgatccttttaaatataggtcaggttgtgtcactccagtgccttcccatctaactcaatgagaaagcaagaggctacaatgacctttaagcccaacatcaacaggcccttcctgcctctctgcttgcatctcctctccttactattctctttctcaaattttccaccttgctttcattgaacagatagccccaagcatgtttattcctccatgctttgaaaattgctcttccatctgcctggaattctttgtccagatatccttgtggcttattttcccatatccttctcatgtccttaaaagtaaaattatgtcagagatcttccctgaccaacccatgtgaaatagaaactgccttctacctcccaaccccacttttgatcttgcactttctgtcctccttcagaatctgttttctttaattgagacaaaacttacacaaaattaaccattttaatgattttaaagtgcataatttagtgttttttagtataattacaacattgaaccaccattaccactataattgtaaacatttttgtcaccccaaaaagaaatgctgtacccattaagcagtttatccattctcccctatcaccagcccctggtgaccactaatctgcattcctactgatttgcctattctggacatttcatacatatagtatcatacaacatatggccttttgtgtctagccttctttcatgtagcatgttttcaagatctatgttgtggtgtgccttagtactccttttttttttttttttctttttttgagacagagtctcgctctgtcacccaggctggagtccagtggcgaaatctcggatcactgcaagctccacctcccgggttcacgccattctcctgcctcagcctcccgagtagctgggactacaggcacccaccaccacacccggctaatttttttgtgtttttagtagagacggggtttcaccatgttagccaggatgcttgatctcctgacctcgtgatccgcccgcctcggcctcccaaagtgttgggattacaggcgtgaactaccatgcccagccagtacttcatttttatgcctgaataatactccattgtgtggacataccaccttttgtttatctatttatcagttgatcaacatttcgattatttctactttttgtctgttttgaatgtgttgctatgaacattgatgcataaatttccatgtaaacatgtttttcagttttattgagaataaacataagagtgcaattgctaggtcatgtggaaactctatgtttaacttttggaggaactgccaaactattttccaaagttgctgcagcattttgcaatcccaaccagcaatatatgagggtcctattttctccacatctttgtcaacacttattattttctgcttttgtttgttttaaaatttttataatcatcctggttggtgtgaagaagtaactcattgtggttttgatatgcatttccctgtagactgatgatattcagcatcttttcagttgtgtatcttttttagacaaatgtctattcaaattttttgcccatttttaaattgggttatttgccttttattgttgagttgcaaagagttatttatatattctggatactaccttcattagatatatgattgcacaggttttgtctcattctgtgtgaactgtctttttactttcttgatggtgtcctttaatgcacaaaaatttttaaatctgaagttcaatttatctatgtcttcttttgttgcttgtaattttgtcatcatatttttaaaaccattgcccaatacaaggtcatgaagattcatacctaggctttttggttttataagttttacacttacagctcttacatttacatccctgattcattttgggttaatttatgtgtatggtgtgaggtaggggtccagattgattcttttgtgtgtggctatccacctgtctgagcaacatttgttgaagaaattattctttccccttaaatggtcttggcagtcttgttggagatgaattgattataaatatatggatttatttctagacattcagttctattcagttgacctatatgtatatccttaatacaagtaacaaattgttttgattaccatagctctggagttcaggttttgaaatagggaaatatgaatacattttattccttttaagattattttggttagagtcccttgcgattccatgtggattttaggatcagcttgtccatttctgcagacaaggtagttggaattttggtagcaattttcttgagcaacctagggagtattgctatcttaacattacatagttcagttcatgaacatggtatgtctttctgtttatttattctaccattttttcaacaatattttgtcacttttagtgtacttgtcttgcacatccttgattacgtgatttctgtgtattcttttcaatgctttttattattattattattttattttatttctttttcagaaggagtttttgctcttgttgtccaggctggagtgcaatggtgtgatctcgactcattgcaacctccacctcccaggctcaagcaattcttctgccttggcctaccgagtagctgggattacaggtgcccacgaccaggactggctaattttttgtatttttttagtagagacaggtttcaccatgttggtcagtctggtctcgaactcctgacctcaggtgatccacccaccttggcctcccgaaagttctagaattacaaatgtgagccactgtgcctggtctatttttatttttattttgtagagacagggtcttattctctcatccatgctggaggacagtagcatagttatagcttactgcaacctcgaaatcctgggctcaagcaatcctcctgcctcagcctcctgagtagctaggattataggtgcacccaccacacctggctaatttttaaatttcattttgtagaaatagaatctcactacgttgcctaggctggtcttgaactactggcctcaagtgactttcccactttggtttcctaaagtgttgaagttacaggtgtgagccactgctcttgacctcagtgctgttttaaaggaagttgttttcttaatttcttttttggatttcttattgatagtatactgaaatatgactcatatttgcatattgatcttgtgtcctgtacctcttctgtacttgtttttttagcttaaatagttttaatttggattatttagtgttttctatatgtaagatcctgtcatctacaaagagatagctttactttatcatttctaatctggataccttttacttttttttttctttttgaagaaagagtctagctctgtcaccgaggctggagtgcagtgacatgatcttggcttactgcaacttctgccccccaggttcaagcgattctcctgcctcagcctcccaagtagctgggattacaggtgcccaccatcacgcctggctaatttttgtattttgagtagagatggcatttcaccatgttggccaggctggtctcgaactcctgacctcaagcgatacgcctgcctcagcctcccaaagtgctttgattacaggagtgagccactgcacctggccttaatttttcttacctaattgcactggctagaaccttccgtacaatattgagtagaaatggcttgattgctattgtcttatttctgacattagggagaaagaaggatgaagtatgatattagctgtgggctttttatcaatgccctttctcaggtcaaggaaactcttttctactcctaatcgtcaacaaatggtaccactactggataacattgtcatgaggtgtatatatgtgatatgtctaatacagtgtgatcagcatatagaaggtggtgaatatttatttcttttggctgccaacctcgaagttactgattaaaacattaaatgtgtcagaggccatcagcatgcgatttgatttctgtaggccctccatggaaaaaccattaaaaattctgttttcttttccatggggatgttgagatctggttattatatcttacaaatatcaccatgttatgggtttgcctaaagaatattgagttctagtcatagagtgaatcttttaatattatggatcttatctttctataacaaatcacgataaaaccaaccctttcatttacaaggaactacatgtgtggcaaaagaagaaaaagaaaagaaacataccaaccccttcacaataaaaagcattcatagactcaactattagcctgtttattttcaagacagaagaatctggataatctctttggccatcacacaaaaagaaaaaaaatggcaaattttcaaatgttgaagagatgatagaatgaccttttcttataagtaaaggatttgttttggcagggttgtggagttgctcagtgcttgaagattgtctgccaagttgggagattagacagaggaaagagtgcaatcttgtacgtaaagtcattactgtggactgagacttttatgaatgtaagtagacaggtgcagcatttagcaaacatacccagtgttttcaaataaatataaaaggcctgatatctgggaaatcatctaattgttatttccaaacagaaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttagaaagttggaaattaactgcaacaagtgaggcattttgaagatatttaaggagtaaaaatgggatcagcacatagtaaactggattggattatttaaaaatcatttcaagctgggtgtggttgcctcacacctgtaatcccagcattttgggaggctgagacaggtggatcatttgaggccaggatttcaagaccagcctggccaacatggtgaaaccccttctctacgaaaaatacagaaaaattagctgggtatagtggcgcaggcctgtaattccaactactggggaggctgaagcatggaggttgcagtgagccgagttcatgcccctgcattccagcttggcctacatactgggcgagactctgtcaaaaaaaaggaaaacaaatcatgtcagatgcaatcagaagtcagcctatcattgggagtttcatgtgtgtatgtgcatgctcttgatatcaaatgtgaaaccactaaattatcatatgcaggaaaagaatatactgtgaattccattaaaataaaatataatatttactcagatatttgttgattaagtcaatggactgtttttaaaactaaaagcttttttcctcgataggttaccactaatgtcacctggggcattcagccagcgcccatgcctgtgcctgtgtgggtgatcattttagcagttctagcaggattgttgctactggctgttttggtatttgtaatgtacagggtaagtaacggacttagaaagaaggagagagggaaagcagaagaaaagggaaagggaagaaggaaaagaagaatgaaaagtaagggaaggaagaaagggactgtaatgatgatacttgatgagcattacttattatatgagggaagataaattttatgaaatacaatttaaatgttcttagtggtaatatagtcacccaaaaaatacttttcgtattctacactgatgtgacagtaataatggtttttcttcaactgacagatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtaccacttttgtgtatggggtttatcctttctgtgatgtgtttttgttttttgattacatgagctagcaataatgcactaaaaggatgacctcagaggtaactttctgtaaaacttcaaatcttgaatgtcagttatttgatgaaaagaaacacaaaaagagcaaaatgtaccacattaaaattcatccttagaaaggcaaatatgtatttgcctgaaatataagaattattttatttctaaacaaacatttctaaattcattatgctaacctttattatttttacattatcagattccttttaaaatgcacatttacatcttttataatttttaattatagtgtatatatgtcattgcatatatgcagttgcaatatacatatgcaattctagtataaaaatacctatttttataaatgaaaagtaccaagaagaaaattaagtgttgagatgcttgggaaattatactgaagtagcataatacaccaccgtaaattcctatggaaataagatagagtattgccagcatccacaagcccccttctgtctctttctaatcatatctcaccctgccctgcaaaagtaaccactgtccttacttctaacactatatgcttagttagatgtgatatttcccctggaccagcaagtcataactacccctatcctgaccaccatacttgatattttggctccaattaagatgtaaaatgtacagcacctacacatggaagtattttgagtgtgagaattagaaaatgggcagagcctttctgtcctgcctgacttactagttgctctttaggatcaaataagataacacatatgaaaggattttatttttttgagatggggtcttgccatgttgcccaagctggtctcaaactcctgagctcaagtgatcgcctgccttgtccccccagagtgctgggattacaggtgtgagccaccatgcccttcctgaaatcattttgaaaaccgttgaaaccacttgggttcaaagctcttcccagtcacttacaaatttaccctctgtggaagtatcttggtccacagagggtaaatttgtgaggactttgtgaaaatgcaagaaaaggggttatcaaacgcatatgttaagtgcttatccagtaagtctcttccatcattcacttgactggtccaagaagaaaattttgagccgtggaattctcttttccaagattaattttaaacatccttcgaaccttataatggtgataaatcattaatgaggcaagccattatagagagttgtattagtctgtttcacactgctataaaagaactgcctgagactgggtaatttataaaggaaagagttttaattgactcacaattcagcatggctggggaggcctcaggaaacataatcatggctaaaggcaaaggggaaacaaggcaccttcttcacaaggcagcatgatgaaaaatgaatgcaggcggaactaccaaacacttataaaccgtcagatctcgtgagaactcactatcaatagaacagcatgggggaaactgcccccatgattaagttacctccatctggtctcttctttgacatgtagggattgtagggattatgggaattacaatttgagatgagattttgggtggggacacagccaaaccatatgaagaaacattcttgaacaggcctgaaatacgataaaattcaaccaccggcagccatgttggcaaaaagtgacagaactgtatgcgttttagaaaaagaaattatactacttatttctaagaagtagctttggtattttgct

SEQ ID NO: 13273 - DNA, 5048 bp, Human
cactccagtctgggtgacagaacaagaccctgtctcaaaaaaaaaaaaaaaaaaaagaattgccttgactttgatgatgactcttttgccagtcttcttcctctcacccagctgagctcatcccccacaagactgctttttataagtgaatggcttgtgggagaagaaagcatagctcctacttttcagaagcagatgggctctgtgaaagatgaggagagggcagggaacacacaagggaagaaaggcactgcttttcccctggattccattttttttttttgaaacggagcctcgctctgttgcccaggctggagtgcagtggtgcagtcttggctcactgcaacctctgcctcccaggttcaagcaattctctgcctcagcctcctgagtagctgggattgcaggcacccgccaccacacctggctaatttttgtatttttagtggagacggggtttgaccatcttggccaggctggtcttgaactcctgacctcgtgatccacttgccttggcctcccaaagtgctgggattacaggcatgagccacagcacctgtcctggattcctttttaaaaagaggattttattgaggtataattgacatacaaaaataacacatttaaaatgtacaatttgacaagttttgacatatttaaacaccacaatctagataataaacatatgcattgtcaccccctagtgcccctttgtaatcactcctcacccattcccctcctcactccatctcctggcaactgttcatctgcttctcatcactaaatactagtttgccttttccagaattttttgatcattgaaatcataccatacatattcttttttgtcttattctttcatccagcataattactttgtgattcatcttagtatgcatcaataaccaattccttttcattgctgtgtagtattccactatatggatataccaaatgtttatcaattcacctgttgatgacatttggggtttttgcagtttttggttattacaaataaagtgtctatgagcattcacatatacatttttgtattaacacatgtttttatttcttttgtgcaaatatctaggagtagaatggctggatcatttatcaagtatttttttttgttttttattttagaaagtgccaaactgtttttcaaactggttctaccattatatatgcccaccaacagtgtgtgggagttccacttgttccacacttgttccacatttttgtgaacatttgatgtgctcagcccttcacatttagatattctaatacatacgtggctttaacttgcattttctgatgactgataatgttaagcatcttttcatgtgtttatttgccatttttatatcttctttactgaaacatctgttcaaatcttttgcccatttgaaaaattgtgttctttgttttctttttattgaggtttgaaaggtctttgttctagatacgtatcctttttttaatctgtggttttctttttaattatcttaagcttatgatcacacataattttaaaatttgtgtgtatctcctctactttaatccttttaagttggcaaaagcaccattcccaatcacaaatatacagcagttctacagttttatgtttctgaatgggtgcggtggctcacgcctgtaatctcagcactttgggaggccaaggtgggtggatcacctgaggtcgggaattcaagaccagcctgaccaacctgcagaaaccccatctctactaaaaatacaaaattagcttggcatggtggcatatgcttgtaattccagctactcaggagtctgaggcaggagaatagtttgaatccaggaggtggaggttgcagtgagccgaggtcgtgccattgcactccagcctgggcagcaagagcaaaactctgtctcaaaaacaaaaacaaataaaaaaccccccccgacaatcctaaattataacttagtttggcttagattgtaaaaaattaaagagtgaagtttcctttccgtgctacctgcagagggatccatacggcgttgttctggattcccgtcataacttaaagggaaactttcacaatgtccggagcccttgatgtcctgcagatgaaggaggaggatgtccttaagttccttgcagcaggaacccacttaggtagcaccaatcttgacttccagatggaacagtacatctataaaaggaaaagtgatggcatctatatcataaatctgaagaggacctgggagaagcttctgctggcagcttgtgctgttgttgccattgaaaaccctgctcatgtcagtgttaaatcctccaggaatactggccagagggctgtgctgaagtttgctgctgccactggagccactccaattgctggccgcttcactcctggaaccttcactaacgagatccaggcagccttctgggagccacggcttcttgtggttactgatcccagggctgaccaccagcctctcacagaggcatcttaagttaacctacctaccattgctctgtgtaacacagattctcctctgtgctatgtggacattgccatcccatgcaacagcaagggagctcactcagtgggtttgatgtggtggatgctggcttgggaagttctgcgcatgcatggcaccatttcccgtgaacacccatgggaggtcatgcctgatctctacttctacagagatcctggagagattgaaaaagaagagtaggctgctgctgaaaaggcagtgaccgaggaggaatttcagggtgaatggactgctccagctcctgagttcactgctactcagcctgaggttgcagactggtctgaaggtgtgcaggtgccctctgtgcctattcagcagttccctactgaagactggagcgctcagcctgccatagaagactggtctgcagctcccactgctcaggccactgaatgggtaggagcaaccactgaatggtcttaagctgttcttgcataggctcttaagcaacatggaaaaatggttaatggaaaataaacatcagtttctaaaaaaaaaaaaaaagagtgaagtttaacttgctactattttaaaagcatgtgaccttgtagagcatctataaaatgtgagaagtgttaaataatctttgatattacacataaaccacactaaaatgcctttcaataagtaaaaagaaccattttaaatacagagaattctaattagattggcacagttaaggccaaaaatataaagtagacattgctcccttatttatcttcaactcttgcctttaagaggcaaatgaacacaaaacacaggtgaatcttgcttggttctgagacagtgaaggaatttccccagtatttaaatctattcacataaccagttatagaaatctaaatataaaaccaatctccagtaagttttaagatggcattcaccatctttgtgaaaagttgaacactactaatgaagtctaatcatatctttagaaggggtaaacagtgatagcatttactgaattggaattactattaaaattcaaaaactgaacatactcatttaaccacaagccagccttagttttaagtcaggactgcccaacagaatattctgtcagtcattcatgatctgaattctggtgtatgagatctattatagtccacataaaaaagtcatgaaacatttctgttttgtaattaataaggcagtgacccattattactcaatagtagcttttttgagataagctatcaagtctgccctttctgtcttcttcttaatgccggcaaagatcacttttgttccagggatgtacttcttgggagtctccaaatactccatcagggtatcctctccccacgtgatgcctttgttcttactggcatctgtgtaagagaatacagcagcctgacctgtcttccgcccgaagagaccatggagattaggcctagtcttgtgctggcctcacttttccacagtgtggcactgggcacacttctgaacaaaaatcttgcctttctcagcatcactcatatttaattctctgtttcatcgctggggcaacgaaggttcccattctgaagccggacgtcccactctctagatacatatcttttatcagatattaagatcacaaatattttttcccagcatgtggcttgcctcttcactctcttaaaagactttcatatgtaactaacctgcacattgtgcacatgtaccctaaaacttaaagtataataattaaaaaaaaaaaaagactttcaaagaccagaattttttttttttttttttttttttttttttttttttttttgagatggagtctcgctctcttgcccaggctggatgcagtggtgtgatctgggctcactgcaggctccgcctcccaggttcatgccattctcctgcctcaccctcctgagtagctgggaccacaggcgcccgccactactcccggttaattttttgtattttttagtagagacggggtttcaccgtgttcaccaggatggtctcgatctcctgaccttgtgatccacccacctcggcctcccaaagtgctgggattataggcatgagccatggcgcccggcccagaagttttaaattttgacagattccaacataatcttttatggattgtgcttttaatgtcttacctaaaaaatctttgcctaacccaagatcacaaaagcttttcacttatgcgttcttttaaagttttatagatttaggtttaacatttcattctatgatcaattttgagtttgtttttgtatatggtgtaaggtatatgtcgaagttcaactttttccatatgaatattcagttgttccagcagcatttgttgaaaagactatactctttccgctgaattgcctttacgtctttttcaaaaatcagttgatcatgtgtgtgggtctatttctggattctctattctatttcgcaaatttatttgtctatattgatgccaatatcatactattctgattactgtagctttatgatgagctatgagatcaggctgtgttagtcctccaactttgttctga

SEQ ID NO: 13274 - DNA, 81681 bp, Human
cataaaccacccagtctatggtattctgttatagcagcctgagctaagaccaataatactcatggtttcttgtgcatccttcaggtgatgtcttttctgtacgtgtacaagcaagaacttatgtatttattttttttcccacaaatgatggcatgctttacacacagttctgcagcttactttttacatttattactatattagatcaatctatgtgaaattaccaatattctactgttttgacccacaaaatatattggaaacccttcaatagcagtgcatacggagctgtttcagtctttttttcaaaataagatataacatacataagacttcacaaatattaaatgtacacacccctacataaccagcatccagatcaatcattagattattaccagcacccagaaggggctgggctgcctcccagtcactatctgactttgaattttatataaatggagtcgtttgatgtggactcttaagtgtctaggttttaattggttgcacaatagtccctttggaagccccttactttatttaaccctattggtgccttgctgatcgaccttaaaggtgtttataatcttttgcttttacaaacaatggggggatgaacaaccttataaacataaggtatttaaaaaagtgttttacaggaaatttcaaacacgtaaaaggaaatagattagactagtataatggacacagcttcaacaactatccacattctgttattctcctttgggtagaattccatttacttacccccaaaaatgccttagggaaggctaaatatgtagactccagaggctcagctgtaccaatgaatagctgcgtgactatggggaggttacctaacctctcttatcttcacctctaataacatggagatgatcattcctactgcttagagtggtggtgaggacaggggacctggatcagggcttttcggctgcaggtaggaagatgcaggtggaagcagatgggataggccacagtccatccactggcgttttatagagtgagtgccttctgtaagatttcattgacaaaagtactccaatggcttaaaaacaaacaaacaaacaaacaaacaaacaaggaaaaagaaacaggttgaagcctccactagaatgaatgcaaaggactcagcatgtcttatgtgctgtctccaccattctgcttttccagactgtcccttcttcaaatcaccgtttaacttgttaaaatcactttcgagccaggggacacttttccaggaaagcgagaaaatgccagggagaatcggggaatgagggcggggagagaaaagcgtcctaagacttgcattgcacaagctgaagtctggaattcgcaccagcgggattccatcctcttcccccccaccccaccccgctgctccccaccccttcttcgggaagatcgcgactctcccgtcgctcgccccaagcctctgcttcgtaggttctggtttcccaatcgatcgtgagtttctagtccctggagctgcgtgggtcgtgagttcaagtccctttccttccggaggcgacaacgttctcgcgggtccccttgccacgcagcgcgggcgtgcacgcccctccccgccgggccgcgctgccagccccgccccgcccctgggtgggaaggtcaaggggcccgggccctcccagcccccgcacccctgcgcgcgcccgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggtgggttctcggcgctggacttttctttctccagggtctggaagccttgctaaaaatccgatgggtggaaaatggttatggctgcgattcaggcggtgtcaggatattggaaaaggcatgagctagtgatgcaatgatattgttaattataaaaagctgcgcctctgtaatttccatcttgaagcgttcttttgggagtgggtattttctaatacagtttcaaaagccagcatcagagagggctgcgaaattctcagcgcttcattcctctttcttttctggaaagggcagcaactttgtcgttttaagggatttttgtatgtattttttaaatttcgggaggccaattactagttcactagcaattactgcgccgcatcggctgatagacaagcagacaggctagctgaacaccgcggggctggatttgctctatgtttgtgtgggattctcacagaagtttcaagccaatgagaagtgggaactgcagacagagatacatgtaagcaaatgttttgctattctttaaggaaattgcaattacagttaagtaatccttaagtcttggagaactttacctaaatgacacccacagtctttattcagcgagctcttgaaaacatactgctttgaacaaattaaccttgtgtgcgtatgtatgtgtctgtggggtgtgtgtgtgtgtgtgtgtgtgctgaaaactaagctgtaacaatgtcatcctggattggggaccagcacttctgtgacaggcagtcctggtatttggttggtctctccggctttccttgtgtttcaggctgaggcacaacaccggcgaacccacctgctttagaaagttcccaggaccggttatgagcaccaacctgcctccccccagctattcttatagttagttcatttttggagtttccagggttttttttttttaatcacaaggtgcagctattcgtgatgctgtgaggcagtagtgcttgggtattctttcattttaggaaaatcctattagcctggaacctgtttggcccccaggactcagctgtggctcttccaagaggctgggcttgaggcaagacctgtcccagggctgcctctagccaaagggaatggggctgcggggagtagggggaaagatggggttagcatgccttttcaactagctcttgaagtccactgtgttgcagtcagcctgttctttctccaacataaacgagacagggttttataaccaactgaaaggaaacttcatgtgaagaaacaggaaaacattgaaattcataatacacagactggaaaataaatttgttattgttctttcattccttccagatataaatctggccatggcaaatatcaaaaagccctgggatttggctctgcactttataaggtcagagctgtctccagcgttctagaatctggctcacccaggcacttacatgaaaacttgtggactctcagcgtccttattttttggattggggactcgataaaggaaatggcctcgcatctcctaagatcgtatcagggccctattccctctggatgtcagcttaactccaggtcctctaatacccagggttgctgatgcagatgggccatgtgtcctgaaagggagggattatattgttgtggtgcacgtttgtagtaacgggccccagaattcagccatgtccccaggttcactgctctgttgaagaagccttcaagatcaccttctccaggaagtcttgttgctacccacagcctggttgttatggcacccaataggtatttctttccatgcccttgccaaggtgtatggacattgtcgtggctccccaactggttctcaagggtagtggttgtttcacagttctgtagctcctccatctggcatccacacccacaagcagtagttgcttggataaactgctgttgaactgaataatagtactagataacgctctgcttttgtttagattttctttttttttttttttttgagacggagtctcgctgtctcccgggctggaatgcagtggcgcaatctcggctccctgcaacctctgcctcctgggttcaagtgatttgtctgccttggcctccagagtagctgggactacaggcgcctgccaccacagtcggctaatttttgtatttttagtagagacggggtttcaccatgttgcccaggctggtctcaaactcctgacctcgggtgatccacccacctcggcctcccaaagtgctgggattagaggtgggagccaccatgcccagcctgattttgtctttttttctaccataaccattttgaagagtctagttcagtagtgttaactgcattcacattgctgtgcaatctccagaactcttttcaccttgcatgactgaatctctgtacctattaaacaattccccatcttcccctcccactaagcccctggttaccaacattccactttttgtctctgtaatttcgactacactaggtgcctcgtataaatggacccatgcagactttgtcttttttgtgagtggcttttttcacttaacataatacagtcagggttcattcatattgtagcatgtgtcagaatttccttcctttttaagactgaatactattcccttgtgtgtacagactgcattttgtttatccatgtatccatcgaaggactgcgtccacctttaggctattgtgaataatgctgctatgaacacaggtttacaaatacctgtttcaagtccttgcttttaattttttgagggtatatacctagaagtagaatggctggatcacatggaaattctatgtttagtgttttgggagtcatcatactgttttccatagagactgcaccatatttacaccaacagtgcacaggagtttcactttctccacatcctccctaacgcttgctcttttccattttttaatagcctcatgagtgtgaagtagtagagattttgtatttttattttgtttttattttttgagacagagtctcgctttgtctcagagcgtgtaccaccatgcctggcaaatttttgtatttttagtagagagacaaggtttcaccatgttggccaggctggtctcgaactcctgacctcaggtgaccttcctgcctcggcctcccaaagtgctgggattacaggcatgagccaccacacccggctgcttttgtatttttaaagcaatcttgctggccacaatcttactggattaaagcctgtgcgtggcgaagggcagagttgcagactcccagagcatcactgtcttgtgcatggcagaactgagcccagggtgcgtgactcctcctcctgttttcccgcgggtttcattttccctgggctgtgcaggttccccgagtcctttcctccatcaggacctgctggcagcagttcccgcaggccacactcttcaggggacagggccaccccaacccatccactgatgggggattttcacacatgtggactcaatgctctggttcagtgacttcctgtgacacctttctttggtgccactcaaagtgcctcacattctcactttcttttcctttcactgtttgagggcatgatgatggcttattcactctgtaatcatgtcagcataaagatgttcaaaagtcaagcacatctcgcataaagaataaagaccaaggaactggttaataccatagtgggaggttttagcttttttggggggtggggggaggacaaggtctcgctctgtcacccaggctggagtgcagtggtatgatctcagctcactgcagcctcaaaccccctgggctcaggtgatcccacctcagcctcctgagtagctgggactttaggcgcgtgctatcatgcccagttaattttttttttaattttgtagaaatggggtttcaccatgttgcccaggcttgtctcaaactcctgggttcaagcaatcctcttgcctcagcctctcaaagtgctgggattacaagcgtaagccaccgcacctgaccttagcttttttttttgaagcagccaaaccctttattaaaaagtgtgatctaacacatgatcccaatgcaggaggcaagtagaagaggtgtggttctgcttgggtggtcgcggtgtctggaaccaccatgacctccctggagcacaccccaccccatacaagcccaaggtgatatcaccgttacacgtcacgggccgcatgcgacccacactcccctagacctgaatctgtcttgggcatttatatttgacttttcacctccacaggatactcactgttaccattctggctctctgtcttccaagccctgggaatgcacaggtaagatttttatttttaaaaaatatctacaagcgtattaaaatccggggtgagggagtccagccttgcgctacggaaccctaggtttgtgggggtgggagtggctttacagttgacctcatctgagctcttcattctcagaggttaacagtggaagctcagagaaagtgagacttggcccaggtgacatgacttgtaagtgacaaggctggggctggtactcagtttcctgactcccagtccaagactcttttctattttattataagttctagggtacatgtgcaggatgtgcaggtttgttacataggtaaatgtgggccatggtggtttgctgcacctatcaattcatcactaggtattaagcccagcatccatttttaatcagatcacatggcctcatttgtgcccctcacagcaggcctcaacctaccttcagtgttgaaaagtaaaatatgctgtagtgtttctgggcaatggcacctgaggacccccacgggtctgcatgtgttgccacagacacacccctcctggaggaggtgggagaggaagtgggtgttacccaaacatcccagcatgtagtgttgcataattcagctccaaacctaggagggcccatccctgggctgaaacccctcagaggagtaagaagggggtgggtgaggccaggctcagggccttaggggttctggaagaagcttgcagcatcctggactttattttaagcaacaggagagatggacccctgtgtgtcagccctgaaatgtgggcagatccctcctgaaaactccgagtggcctctctgtgtctctggctcaggaaagaagtgagagaagccctatctctgagcaggctgagggctgcaggcaggtaggggagcattttctctcttcatattaagaattttgaagcatattcaggccactggcaatgggaaggattttgggaggagtaacaaagaattttagaccttgcggttttctaaggcagcctcatggtgtacacatgaagacaggtaggccccaagggcagaggttcagggtcgtgtttactgcactttaggcacgttatatagattaacatacatcgtccttaccaccattttgaactacgtacatacccccccattttacagatggggaaactgaggcatagaaaagttacgcagagagtaggggctagagtgagaatttgaagccatgccctggtccagcagtcttgaacctatgccagtccttgacaaccagggctggaacctggatctcctggcctcccagcttcccggcacagcttcctggctcgtctgttccacttcctttgccccaactccctgggacccctgaaccctctcccgggagtgcaggccatatacatcatctctgcaaatcaaccaacagctcagcgaagcccaacctccgaagctgtagaaaaggccagggatgggagctcctagaaaatgtcaggccctggggtcttcctgaagagtccacccaacacattttttttttaagtacatacatttgtagctcaagttgtatgtaaaagctacaaccctctggaattgttgagatctatctctttctggaagcatctttatgtcgtcatcttgctgaggttgaaatggagaaatttactcaattcaacttttcttagaaaactgaccacatctctgtgtagcttttatttatgtacagacatcaaaatcaggtagaggatttcatgggggcaaataactcatattcgacactctgaaggcgaggtagcacctaaagaaagagtcattgcccttaaaagcagtcttattcattcccagaaaggggatgaacagggagcatgccacattaggctcagcagatatgattcctcttgctcttcacaactacagcattaaaaaccctgaaacctgtctgctaaaaatgggagctatgaagcaatggtacagggagtttttttttaaataaagtttttctaaaaacacagagatggggtcttgagggcggtctcaaaatcctgggctcaagaaatccttcctcctcagcctcccaaagtgctgggattacatgcatgagccactgcgcctggcctggtgtggggagtttagaaagtagttctaagtataaaataattacaaggaaaaattttagaagaacaaataggggttataatacaggtattggtattttggaggcctttcttttttgctccatttccccaactttctgtgttgcagcaataagacttttatggtgtgaaatgaccttgcctgtttctcctctctccttccctgcaggcacagtgcacgaatggctttgacctggatcgccagtcaggacagtgtttaggtatgagccactgtggatccttcattggggtggaggcattcagcccagttgcagtgctatttatttctttctctgttgttcaatgattagccatgcccatgggagaatacagtgacatggaatgactgaagtcagtggtgcccttttattgatcaccttctttgtgcctggccttgagctaagcactgagaggggtgaaagaattgatctctgttctcttgaaggtttctattggattggtgtttcctagggctgccgtaacaaattaccaccaacttagtggcttaaacaacaccagtgtatgattttacagttcagtaggtcagaagtttgacttgagtctccaccagaatagaattaaggtgtcagtagggctgtgtgctcttctggaggctctaagggagacttttattcccttctggttgttggcagaattgagtttcttgtggttgtaggactgaggttctgtttccttgctgactgtcagtggagggcaattcctaccttttagaagcctcctgctttccttggctggtggctcctccctccatcctcaaagccaacacagcgagtcaagcgtttctcactttgaatctcttctttttctgttgtagcatctctctgaccaatcagcctcttcttcttctacttttaagaactcctgtgaatatatcgggcccacccagaaaatccaggataacctccccatctcaaggtcagctgcttagtaagcttaattccagctgctaccttaattcccctttgccgtgtaacccaacctattcacaggttctgaggactaggaagagattttggagtgtttgtgggggtcattctcttagcatgccatcttttgcaatggactctgcaaaagaagaggagaaagtaataccttatgtccagggtcaataaagcatcgatggggccgggtgcggtggctcacgcctgtaatcccagcactttgggaggccgaggcgagtgcatcacctgagggcaggagtgcgagaccagcctggccaacatggtgaaaccctgtctctactaaaaatacaaaaaaattagccaggagtagtggcatgtgcttgtagccccagctactcaggaagctgaggcaggagaatggtttgaacctgggaggcagaggttgcaatgagctgagatcgcaccactgtactccagcctgggcaacagagagagactctgtctcaaaaaaaaaaaaaaaaaaaattaatggaggtcacatttgaattgggtattgaaagatgaataggatcctaagaaatgccattccaggtagaaggaacagcattaacaaggaccaggtgtggaaaggacactcagagcatggaatagtttgttgttgacagagcatagggcatatgaacggaagaagacagccctacttgcccccatcttaggggaagtatttagcttttaaattatatttaatttaagcaaaatcatttgtcttctctgagctaacgtcaccatgctccagaggggagatagatggtttgaaaaatcgatgaacagtgaggaataaaaccctgtcctgggaaatctgggcttacgttttgattttaaaataaggtgttttgatttgaagatttgatgaggaatcaagagtagagcagtggccttcttttctggccccccatttcagcgatggcttcaggcttcaagctggagaacaggctgttgcattctgcaccttgccattgcttttacctctggtaggattgggtgtgagtttctcagatgagatgctgggggtgagttgtcgggtgcaggcatgtggtctccagtctctagccccgcacagagcagactccaaggctgctgacatggctcggtatacgggatcatgtctactgctcgctggagccacagttcaggcctcccctgtctgtaccctagcaaggctgattttctagagagtccacctctccccttccagacataacaagcagagcccagcctggctagaaattgttggctggcacagagctgacttgaaagcaaagctctgctttcttaacaagcaactagctgtcagtcaagccttttcttttttttcttttttcttttttttgtttttgtttttgttttgagatggagtttccctctcgtcgcctaggctggagtgcaatggcgcaatctcagctcactgcaacctctgcctcccgggttcaagcgattcttctgcctcagcctcccaagtagctggaattacaggcatgtgccaccacacccatctaatttttggtatttagtagagatgggatttccccatgttgggaggctggtcttgaactcctgacctcaggtgatccacctgcctcggcctcccaaagtgctgggattacaggcatgagccactgtgcccagcctaagccttgtcttttcctgatgcaagagactctttctcccctgaccactgttacttgaagtagaagtggagacaattgttaggcccatcccagtattttcagagtatagtatgtgcacacgaggatccttgatgtattagatggtacatctgcagataaacactctttattttaatagtgtatatttatttttactgttaccttctacttatgctagttttcacttgctgtagtcatgtaagactttaaatatacatttatttgggcttcaaatatgggcttacttaaagaaagagtatgtgcaaatgatagtacaggtttgttttagtccgttctctgttgcttatacctaaatacctaaaactgggtaatttataaagaagaggaatttatttcttacaattgtggaagctgagaagtccaaggttgaggatctccatctggtgagggccttcttgctggtgggggctctctgcagagttccgaagtacgcaaggcatcacacggtgaggggcctgggctgctagctgaggtctctcttcctcttcttagaaagccaccagtttcatttccaagataacccattaacccattaatctatgagtagattaatccattcatgagagtacagccctcaggatccaatcacctcttaaaggccccaccactcaatattgcaacactggggattaagtttcaatatgagttttggagggacattcaaactatagcaaggtttttgtagatatggtcaaaatcatgatggtggtatttgaaaggctgatgtttgagtgacactggttactttgatacacttcagccaacatttggggtaccttaccgcgatgagttgggaccgccctaggtgtttgggagtgcttcctccacgcctggtaccgagttctgcttaaatatgcaccggacacaaggcagttggggtgccactaatgctcgccctttctgtgcctttcagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtgggtgagtagcccggccttttgttcctctccgctgtgctttggtgaagacatcgtctgtatctggcatgctcaccacaaatgggttgttagttgccattcaatgcaccagtgaaacaatgacttactctctgcatacttatttcactcttagcagcctgtatctctgggttcctgcccaactagggaggttattttgctgttttgttcacagttctccagaaaaccaatttttttctttattttactttcatctatctacctacctatctgtatctatctatctataactcatctatatatttaaagaccaaggtaatattttctcaaataaccaatacatctggtcagacttattacagtaagtaaatctcagaggaagttctagacagggccaaagctctgtcctcagcccccgcacccttgattggaacatgtgcttctgcaatacaagaagccttgaagggcacggccaactgttctggaaagaaaattaggttacttgggttggaactaatgtgcttgtgaccaaaaggagcctcactgataggaactcacagcaagaatggacctccgggaagaagcaggcacaaaggaattggcaaggggtgtgaccaaggtgcgctgtgatcgcgcctgtgaatagtcactgcgttccagcctgggcaacatggtgacaccttgtctcttaagaaaaaatatatatgaattgaagttttattacttttttcctctaccccaaaagtttgagagaccattggtctagcaagatttttgtttgtcccattttgttttttgtttttcccatttttgtttgtcccaagattttgttgtcccatttcagggctctggagtgttgagctgtaacccactattagggaagctgtgttggttaatttaaggtgtcttctatatgcttatatgaaggagtgtgcattctctttttaatacaataattgcagacaagtgtcttcagagctatgagggaacactgggtatgcttgaacccaaacttctgcattttcgctggtctcaaggcgtgtggtctctgtgtgtgttggcgtggggagagagaaagagtgagaaagacagagctggttaatgtttaccttaaacgtagatgactgtgcaaagggaatgagcgcagggtccggtcaagccaactttggtggagaagatggtaacatgcttccttataaccagcatcaggaggaaagacctttgtaactggaagggacttttttttaccaatctttaacttcaacttcttcattttgtagaaaggagagtgtggactccaaccagttaggtaattacagaggtaggatgccagtccagctcccctaacttctcccctgtctacaatctcctaactataggaaatgacctctcctatctggtagaaaagaaatgatcccaaaagaaaatgcagagatagaggtgggaggtgctgctcttccaggatgtcacgtgggggctggataagccaagtgatcagcccttacgtgtcttgaggtgaggaagagggtgtaatgattctttcgaggcactctgcggttttggcagggggccttgggtggtcgtggtgcagacagctctagctgatgcctcgggcaagctcagcggcctcctttgcagaacggctgggaactgctgcggctttctccaaagtgtctccctccttcccctaaacctctttccagggtcccagtgcccttgacaatgaggacatggctgggaaacctattcctcccctggtccctctgacgtcatgccatttatggctctgaacctgtcacacgggagatgcggaactttcataatggcccttttgtaaggagaatacaatctaggagccctagtgaggactggcaccaggcccatccatttccaaaaagttcagcattatgcattcataagtcctgagttctttctaacttcccttcaccccaccccatggtttcctggttttacacagggctttcaaatggccctcgctgaggtccctctgcgtattgtaaagagctggcattgtgggggtggggggaagtaagagaagggatgggaaagggaggctctttctacctaccgctccttccaagaactgggatggaagagaggtgggcctgggagcaggtggaagggaagcaaggcaccgtggcggaaggtgggagggaaggaaaccagatggggggatcattgagaaaagacaaggaggtgagtgtggaggtgtcactgcccagagaatgtgggtgttttccagagcacagctctgatcctgtggaggaggcattgcatgagcagtgggtaagtcagggagacttgggaaacatttctgaaactttagtgttctaggagaggaggaaacatctccaaaggtgtcttgtcctcttcatcaaaataagaatagcgatcaacagtaacatccgcagcagcagtggtaataatatcaaacacttggatagaactcgtgtgctaggacctttacaataattaatgcgcttgatcctcataaccagctacaaggtaaaactattatcattcctattgtacccatgaggaaaccgaagcagagaaactaagaaacctgttcaaagtcacacagcaagtgaggggccgagccatgatttgaaccattcaggctttgaatgagaaaacaggctcagtgaggtatagatttgttcgagggtgctcagagtcagtgctgaagtcaggattaaaaacaaggtccttctcttgctatttttgttttctgagacagggtctggctgttacccaggctgtagtgcagtggcacaatcactgcaacctctgcctccttggctcaagcgatcctcccatttcagcctcccaagtagctgggactacaggcatgtgccaccatgatcctcgatcactgcaacctctgcctcctgggctcaagtgatcctctcatttcagcctcccaagtagctgggactacaggcatgtgccaccatgcctggcttatttttgtatttttttggtagagacagggttttgccatgttgcccaggctggtctcaaattcctgggctcaagcaatcctcatgcctcggcctcccacaatgctgggattataggtgtgagccgtggcacccagctatctctctttttttttcataatgaaactttttgctctgtaaaattttgaacctagtcaaaagtagaaagagcatagtaagcacctacctacttatcacccaacttctgtagttatcagcacgggcacaatctcctttcttctttacactctactcagtgcattaatttaaagcaaatcccagacatcatataatttcattcttaaagacttcagaattatctctaagagataaagaaattctttacaaaaacaaatttaaggccaggcacggtggctcatgcctgtaatcccagcactttgggaggccgaggtgggtggatcacctgaggtcaggagttcgagaccagcctggccaacatgatgaaaccccctaaaaatacaaaaattagttgggtgtggtggtatgcacctgttttcccagctactcgggaggctgaggcaggagaattgcttgaacccaggaggtggaggttgcagtgagccgagctcgtgccactacactccagcctgggtgacagagcaagactctgcctcaaaaaaataaaaaattaaaataaaaaaacttccaaaaagcacaataccattatcaaacctacagaagtcaataataatctctttttatcattaaatatccaggtagtgttcaaatctctctgattgtctcataaatgccttgcaatttcatcacaaatggccagaagaatccctgcagtccccggagtagcatggctctaacaaaatcctgctttctcagccacaaaacatttcactaacattagttattggagtccctacatttgccactgagccaagttggttagcaaagccagaacttggaatatccacccagagggatgacaagctgagccccaaaggggccatacatacgaagccatctcagcagcctgttgtctgttggtttgttggaatcagatccatgcaaattctgcaaattgcattggttgacaagtctcttaaatgtcttttagtctttactgtttccctggccacttatttgttgaagaggctgagctgcttgttctgtagaatttcatacgtttcggaggtggctgattgcactcttgccggggcgcgggttatcttattccttcgtcccctatattttcttgtaagctgctcatagatctagggacttgatccaattcaggttaaatttttgggcaggctattttgcaggtagcatctttgatcttttgccctcttcatgcactgatttcttctcaaagtgtaagacagtctgccttggggaggcaaatgagcatcccctttcacggcggtttactttttctagggtttggacccactttcaaggaagcacttcatcccttggtgccgcatgaagccatgctgtttccatgggctgggcggggccgggctcagcacctgggtggccagtccctcagagcttcctcctcaatttttctctttttggttccactttggaggtgactagaccctgtccttttggaacaatgtttggccttaggtttgagtccacaggcccctaggtgtgcacttgggacatttctgcagacacagtgaacagtgacctaggaattatagtccacgagccaagcaagttttgtgttgttcagaaaactggcatcttggcatgacagtgatgggactcatggctcattagagtgtgtcacccagatcctggacccttgggagatctggtgaccagattctcaggggagggagagccagacagacatggttaacgggtaagcagggaggggctgctgaaggagagcctcacccaacagctcacaatcaagacccagacagaggccaaatcaaacacatacgtagagttctgagctggccacatagacatcccagagaaggacggtgtggggctgaggatggtgtggtgctgaagcctcagggggtggggtgagctggtgccgagtggctggggcacccaagatgtggactcccattcaggaaccttcctctcatggcacgctgcctctaagaccgggtccctgaacgtggccgccactcaactctgtcaactcattcccttgggggctcaacttgtcatctctctgggtggacattccaagttctagctttgctaaccagcttggctcagtggcaaatgtagagactccatcagtaactcatgtttgtgaaatattttgcggctgagaaagcagccttttactagagccctgctactccggggactgcagaaattccggccatttgtgaaattacaagcaatatcttgattctctcttctagtccaggatttttgttattgttattgatctgagaacaggcagagagcaacacatggaatccttttggaaggtgggtggtgttggtctgaggctttctcttgagttatttttcctgaaagccagccagtacttcttcagtcaaccaatgtgtacagagtgctttgttggtgccaggctctggcctaggcaccgagggggatgtggagttttgcatggccacggagctctctctagagcttgtggacaaggaagggagattaaacgcaacacaagcacaagcagctgaaattcaagacggcctctgatgagttcctgagatggtataaaaagaaggcagagataagaagccttctggggtggaggggactggaactgggaagtcagacaggctttgagtctcaccttggtttggccacttcctacctgtgaggacgggggttggtttcctcatctgtaaaatggatataacaatgcctgtctcacagataacatgtgcaaacaccttgcccagtgtttacgcagagtatcccatagtaaacgttaactgggaaagatttgtggagaaggctgctagggtcttgagatgataacccaggggaagagtcacagagtctgaaaatgcatcaaacgtctaattcttcaaaacctttaaaatgacctaaaactgagcctagtacacatttaccttgcaggcctcgaacggctttccccagctaagcctgatgtggcttcactcggaatctgcttggaaatggcagcagaacctgggattatttaaattgtgagacagaaaagtgggaagtgggaacaaatgtggcataaaggccggggcaagtaggaacctcagcccctaatgctgacaggactgtggttagcaaaaactagggaggagaaggcggccttcactccaacagacttttcttagtttttatacagtcctctggcttggtctgtaacttgaaactcagtcctcaggctgagaccagaaggaaaatgcgtgaaacagatctggaggaaaatgcgtgaaaccatgaaaccgattctttagctgctgagggcattgggactacgcaggcccagagaggaaatgggatcgcattgaggtgggggttctgcagctgggttcgctcagatgtctttgtgaattggccccagcaagcttgttcatgggcatggcctccccaggtttcccaccttgctgcaagtctttccctatcattgctgggatgatgggcaagtggcttcacttctctaaacctcagattttcctcccgtaaacagggataacagtaccaaccgccacaggaaatttggagaattaagtgagatatgcatgcaaattgtctaacatcgaggctggcttatcataggggcttcctaagttcgttactgtaattattgttttcattatctcaaatctcatcattccgtgatgacttctcctgctccaaacccctagtcctgttattccattattttttattctttcttctgggaattagatttaatagtgtgtgtcgtttagggagttgaaagttgaattcttgccaattttcagcagtaggagttggggttaacttgtgcttccagggagacacaaacacagacaggactccaggaagttgtccaggacagctgttcccaaaagtagctgtgcccatgaatcacctggggaaaatgcagttctgactcaagaggtctggggtgggccccaagggtctgcattttcttataagcccccaggtgatgccacgctgctggtccagggaacaccctttaattagcaaggccctagttcatctgtctatttttcgacagaactgtgtttaaagaaaggtagaaggtttatttttttcatgcaatttgtatattgtttgaatttgttagaagaatgtgttacttatttaaaaacaaaacacaaactggaaagaaatgattttaaggcctagattgaggtagcatggtgtagtggtaaagggatgagatgagacattagtaagaactggattttgatcccagatttgctacttattagctgtgtgacatttagaaagccacttggcctctctggcctaagttttattatctgtgaaaagaaaggatggtattatactaagggtcgtaatctggggtctgtggatataaatcaagggatctatcgtcatatttttccccactaactttgaattgagatttagcattactgtccattgtaggcaacaggccacaggactattagcagtacctgggatggtattgacaagagaatcagatatttacatatcacattacagctgtggcagttattttgaaatacttggaagtattttgaaatgttttgaaaccttcaaaatcatagaagatactagatctgcctaatttttttttaatgcactgataaacaagtatctatatcactgtatcatgtgtgtgtgtggggtgtgtgtgtgtgtgtgtgtgtgttttgagacagggtctttttttttgagatggagtctcactctatcgcccaggctggagtacagtggcacgatcttggctcactgcaaactctgcctcccacgttcatgccattctcctgcctcagcctcccgagtagctgggactacaggcgcctgccactgcacccggctaattttttgtatttttagtagagatggggtttcacagtgttagccaggatggtctcgatctcctgatctcatgatctgcccacctgtgcctcccaaagtgctgggattacaggtgtgagccactgcgcccggcctgagacagggtcttgctctgttatccaagctggatggattacagtggcatgatctctgctcactgcatcctcaacctcccaggcataagtgaccctcccatctcagcctcccgagtagctgggactaccagtacatgccaccatgcccagctaacttttgtatcttttgtagagacagggtcttgctatgttgtccaggctagtctctaactcctgggctcaagcgatcctccttccttggcctcccaaagtgctgggattacaggtgtgagctgtcatgcccagccatacattcgttttttaaatattttgatagctgcatttcaatacaattgttttctttcgtaatcctctgagttttattttatgcaatttagggcattattctgagaagggagtacatgggctttagcagtctgccaaacaggttcaaggcacacacagaaaagtttaaattccctggttctgatgatttctcaggtttcctgcaactcaagaatgttctactattctaaatcttcccaatctttaggaaacataattttttgcgttagccctttcccacctggattgcctaggtgacgtggctcttctctgttgcgtgtgttttaacagcacacatgcctgctgacacctgccgggaccctaccaagtctccacttgtgaggaagtcccttccaccctcagtggtagatggctttggttattggcactggtctggtgaggttcagtgcactgactggcctcatgttctgggtggggtcccactggtgggccatgcccagcccttggtgcctttgtgtagtaggtcacttccccagtgtctagcgtggcagtcttttcaatgacctacaagtttttcttggctctcatcttatgttccttggtctagtcatgttacttttatttctactccactctggaattagccagttgtgtgtgaaaagcgagtggtgttgcagaggagggatgaagtgtggactttttaatggcaggaccattcagctctggtctggcaaaagtggctgcattaccaagtctccagagagcactgcctggagggcaggaggttgaagttacctgccaggttgcaaatagcctcgaatgccagggccagagctgagctgactgtttagcacatgtcttttaagttagtaggaggtgcatgctatgatactccttagagaagtgcagtcattctaaatgtgttgagatggagcaaggtgatcacaccatctcttttgttgtcaaggctagttttagatttcttttcaaaatccttctgatgtaagtgggttgaatccaccactggaggactctagaacagaatgactcacataggttctgtacagaaattcgcagatgttctgtggatgttctccgcggctcttatctgtttatgtggatggtgtctgcatagcatctgcagctcacacccccaaccctgctgtaatgcaagaaacagagggatttgggggatttgggagatgtttatgttatcagggatgttaaatgaaagaagtaaaaataccatatgaatgcaaggcattcattttatggagagtgtgtgcctgagtgggataaaacggattgaaacaataaatgaggaatcctgtttgatgttgacgacaacagcttcatgtaaatatcatcccataggcccaagctatttcttttgtggggaaaaatggagatcttcatttctcaaaggatctgaagtgagcaattcaatgatgccaggcactagtggtagagagtgtgatgcagtggaacgagcatgggcttagattcacacagacgtgggttcgaatcctatcactgcaccgttacaaagcctttaaatcctttgagtgtgtcccagctacaagatgggacaatgatgcttatcttccgggaatgttttgaggcttagtgaaggcaggatagtcaggtcttcaccctctaagcaatcgcgttgtcactcccacccgtccactgccccccgtccactccccccgatccactccacgtacctgcaagctctttatctcacaggagcagcaactctgtttgctttacatcttagcagtccctgccagtcatagggtcagacacgtggcaggtgcttgttggctgcttatctcaagtggggaagtatgtggaaggagcattagttggggagggagaagaagagggacctctttcaattcgtgatcatgtcttgacacttcaccccctctgtctccactctgacctcacacaggccacagaggcagctttcgagcctttctctggggccctcttagactctgggagtgctgaagagctacctgggtaccttcgttctcctatccgttgggctgccatcctctgtggacacatgtaccacacaggccacgcggtgcccaggcctggcaggctgggactggggaagtgctggtggtactgggctgacccgtcatcagagagacccatgagccagacagcctccctccagcagccagccctgggccttgagcatggaggcacagaggccagggcttcccagcagccccaggtgtgtgcaccgagggcaggcaggtgcccacaggctcttgtctttcataatggagggcatggctgtcgggggttcagggaagtgggtggggtgcctggcagggggattcctgagacaaaggcacagtgccagcctccactgtttatccacagcatctggcagagtgaggctctcgtggagtgatttttgaatgaatgaatggcggaaggaagagtgcgggcaccgatgaacccaggctagccagaggggagcgccactgccttcctcactcagtctcccagcactcacctccagcacaccctctgctgactcctcccactgtactgggtgtcaagcagggactaaggtgaccaagagtctccttgttccttaagcgccttgtgggctggggccatggtcgctgtggctgtcctgcacccagcaagacgctgggtaccacggcagctcagtgagtgttagatgcaatctaatgtacagaagcactgacgggctaatggaaaaagatgcctgtgaagaaccttccagtgagattaacttgcaaagaaacccacgtccactgtccccttccttaaggggaaacgctgtgggaggctgtgcccttcgtaccttgaagccacagctttgttttcctgccatgggggagactggctcccagggcttcaccaccagccagcgccagctccttgcacaactccagagggcaccactcaattgtattacatgtcactggcaccccctggagcccagcaaccatcccgaggctcctgtttgtcttggaaacagaggagcatgcttggggaagggtctctgggccatctccttgggggctggcagggaaaggacattcacaggattccttccctccagagggcctcagacaacagactagatgtcaaggactgaccgcctgttcccctccagcttgtcggagccgggccagaggggagatggggacagccagtgctgggccctgctgcaggcagccagcatccacagactctggggccggcgggtatgttggggccggggaagcagaatacttggggtcttgtcaatgctgtctgactttctttcaaactaaaacatttgtggaaatctagccagagttgatttatgagctctacatatttcacaggtcttaacacgtcccccaggaatcagtgaggtcagacagaacagactttgcatccggaatcagtatgaaattggcatcttcaacagtttccatgggaggaggggtttaagaatttgagggagattatatgaaacaatgcaaagacacaaaaaaccctgactctgcttcattccattagggaaaaagatgggtcatctgttttctgcatctgagctgagtgaggggtggccttctccgtggggacagggatgaagtatgatgggacaggactcctggggcaactgagagctcagagtggactcaggggtgaccacagcaccctgtacttattctccagctcacactccatagctgtgataaatacacatttgtgattatttatttaacatctctccacccaacagagctttctgtcttattcgccattgtattttttttttctttttctttttctcttgtgcagtggtgctatcttggctcactgcaagccccatctcctgggttcaagcaatcctcgtgcctcagcctcccgagtagctgggactacaggtgtgtgctaccagctattttttgtattttagaagagacggggtttcaccacgttggccaggctggtctcaaactcctgagctcaggcaatccgcccacctctgcctcccaaagtgttgggattacaggcgtgagccaccacacgcggtctcaccatagtatttttctagtgcctgataaatatttgttaaataagcagaaaagctacatgagtgaattatatatgtgggattcaaatgagaaagagaaatggattatatattaggtacagtttctacataggttaacttatgaccactgatggaattcatttatccatttaccatttatgtgttgaggtctgagctgtgcatgtaaagattaacccatttatgcctgatgttgcaatttttaaaatttttgcaatcagaccttggtgatgaccttgaacaggagaatataaataactcccacatgcttagcgttccaataatggaacactaggcataatttatcagatatcatcaccccctggcgagttcacagcctcttggcgggagtcgggtggtttggcaggaaatatgaaacccaaataattttatgtagcccagtgaaatgggatggcaacgaacgtaggtatgggacactttgttggctctggctggagtggtcacagaagctttcctaaagacagggttgcatatctgtgcgtccatttgattaaacaatattgactgatcacttttctgtgtcagacactgccaagggctaggagggtctaaggatgaacgagatgctgtccctgccctcaggatctctctgctgagtgggtgtgagtgggggttttggaggggggtgtacataactcatcagattctcttcatgagccagtgtcagatgtgactgatgagagcaatatgtcccaggtgctatgggagtgcccacgaggaatgtgaatgcatatggtggcctttagcaagtctttgcaggattgaataggatttccatgtcagagacgaggaagggcagtcagggttagggaacagcatgggcagagacatggagacaagaaagttcactgcatgttgagcagtcttggtcatgagtcaaccggtcacctgcacacttatgacacccagtgtggctgcagcatggacacatgttgtgggcagggcaggcacagaataagagatgaggcttagaaggttggcactcaagattccccaccagattgtggggccttgaattccatgcagttgacttgggctttattctgtgaacactggtttttgagcaggggagtgaaatgtttacaagcctatttggagatttctgcttagcctagtcttagcactgccacaagctcattgggtggttgtgctccagttccttctctttctggggcttcagttcacatctgcatgagaggggctgggccattatctgtgaggcttcctccagccttgaccactcaggatgcaaagatgcttatgacaaccaggtgaagggtggcttctggagacaggcagctttcggagatggtatcttctcatttgaggcattgattttgcatgtagtctaagctgtaggggctaattactgggtcacctcataattacatcacctccatgttctcagggtcctggtcaaagtctcctttaggcttaaaacagggatgagccctctgccgagacccctgaaaaaggggcatcagtggatggatgaaattggctctcactgtgatgatagggcctggcctggtcctgtgagaaatctgacactgcctttataattcctgggggaagtttgcaagcagctggagcaaaacacaagctccttaggaagccaagaatcctcccagattgaccaacaaggtagagatgtaagcgatcccaccatcagacgtctctggaaaatcccacctcagacctcagacctcctcaacagatcctttttccaggattgtctcaatctcatttctctccagagagcagacagtggctgggggccaggtggcactggcctgtggtctgttgtggtctccacttctccccatggaggctgggtcctgcggttactgccatgagtcctttcattgtagtaattcccactggaacactgcttctcgcttttccaaatgctttcgtgtccaccagctcatggaattctcaaaatagcccagggaggaaggcaggcctaggaatgttcttcccttcattttatttatttatttatttatttatttatttatttatttatttatttactttattattattattatttttgagacagagtcttgctctgtcacccaggctggagtgcagtggtgcgatctcggctcactgcaatttccgcctcctgggttcaagcgattctcatgcctcagcctcctgagtaactgggattacaggcacctgccaccaggcccagctaatttttgtatttttagtagaaatggggttttgccatgttggccgtgttcaaattcctgacctcaggtgatccgcccgccttggcctcccaaagtgctgggactacaggccaccgcgcctgtctgccccttcattttagagaatatgtggaagggctccatgactgtcccacatcccagagtttgcttgtgatttagactgaccagcatgtgggcccgccagctttaggcccttttaggccatcccacgacgtgccctggttggtcataggcaccatgccagctcctttctctaccccaaatataccaggcccttctggacctcagggccttcacactttctcttccttctatttggaactctctcctggctcttcacattgcgggctcattctcctctctggcttcagctcagttcagatggcaccccttagagagtcctactcaggctgccttgtctgaaattacaccgcagttactcccaatcacagccttatcattttccagcacagtcttcagcgtgcattaaatccaccggaggccttcaaacacagattgctgccgagtttctgactcagtaggtctggggtggggtcttttcttctgagtgatgctgacgctgctggcccgggggctgcactttgagagccactgattggtggctttttatgtatttgtttgttgattttcccatcccttagctgtaaacttcaagaggggaagaaacgttgccttgtaacctgctgcatccccactgcctggcccatagttggtgcttgctaagtacctgttagctggctattggctgaaggctcagctggaacctcttgcttcataatcaatcgtcttgcacctgagagggaagaaggacaagcattggcagaaactctgggagctacttggtctcagctcttctctgctttactacctttttctttaactttttcatgcttgagccttttctaagggtcattattaattttgggtaaagattacatggataattttcataaaatcccaggtgacggattttactttctgggttcagaattccaacgaagccgcaggacatctgggtaagagaattaaaatgtcgtgactggcttgcatagaacacctcgtagaattcccaatgtggtactttcagaaccctctgtgtctcaggcctactagcctttggcttcagaagaacaaagttgaaattttgccagattggagttgggttttaaccatgaaatgttatctatcttccctgacaaagaggagttgaagaccagttctaatgatagatcccctgaagatattgctttggccaagggagtgctgagggtaggcttgggctgacctggtccatacttcgtgctaccattgggggccacaggcaatggagtatgtgggttggaggcttgccaggaggagggttggcaactcctgcataaaccaccacaaggctgctatggactgagaatcgtgggaacagctgattctgcccaagggggttgaggaagtctttaccaaggagggacatttatagtttggttgagaaatctggaggataggtatgtgatatgacaggatttgtccaagatcacctggcaggccattggcagcgctgaaaaagcccaaagtctctggtttcttaatctccaaaaatcatgagttgtgcaaagagatcagattcagcagctgaatgaccttgagcaagtcacttctccgtggttgaaggatgatctttaagattcgtttagataattcattcatttcgagacactggggatagtaagtgaccagtcctctttgtaaatcatacagccctattctttccatattcaagctcaataaatagttgtacattgaatgaatttgactgctagcatcatctctttccaaagacagaaaatatggggcaggagaccctggtgcattagcaggcagacaagccacaaatgggttaataaaatagagtcattaagacaacaggagatagtgcaacttggcttttgactctgaggaggagggaaggcttgccaggattgcattccagcacagcctactgaccgtggggaagagtgtgtgggactccaagtcaagccccaagagccacacgcacgctaataagttctagtcaacaagaactctgaaaccagacaggggagggagaaggacaaggcagtctacttccctctggaagcttgggaggtgctcagggccagggggaaagcccacacaatgtactagtttgctaaggtggccataacagagtaccacagactgggcagcttaaacaacagaaatgtattgtctcctcgttctgctggccagaagtctgggatcacaatgttggcagagttggctccttttgagggctgcaagggaaggatctgttccttgtctttctaattggcttatagctggccctgtgtctttcctttcctttacttgactttgtctttcctctgtgggtgtttgtgtctcagtttcctcttcttaggaggacactagacattttggagtagggcccgctataacgggctcattttaactgaattacctctttgaagaccctgtccccaattgcagtcacattctgaggtactgggggttaggacttgaatatatgaattttggagggacacgattcaccctataacacaggacacagccctcttcctccagtggggacccttttgaggtcagagacccctggtaatccttccttccttccttccttccttccttccttccttccttccttccttccttcctttctttcttttcttttcttttcttttcttttcttttctttttttttttcttttttttgagacagagtcttgctctgtcacccaggttagagttcagtggtgtgatctcggctgactgcaacctctacctcccaagttcacatcattttcctgcctcagccacccaagtagctgggattacaggtgcatgccaccatgcccagctaatttttgtatttttactagaggcagggtttcaccatgttggcctggctgacctcgaactcctgggctcaagtgatccacccatcttggcctcccaaagtgctgggattacacgcatgagccacagtgcccggctgccattcttttttcttatccttaatgaccttaatctgtgatttcttcccagaggccttcttagatctttactgatctcatcccaagcccattggaacctcctcttctctgagttcccaaaacactgtgcttgtgcctctgttgggacatttctcaccatctaccttagacttaggaatgtgcttgtgccacttactcattaaagcttcgtgtcctgttatctttatgtctctttcatatcccctatctcctgtcttgcagatagaacagggtcaataatgtttgctggcttgttgataggtcagctgtccaagaaagttgggtaataagtgctggataaacaggaagatgaggttgttagaaaacagcaacagcaacatgcctttccttagattttgtgcactcgtagacaaagtcaagctactggatttataaagaaaagatgctctttccatccttccatccttgtttggccccagtaggtcaacagaagaatctacaaactgggtgctcagcattcttaagcccccagagttcaaatcgaattcctcttttggccagtcttggagagactcttcaatcatatcttaaataatggcattcttttggctcagctctatggatactcctccttccgcccccagtcccctgaccttctgccctcttgtttcttggctgaaaatctgggtctgctgtagagagcaagagcagtttcagcagagctggggtccttcccacaaatccagagccacacactccagaaagcctgactatgcagaaacagctgggttttggcaggctgattctgaaaagcttcgaatcacttagaagcactttgttcccaaatggtatgtggaggatgaggaatgtaccatcagatgaggcaggtcacccatcttgttatgagaggactcatttgaggactgtcccttgaaacagcttccctgacctcccacctttaccttattctagatgtgacactcccaactggttcatgggtggtacaggtgcctggatattgatctcttcagctcttgggttggggggcaggggcttcagagggaggcttagtccttgggccaatttgcccattccattgtaccttacacacttgtgtaatgttctatgtgtgcctcaacatgaaaaaggttaagaagggcaactttagactggcgtgctctgcagagatttctaggaacatagagcaaatttctcatttaccttttaaagtgaaatacattcacttgttacacttggtgctgtggcttttgatgaagcaaatgccaacattaggactctgtgtctccataaagctatagggaaatttgattaaattcagtgtattagtcatcaggactttttgattgcaactgacagaaacccagctccaagtaacttaagcaaaacaacaataaactacctaaacgtattttgttttttctttctttcttttttttttttttttttttttttgagatggagtctcactctgtcacccaggctggagcgcagtggcttgatcttggctcactgcaacctctacctcccgcatttaagcaattctcctgtctcagcctcccgagtagctgggactacagttgcacgccaccatgcccagctaatgtgtgtatttttagtggagacatgtttcactatattggtcaggctggtcttgaattcctgaccttgtgatccacccacctcggcctcccaaagtgctgggattacaggcgtgagccaccacacccagcctaatttgttttttcataactgaaagctgagaagtagaactagcttcagacatgcctgagggcaagggcttaagtagtgtcatatggccttcatttttttctctctctccaatgactatctctaaaacataggcttcttcattctcaggacaggatctctcaagtggaggccgctggcagctccaggcttatgtctttctagtttaacaacccagagagattgccttaatctcgagctctggcaaaaggtcatagttgggctctagtagccagcatgggtcacaagcccatccctgagttcgtcacaatgactagcaacccatgggctttgatttagcaagcctacatcacaagcccaccccggaaccagcagtgggtccaaagctacctgccgtgcatggaccaaaagtgcagaaaggcagttccttaaaggaaaattagggtgctgttaccggatgaaggaagtttggatggtgggagggcaagagctgtacctggaatcctaacttttgcatggaaagagaagaaacagaaggacccaaagtttgttctgagcccacagtgacagataacaaaggatgcactcactcactaaaggatgcactatctcagtcatacacacacccttccatgacattgggggatggtcactagtaacaaaagtaggggcctagagctgccatctgagctgctcacctgtcctcaggtaagcaagtactgatactgcccccaaagaaaactaactctccctttcattgaaagttatcaggtagataataccatgaatcctctttacagaacatctgaagaaatgcctagtccctcacctgaattcttttttgtttgattttgagacagaatctcgctctgtcacccaggcaggagtgcagtggtgcgatctcctctcacggcaacctccgcctcccacgttcaagcgattctctgtctcagcctcctgagtagctgggattacaggcaccggccaccaggcctggctaatttttgtattctttttgtagagatggggtttcaccatgttggccaggctggtctcaaactcctggcctcaagtgatccacctacctcggcctcccaaagtgctgtgattacaggcgtgagccaccgtgcctggccacctgaattcttttgagctgttctttgttatcctgcccttaggaacaacaaaaaataaaaggcaaagaatggtagatttttaccatatgtaaccatcattatctttggtcatgttatagtatgatttgtttacaatatactgctggatttgtttggctaacattttatttaggatttttgtcattaatgtctataaagtagaatgacctgccacatttcttttttaatattactcttactagttttggtgtccacatataagcttgatagagtgagatattgttccttttctattctctggaaagttagaatggtctaaccttaggtcattcatggaaattttattcaaattcaattcatggaaagtttatttgaatttgcctataagatcattgagatttggtatttttgtgtgtgtgagtgggaagatttttagctactgatatgatttcttttttttttttttttttttttttgagatggagtcttgctctgtcgcccaggctggagtgcagtggcgtgatatcggctcactgcaacctccgcctcccgggttcatgccattctcctgcctcagcctcctgagtagctgggactacaggtgcccaccaccacgcctgggctaatttttttgtatttttaatagagacggggtttcaccatattagccaggatagtctcgatctcctgacctcgtgatccacccgccttggcctcccaaagtgctgggattacaggcgtgagccaccgtgcttggccgctacgatataatttcttaaagttaggggactgtttgcactttctgtttcttcttaagtcagttttacatagttacctttttctaagaacttgtctacttaataagtttttagcttcatttgcataagctttttcttaccattctttgtgttatctatttgatctttgctgactttgtagttctgttgtattttcattcccaatattgtgctaactcttttttttttattattttttatttttttagacagaaacttgctctgttgcccaggctggagtgcagtggtgcgatcttggctcactgcaacctccactccctgggttcaagtgattctcctgcctcagcctcctaagtagctgggattacaggtgctcgccaccacacccagctaatttttgaatttttagtagagatggggtttcaccatgttggtcaggctggtcttaaactcctgacctcagatgatctgcctgcctcagcctcccaaagtgctgggattacaggtgtgagtcactgcacccagccttgtgttaattctttaattaaaaaacaaaaaacaaaacaaaacaaaacaaaacaaaaaaaaaaaccacacagatattgccagagtcatatcagtttgctgttttcaaaaagaaatattttgctttgttgctctccccgatctctttcttttccttttgcttttatttcatcaattcctgttttttattcttttctttctatgttttggatttgtttctgtttaaatttttttctttttttattttttcgagagtctcattctgttgcctaggctgtatgcagtggcatgatcatggttcactgcagctttgatctcctgggcctcaagtatctgggaccacaggtatgtactatactgcccagctaatatttgttgttttttttttttttttttttttgagacagagtctcactctgtcgcccaggctggagtgcagtggcatgatctcggctcactgcaagctccgcctcctgggttcatgccattctcctgcctcagcctcctgagtagctgggactacaggcgcctgccaccacgctcggctaaatttttttgtatttttgtagagacagggtttcactgtgttagccaggatggtctcgatctcctgacctcgtgatctgcctgcctcggcctcccaaagtgctgggattacaggcatgagctactgcgcccagctaatatttgtattttatgtagaggcagggcctcgccatgtttctcaggctggtctcgaactcttgagctcaagtgatctgcctgccttggcctcccaaagtgctaggattacagatatgagcaactgtgcatggccccttttctaatttcttaagctggttgcttagctcattaactgtaagcctttcttctttcattaagtcagcacttaagactacatattttttggtgtgacctataagtttggatgtatggtatttattgctattaagttgtaagaatttttaattttccctgtaatcacttcttgttatccatgatttatttagtggtgagtttctgaatgttacacatttatggggatttaaattatctttttgttattgatttataacttaattgcgttgtcatcaggacatagggtcttcatgatttattcactttggtatccacaatgcctagcacaatgccaagaatgtagatgtcatttagtaagtatttgctgatataattgaatgatagttgagtgaacatctattgaccaggcgttagaagaattatctctgctcaaattgtccaatccttccagctacttgatattccaaaataactccacaaatgggcactggaaatataatggcccctcaaaattgtcttctatgctgctcactcctttcctcctttggcctggaaaacaggcactgagtgggtgagtgagaggatagtaaaactggcagtgtgagaccatcacacccagtctcatacataatagatttaggtaacggttctccctcttatttcttatatgacccagagaaatgcatttcttctttaatagtaataggctctattaatacattttaggtggcatttcctctagtggaatctcttatctcattgaatcctccaaaatattcaggcatgatattcccattttaaaaatggggaaatggacataaagctagttagtggaggggctggttgggttcgtgatgtgtattttttgttctgtacacgaaccatctccacctcatttttatcacttataatgacagggtagtaacaccttagacttccctaagggaatagaggtagataaaaacttgtgattgaattatacttgtaaaagggcgtttgaagacaaataatgaaaaatacgaatccattctgcactactcaatatggagtacatattgagttaatacacattggttaatacatattggttaaatgaatgaatggatgaatggatggatgagtgaacagctcttattttgatgagtacattttctgctttttggatcaacaacctctttagcatattaaagaagaaaagtgtctcagtcttttcctgagcccctaagaactgctttttttttttttttttgagtcagagtctcactctgtcacccaggctggagtgcaatggtacaaacatggctcatggcagcctcgatttcccgggctcaagcgatcctccaaccttagcctcccgagtagctgggaccacgggtgcacaccactatgcccagctaatttttttcttttctttgagatatcgtctagctctgtcacccaggctggagtgcagtggcacaatctcgactcactgcaacctccgcctcctgggttcaattgattctcctgcctcagcctcccaagtagctgagattacaggtgtgtgccaccacgcctggctaatttttgtatttttagtagatacagggtttcaccacgttggccaggctggtcttgaactcctgacctcaagtgatctgcccacctcggtctcccataaatgctaggattacaggtgtgggccaccacgtcctgcccagctaatttttctattttttattttttgtagagacagggtctcgctatgttgctcaggctggtctctaactcctggcctcacgtgatcctcacaccttaaccttccaaagtgttgggattacaggcatgagtcaccatacccagccccgaagggccttttgaagatgcctacttaaaaagtcttgaaagaggtccaaagggaaatgttagaacttccttattttagagcaaatctcaggaaatatggcagtgtttatacattataacatttagatagtacaacaacatttataacaatgtttgtgcattaaactaatatgtatacaatgtaacaatgatgcacagtgtaatattcatatgacatgagacaaactggaaaataaataattgtgctcctaaatgctttttaaagtaacatcagatgaggaggtcttccgctttcaggttaccctcttagcaagttttcttcctacttgctaataggtctacaaggtcatgccctcattttgtgtgccgaggcacagcgtgggcatctcccagccgttttttttttttttccgtcttttccttttgcatcctccagagggcctccttagccctgcagaggtaagaggtttaggcagtgagtagtgagggcagggagctcaactgggccccagagcatttggattcaccaacctttccagatagaagagacctcagaggccttattttctcaaacgagctgagaaagacttgctggaaggccactgcggagctagtggaaggttccggactagaacctgactttcagttccttctttattttttcttttaggaggtgggctccccgccctcacactcccttctcttcctcttcttcctcctcctacttcttgagatgaagctattgccagtcttgactgagggccaattctgtgcctggtactgtgtaaagagctttagttatgtgtgattctcacaaaaccccatgaattaactaccatcattatcaactcctttcacaaacgaggaaacgaaggtttttaggggcaagtaaacaaccaaccaaaaaacttgtttaaaattacaaagctggccaggcgtggtggctcacgcctgtaatcccagcactttgggaggctgaggtgggcggatcactggaggtctggagtttgtgaccagcctggccaacctggtgaaaagcccgtctctactaaaaatacaaaaattagctgggcatggtggcatgcacctgtattctcagccacttgggaagctgaggcgggagaatcacttgaacccaggaggtggaggttgcagtgagctgagatcgtgccgctgcactccagcctgggtgacagagtgagactctgtattaaaaaaaaaaaaaattacaaagctaaaaaaatgagggcagcagaatttgaaccagatccgaccccaaagctggtgttcccacttgcctgtgttgtcctttgaatcgagttactagaggctcaagatgcccacgtcatagtccagacctctttgttcctgcttctttccttccctgcctccccttctctaccttcatctttctccccgccatccctgtctccccagcactctaccctgattccgtgatgcttgaattttaattcctctgtggagatggggttacagaagagatgtgggctgttggggtggagttaagtttctcaggagcacaggatggctgctggacttttctttatggggttttgtttttgatcacagatcgattatttctttcagtgggaacagtttatagaacttagaatgcaatcaatgaagaaatatgttttgatttacagatattcacttttttattgtagtaaaaatgcgtaacaagaaatgtattatcttgaccgttttcaagtgcacagcgcggtagtgtgaagtgtatttacattgttgtgccgcagaactttttcatcttgccaaacaaaaactccgtatctattaagcaactttctctctttccccttctctctagcccgtgataaccaccattctactttctgtttctatgaatttgacctctttaaatatatcatataagtggactcatacagtatttgtctttttgtgagtggcgtgtttcacttagcatactgtccccaagcttcattcatgttgtagcacgtgttagagtttccttcctttttaaggctgaacaatattccctcatgtgaatgtaccacattttgggtattcattcaacggctaatagacatttgggttgcttccacctcctggctattgtgaataatgctgctatgaacataggtgtataggtatcacttcaagatcctgcttacaattattttgtacgtatatccagaagtaatattgctggatcatgtggtaattttgtatttaatttttggagaaccaccatacagttttccatagtggctacccaattttacattcccacaagtgttcagtttctccacgtcctcaccaacacgtttttttctattttttgttgttgttttttgtttttaattgttgttttaaatcatatcagctgtcttagtccctttggtgttgctataactgaacaccacagaccaggtaatttataaagaatagaggcctatttagctcatggttctggaggctgagaggtcctaatgcatggtgccagcatctggtgggccttctggctgtgtcataacacggtggaaggcatcatgtggccagaaagcaagagtgtgaatatcagctcgggtctgtctttgtcttcttagaaagccaccaattccatcatgggggccccatcctgatgactttatctaattttatttacctcccaaaagctccagctgtaatcgacctaagaattttagttgcatttcccacacttttaatactgtcacagtggcaactgaatttcagtacatgaactttgagggacacattcaaaccatagcagtagtcatcctaacagttatgaggtgagtgactgggttttaaattaatattctgtattaggcactgtgcttggagtaggggctacaaagataaagtgtgtttcctgccctcgcatcactcacagtcttatggctaggctagtgtttctgcgggtgtgaacacttgtgctagcatcagcttgatgttggtaaaagtactgattcctggccgggcgcggtggctcacacctgtaatcccagcactttgggaggccgaggcaggcggatcacgaggtcaggagattgagaccatcctggctaacacggtgaaaccccatctctactaaaaatacaaaaaattagccgggcgtggtggtgggcacctgtagtcccagctactcgggaggctgaggcaggagaatggcgtgaacccgggaggtgaagcttgcggtgagccgagattgcgccacttcactccagcctgagcgacgagtgagactccatctcaaaaaaaataattaattaattaaaaaaaaaagtactgattcccaggactctttctagacctcctgaatcaagagctctatatttttagaacaagcctccaaagacactcttatgtacaccattgggctaggtcagtagttctcaatttggctgtacattcaaatcaatttctgggttcctcccaggggttctgatttaactgggttgggatgggctcctatgttttagaacttcccaggtgattcaaatgtacagtcaaggcacatttggcgaaacactggactaggtgatttctaaattctttccagatgtaaaattctgcccccagcagcatttttttagttcagcaaatatttattgacttgtctcctcctttcagggctctgggtcagccagggtgtgagggtcaagaaaagactgggctcaaataggcggccttgagttcgtatcctgactcattcatgctgactaccaggataacctttgagaagtccccaaaccaagagagggtgatagaagcctaatgaagaaagtctctgtagaagatgagagaggttcactgtgccaaatgctgctaagaaggggtgaaggatgaagactgggaatgagaaaggattgttggatttgtcattgaggaggccattggtgactttgatgagagaggctttaatggaataaaagagaaggaagcctgattggagtcaagaacgggaggtgtgcaggcagagcagtgacaatagacagcaacttctgggaagtctgtggcagaggagtgcagagaagtgtgaagtacattgcgtcagttgttttttattagaatttcctccactactgctaacactgattggaaaagcatttattaagaacccaattgagcaggcacttatgagcagactcttgacgcaaccctttagtgtcagtgaatatattttggggagcttactttattatggcatttgggttttttggtttttttttaatatgagagtcaaattgttctgattgaagctaactcagagacattattaaagcataaaacttattgccagtttttttgctgaactacaaggggctaggactagtgtgtggggggcatctcactggagaaaacatttcctaagactgagaaccagtaccagttcccacatgcaggagaggatggctgtgtttttactccttcttttctctctacttttccttcttcatccatctcttttcttttattttcctctttacgatccattccgcctccattatcctcctcgttctcttttgcttcctttgcttggcacacgatgcctttatagatgggctcccatctcatcctccacccccagcccagctctcactgtgcactcctacgtgttttaactgctccagtgaagctccccccggctctctgactgtacagtgcctctcatgtctctgtgctcttgcacgtgctgttccctaccttcttcttttggcgaactcctactcatttgtattagggtactcactaagccactgtaacaaagagaccttgaaaacgctggtttagataggagagaattttatttctctctcatgctgcagtccagaggcaggtggtttcgggctggtagggaggctcaatgtgtagttttcagctctggttccaaaatggctgctctggctcttaccatcacatctgcatcccaactagaaggaggagagaagggacaaggggactatgcaccaattctgtttaaaggcatgacccggacattgcacatattacatttacttatatctcactggccagaacttagtcacatagccacacttcactgtgagagaggcttaaaaatgcagtctttggttgggagaatagatattggcagatgatagtctctgctgcaggatccttctagatccatgtggtgtcttctactccaggaaggctgtttcacctgggagtgcccccattcttctctccagcatgacattcaccatcctgagttgggattacctcgtcccttgtctgttttcaactagactgtaaacagacagggcctgtgtgtcatttatctttgaatccctagtaccgataccagtgttgccgcactggtatagcataaatgactcctgagcagaggcattgggggcagtgggactcgggcactgtgcctttatggtgggagggagggcaagggtggtctggcaggtcagccagctggttggccccacatgtagctccctcgcctccctgccttcctcactggagacatccaggaagctgctggtgcccatagagggttggctgggaaagggcagccccattcctcagccaggtaaacatgcaatcctgaaaagtgtttaatccaaatatttattttaggttcatgtcattgtatctcttaccaagtccaaagggtgatggggagcagggtgtggctgtttcagccctgcactgtttgtgggtgtgacccgcacttctagactcccagggcatgtggccacccctcaactgggaggtggtatgtttcagggctctttctctcttgctccctctccctcacctctatggtcccagcaggctttagcctcttcccctcgtttcctgggcttccagttcctgttgggtcgtagcctccacactattttctgctactctggggtcgtctcctagagatgaggagcaggaagctttggaccctactggggtagaagcatggggagagggcaggggattggcagagtgggttggtctgtgaccaaaaagttcatattctcagtcgggcatggtcatgcctataatcccagcactttgggaggctgaggcaggcagatcacctgaggttgggagttcgagaccagcctggtcaacatggcaaaaccctgtctctactgaaaatacaaaaattagctgggtgtggtggcacatgcctgtaatcccatccattcgggaggctgaggcacaagaatcgcttgacccgggaggcagaggttgcagtgagccaagatggcaccactgcactccagtctgggtgacaaagcgagactttgtgtgaaaaaacaaacaaacaaacaaacaactcggccaggtgtggtggctcacacctgtaatcctagcactttgggaggtcgaggcgggcagatcacaagatcagaagatcgagaccatcctggccaacatggtgaaaccccatctctactaaaaatacaaaaattagctgggcatggcggcatgtgcctgtaattccagctactcgggaggctgaggcaggagaatcgcttgaacccaggaggtggaggttgcagtgagccgagatcacaccactgcactccagcctggcgacagagttaggctccatctaaaaaaaaaaaaaaaaaagctcatattcttagttacctaccggcctgtttctcgtaacttgttattgtgaaagagccagctggcacttctgcaccttgtcctaggaggttttgggctccagaaatgtgtgtatgtgaggggccccttcccctaggtcatcgtcagtgtctagacctgttctcacctgttagcagcttcatgacacaccctgttgtgtgttcccagccctctgcagcgccctcacatgcttgtttgtgtgccacatctgccctcctctcttgcctgcaagctctaggggggcaggtgataggagttccattttagacataaggaggctgccatgcagaaggtcactgatgtgtaccagatcaccctggtgagttgtgatgggatcggaagtggtggcagggtcttctcactgcaggcatgggaagggtgcacgtgcgtatttcatgatcatgctctgagagtgacccagctgggaatgtttgctgctgctgatggactgattgagtccaagggctgaatttgcacacctgggtattctcacggccagcttgaaaaatagatttcctgggtatcccctgagaagtcctgttgatgtcaattttcaggccaggaaggtgtatcttttcccttctatgatgctcctccctcctatgattgttgagaataaagttctttcccatctgggatgtcaagctgtcccgggaggaaagaggaaacatcacttactccatcaggccaagcactttgctatggactgaacatttgtatccccccaaatccatatgttgaagcccattatccacaatgtgacgttattacaaggtgggtcctttgggaggtgactgcgtttggatgaggtcacaggggtggagcccccacgttgggactggtgccctgataaggggatgaagaaccctgagctttctctccgccctgtgagggctcccaccagaacctgactgtgctgcttacctgaccctggacttccagcctcgagaactgggagaaataaaagcctcgtgtttaagccacatagtctatagcgttcttgtcagagcagccccacaggactaagacacgcatagtatgttagaacttctggaagttgaggctgctttcaaatcagccctgggccattgctagggtgggactaggcctccaggcactgtgagcctcagcctgaggctctgtgggatttggaattgtcagccaatgtccactagatattcttcatcctctgggaatgagagacgggccacaataaggtagatggtggacttgtctcttccgatgtgtctggtggcttaactgaatttccctcttgctttcggaagagtcttagagtcaagtatcttcatttccagtataattcgctttaatactctctagtatgccaggcactgtgtggggtgcttaagctatgattgtgaataaggcccttttcctgctttcaagaaactggaggttccgatgcacgtggctaagtatattgtaggaagtgaactgctataaaactagacgtgctttgcccatatgtgagtaggaaagtaggcttaactctcagtgttgccaaagtataaagcgcatgccttgagggttctagggaggaaatgtaaacttgccatttttgtgttttgaggtggttctggaggtttaatatttagtgtactttcaccagggagggattggagctgccagacaactgatgaggttattacaatcatttagagaaaagacagtggggacctggagtctttggggtaggggatgtaaggaaagtaggaaatttgcaagattttcagaagaactgcctggccatggcaattgtatgagagtgggacgtgaagggaagatttaaggatgactgtggtctctagcctgggccactggaaaacggtggcactgttaaccgagacagggctctgggaatggagcgctggtgtggggagcaggtgggaggggcaaggagttcacagactatgatacaggtcaggatgggtgaggaataggctcagagggaatgagaagaaggagccctcggggagatggggagattacaggagtcaggatccacagcatgtagaaactatgttcatgagtactcagttaaaaaagggatgctctgtgttggaggaagtatgttgtcctttctcctcactgggatcttttgtactttttgttatctctttatgggtagtcagggaattgagttcataggaaatcaaaaccccaccagtgatcaagggaggagaaccttctggaagcacacaatgccctggccaaggcattgcagccataggcacccaactactacagggtggagttaaagaaaggctctgtccgtacaccagaaaagcattctgttttggctagactgtgctagagtctttaataagactccaaaaataacaactctgttataaccagcaggctttatcttagagagagaagaatccagttaagaatcgctgcttgatttttttccccattaaaaaaaaatagtttcaacttttatttgagatacaggggtacatgtgcaggtttgttgcctaggtattttgtgtgatgctgaggtttgaggtatgatggatcccattacccaggtactgagcatagttcccagtagttagttttttgacccatgcctccctcccttcctcctctagtagtccccaatgtctattgtggccatcttcatgctcagttcccacttataagtgaacatgctgcttgatttttgaaaacttaaattccctcttagactctcttaaatattgcagttacttatgcaccaacctaatagtttctgaaactctgagcaggctgcatggatacagaaccaaatcccacttggaacagtctagcaccttgttactcaaagtgtggtccctaagccagcagcattggcctcatgtgggagctagttaggattgtagaacccaatgaattagaatctacattttaacaagatccccactgagtcatacgcatattaaagtttgagaagtattgatttggcacagtggattttagatacagttttgcattggattcatttaggtaaaatgtgtcattaaaataacacagctttccaagcctcagccctggaaattctgatttagtcaggcaattctcttgggtaaccaggtttggaaactactggcttctaaagattccaaaatttctgtcgatagacaaatggcaaaaattttagtaaatggaaatctagtttgaactccacgtctgtttgctttacattcatgataatggccaaagcctcatggctttttgaaaaaaaaaaaaaaacaaaaacaaacaaacaaaaaaacccatgtctagattgacattagacatgacttgtccccttcctctcaggacatcttgatgcatgatgctcaagaggacatgtgtttcccctggccccgtggcagggaccatacactggcaaaagttgaatgggcttggccaattcactgcccagtttgaaagcaactaaagtcagctgatgtttaccaagtgctctggggatgaaagtaattacccaagaaccaaacaatgtgatctccattagttgcatagtttgtctctgtagaagatcatagcttgaaggggcctttcagaactctcctccagctctcgctttagggatagagaaagagaatccatggagaggttgggacctggattccagctggtttcattcaagagggaaggatattttgttgtttggaaaatggatcacatatttgttgcctaatcagaggcgcaaaatgaacaaactttgtattccatgcttaatctcaagtgctggggaaagtgctgtaaacacagaaagatctggctcctagagattggccaggaccgtaagacacatggagtgcagatgccctaggaattcgacagcgagttctccaacgctgagatctttaattaaacaggtgtttgggaagtaggtcctgtgtagcttccagccttggctgggctcgtcttgctgaaaaatggcaccgacccagcccagcagcaggcctgaaactggcttcacttggaggtgtaggaatgtgccattgttgttttcttctttcttatcaagccccattagcttgagcaaggaaggaacaaaaatgggctgggaaaacatgttatttcactgggtaaaaatttactaccaaggaaatgatttttgccatatccaaaaaaggaagagtggaggccttggaaaggtgtgtcttccaagggctcttggaaagcttctcccagtgtcacccagtgagaatgtttccctttggctgatggccgttctcacacaagaactgagatattcagccgacgttaggtacacaggctcacaaagtcagaccttgcctgttcacagtattggagcaaagaaggcatgggaagaggcaagaatcagattgtgaaaaggttgatcatacatggccattaggcacacgtacctttatgcttttggatgcctacaattatagaatcatagatgggcccagagatgcctgggtgcagaggtggagatggagactccatgaaggaatgtaccctggctttccttacctcttgtccagatctcccgccatatgcctggggctcaagggggagaagtccctggctttggctgtagttgaatcacagaactaaccatgcttatagcccatgaaacccctgggctgtcatcctggtgtctttagtgaattctagaacagcatctgcaggaggcagagaccaaccttcttctatcttccacagctgtcagaaacagcacctccccggggaagggagctatgtgccaggcagtcaggctggcacctgtgctcctgttaattcatgaactctcacatctacctacgaggcaggctacatcagccctgttgcagaacacccaaggatccagtaaattgccctgccttatttagttaccaaatgtgggagcctggattcacacccagctctgtctgctcccaaagttcttattctttaacctgctagtcttttctggggagttctcagccctttggtgtatttttcttttaaactttggtgcttggagaatgacctagaaaatgttctccctatgggcatggggaaccattagtgttttgttttgttttgtacagtttttaaaggacattttatttctgttagaatttgtgttatgaaaacaaagtattttcaactttcaggaataaatgctgaactgtaaatacatatatgtatataatatgtgcattcaaatataacacatagctatcatacatatgcatgttatttatatttgaacatatttatgcatatttaatgtgatatattaagtctgttataactgcctatagagattttatttaataatctgtgagttaatactaagatcatacttggaaccattacttttatatgggatagaaaagtgggttgtgtgatgttttctgagaaccagcccactcccaaggggaggacataaaatgggcataaatcaacaatgtaatacccacgaagctgtctgagaactccatacagtgaaggagaggagtgccaatcaccactggcttcctctgcagagtcctgctccaaggactggaacggtcagcagatgtgtgggctgtggccctttcctgtgctgtccgtgagtcacaatggaaggttctgttcattttgttgtccccgagattgttggacagttgtattttgatgtgttgaggccagtttcttcatctggtgcctttgtaagatcttttctgtacttgaaggacattcttttactcctttaaaacacaccagcctgagggacatccctttattccccttgtctttgcatatctgcccacgtaaagcttactgtctggctggggaatgtgagacatagctaagggtatgaaatcctaaaagagtttcccaaatatgtaggccactgtcctggggcctgaaagccctttctgtctatggcctccttggaaggcatcgaggaggtgatattgatgggttttgatgactttcctaagtgagcagttgtttcagattgagaaggccactctgtggatgtctcaagggagaggtgccagtgcaggtgagactgcaaggtcaccagagctgtgctgcttgatgcagatgacgacttcttcctggcaggggcagtgctgggcttttccaggttctgggagagctggtgagcgctttcctccagttgccagggtgctggtcatctgggcagcagatagtcactgcctcacctgtggggagccaagctatggttgctgtggcagaatcctccaagtgcccaggcacccgactggtgtgacagcagccaggagggagcagggagatgagagaactcccagtaaagtctgcttctgggtaccatacagcgggagggaatatgcttgatgccagctcttccaaaggtcatggaggctggggaggacacacacacacacacacacgaacacacagccgctgtagagcataaagaatgaatgaatgggggccgggcacggtggcttatgcctgtagtcccagcactttgggaggccgatgcgggcagatcacgaggtcaggagatagagaccatcctggctaacatggtgaaaccccatctctactaaaaatacaaaaaaattagccgggcgtggtggtgggcacctgtagtcccagctactcgggaggctgaggcagaagagtggtgtgaacccgggaggcagagcttgcagtgagctgagattgcgccactgcagtccagcctgggcgacagagcgagattccatcgcaaaaaaaaaaaaaaaaaaaaaaagaatgaatgaatgaatgagtgagcaagtgaatgaataaaggattgaatgcacccagcattcttttctcttaggggactcttcctgactattgcacaggaaaagaaagcagaccctgtttgcccatgaggatactgacccttgctcaggttgtcatagcttgtacttttccactgatgcggaaagggaggccctgccaaagaatgtccttggagtgattcaatgtatttttccttctgtgatttaagtcaaatgtatttaatgtaagaagttccgctgtgagctggaatgtgtgatgagtctttcagcctccccccgaggaagcccaccgtgtgaacacttccagttttagctccatcaggtgtgtaagctgacagtggttggcgtggtggtggctgtttttaaagtacacacacccaaatgggcttgtcagctagttggctggaaaaacctttctgggggctgcgagggattgatgtttgccgttcatgtgttcattcattcaatagttcttgaacattaccagggacacagcattacaccaggtgtgttttcaggctataaaggtgagagattccgccccccccgccaaaaaaaacttcagggacttattgacgtctcaaaatatagtttctattgacaattcattaaacaagttagtgaaagttaaaattttaattttaaaatctgtattttaaacaaaacaaatacaaaagtgtcgtataactgagttaattcttttattttttgagatggggtcttgctgtgttgcctaggctagaggtcagtggtgcagtcttggctcaccataggctcaacttcctgggctcaggtgatcctcccacctcagcttcctgagtagctgggactacaggtatgcgccaccacacccgattaattttttgtatttttagtagaaacagggttttgccatgttgcccaggctggtctcaaactcctggactcaagcaatcttacccaccttggcctcccaacgtgctgggattacaggcatgagccactgcgcctggctgagttaattctttagttcagtaaaagtgctggagtttttaaaagagtgaacttcaaggattttgatcttcggcctgaatacttcgcacacatgcccacgatggggccctttgtgcccttctgagtccagcctggcctgctggcatgcgtctggtttctctctgtaggacttggcaggcacagttgtgtgggatgcaaattacgcaagcacagaggcttgggaacttgctgccaccaagcctctccagtgattcttctcctgtgttggtcaccctcacccttcattcccctcaaggcaggaaaaagaacagaaattcctaaggcagtgttgttcccagcacacaattgccatccatcactccctgctgggaaaatgtaaatacgcaccagccgatagtggcactatttattgtcatagacttcactgtggatttgagcaggagcagcttctggccaagcattattcaccagctcccctgggaggctgtgctcggtgggcagagctgcatggaagggaggcaaaggggaggctggagtccttgcagctgagaacagggctgggtctttgccactgaggctgcacatgcttaacatcagggtggagtggaggctgccgtcatcttggcactaggttcttggaggtcgttcatgtttagaggagggaaagccacttccataggattcccagacagctgtcattttggggtagggtggggactgatcagcgttgttagtgttgggctgttgcaggtggatggtggatttgtagccatatcacctgaagccgagggaccactgctcacccagttgaacgttttactgaagctcacaaagccctatgctacacaaggcccttgccctcaaggagcttgcacttttgggtcttagacacccccatccccaccgtacgtattcaaagaagccaactgaatggatgatgatcaagtctgcaatctgcagtgtcaggaggcagacagcgtgggagtggggtcagtaaaaagcaacaaaagctcagccctccctcagcccagtctgccagctcccccctgaatctgcttggtcctgggtggcatgacctctgttagacctgcacggagtagacttagagtcaggcaggcagggaggcctggactcagctcttggcttggtgcttactagctctttccactcagttttcccatctgtaaaatggggattgtgagcccacctcacagggtgatgtgagagtaaatacaagtaacaaggtaggtgtcaggcacataacacaggctcagtgaattgcagctttcagtattacttccgactgcacttcaccattcggtgaaggtggagaaaaggtgtagatgagcaaaccctgatgcaggaatgaagaggggagggaaggtgacccaccaaggtgcaggtgaaggcagggctgacaaggagaaaaggttttggggtcctctggaccaggcagatccaggaggcaccgtggatccttgtggagtaaattaatgtgtgaatatttaatgaaaagtctcttcctttaggtcaaagtgagagtgtggcatcgggaggtccatttcaggatcttgggcgctctcccctaaagtgcagtgcaggggagaaaggggaggaggatgtttcagtttcaacaaacagttttgagcactgactgtccacaccagatggcttgggaatggccatgaatatggctcgatatctgtgctctgaagctctaagttaagaagggaccgaggtggatgcaagtatcttcatgccaccagacagatggcagtgggctctagagcagcatagagagacttgctgtgagcagaggacagacagagattagccccaggaactatggagtggagcgaagactggagagcttcagaccgaaagattttcacgggtgaataccattaagcaactggactgccagcttctgttggcagggaactttttttttttttttttttttttttgagacagggtctcactctgtctcccaggttggagtgaagtcgtgcgatctcggctcactgcagcctccacctcctgggctcaaacgatcctcccagctcagtctcctgagtagctgggactacaggcgcatgccaccaggcccggctaatttttaatttttagtagagacggggtttcaccatgttgcctgagctcgtcttgaactcctgagctcagatgatccacccatctcagcctcccaaagtgctgggattacaggcgtgagccaccatgcccagctggggacatttcctttacttctgttttgttctcagtggtgtttatcatagtcctgtgcacacagtaggtacgcagcagacccctgtttaacatatgaatgaacaagcctaatacaaaatggctttctaaatcaagtaatggttattgtcaaggtaatgcaccttcaaagagcaatggcataggatggcagaaggattcctgaggataagggttcccttcttggccatttccctttgtggatttctggtgagcagactagctcagccttcagtagaggtcagtgtctcctagaggtgcccatcggggaagcactgccacctccttgggtgtaacctagtgaccttattaactgcctcccagccaagatgagccactggcacccctggtggctccagggctctagatggatgtgagtgacattctttggactatgtctgtattacagatgtggacgagtgtgcaacagattcccaccagtgcaaccccacccagatctgcatcaatactgaaggcgggtacacctgctcctgcaccgacggatattggcttctggaaggccagtgcttaggtaacagctctctgggggggtcacagggactcttggaagttaacggttgccaggggcattttgaggtatgggcatagctggctgcctgagggtagtaagcttttctttgctagggagggcgggaggggtggaaggctattgaactcacatgtgtaaccacccttgaaaatcaattgccatcatcgccatcttgtcatcattatagtttttgaatgtatttatttatttttgagacatagtcttactgtcccccaggctggagtgcaatggcgcaatttcggctcaccgcaacctccgcctcctgggtttgagtgattctcctgcctcagcctcccgagtagctaggatcataggcatgtgccaccacgcccagataatttttgtattttttgtacaaatggggcttttgccatgttggccaggctggtcttgaactcctgggctcaagtcatctgcccgcctcaaaagtgctgagattacaggtgtgagccaccacgcacggccttgaatggtttttttcggtttttttttttttttttttttttttgatatggtgtctccctctgttgcccaggctggagtgcagtggcacgatcttgactcattgcaatctctacctcctgggttcaagtgattctcctgcctcagcctcctgagtgagtagctggcgttacagtcatgtgccaccatgcccagctaatatttgtattttttgtagaaacggggttttgccatgttggccaggctggtctcgaactcctgggctaaagtgatctgcctgcctcagcctcccaaagtgctgagattacaggtgtgagccaccatgcccagcctcaaatatattttttaagggctatggttttggatgtattttttaagtttgattttaccttgactttcttcctgtcttcacgaagtttatatccaggccaggaagtgacagaggtgaggatgattttgctttagttagaaataatgctaagagaagggaacactttcgcttagtcacagaaatgtggcaagtcttgaatgtggatcagtagatcctgatcttacatcagttcctttcaacaccctgtctttgcccttccccgccaccaaccaccacacccaccccaccggctatggccttccattttactcctgaggagtcagtcatcaccaattgagaactgcctttgcagttagcatctgctctctgatctttctgtttattttactggaaggttattttcctttcttcccctctagttttgggtttagccaagtgagtgaattcacagcaaactctagctgtcacttcaatttctaattctagggtgtgatttctatgctgtgttttctagaaaaggccctgccagtttaaattctctaagacaccattctgttgcctgaaagtcagtcctggaggagttgagaaacagatccaaacgaaatcatggaaacaaagaaaagctacctcttgccaagtttcttgattgaggctgagtaggtctgccctcaagccccgtccgaagcatccttgaggcctagattggcttgattctcctttccaggcttgcacatgggcgtctgtgaatatgacagtcactgtgcattcaaaccaacctctgctataatggaaaatttgatgctacttatttgaacataagcagatcagtgacagagagttatttgtacaggaacttaatatgtcgaatttcagagctggaaaggatgttgaatattatgtcatccaacttttatagcatcgcagactgagactcatagagaaagaacattttagacaaagtgagttgggtctaacttccaagtctcccgtgtctcagtctagtttttttttcccaccacaaggggcgctggagtggtagggggagaccgggctataccagccctgttacagaaaccctctgatgtgaggggtgccagcaactcggacattcctctacctgggagggttgttctcttcctgggagcatggagctgtggaaaggatgctcatggatgcctagcatggtaccatgtggcccagccactcatattcacatctgaaaggaagacgtcgcctaattatggctgaactcctgccctcccctggctaaactcacctttccctttcaaaatgcaagttccatagccacacactgtctgttctgtgtaccactgaagatgctgcttttgcagaaaaatgaggggtcaggggggctgccttttttccaaggtacccgtagtgaagggtaccctctccagcccctgctgcctgcctggccttggtgatgtgcccaactgcactctgggaagaagtcagggccagccactgtacagccaatgggccctctatgcaagagctgctctgcactcaggggcagtgcaatggccaggttagaagtagccgggacttagagacaaaacagaatcacaggacagggcacagaatctgagaagggctgaacaataggtaagggatcaagatggatctgggaggtggagtccttcctggcagtaggtagaaaccaggcacaaggactgaggctctaagccggcttccagagtcctggatggcccctggttccaaaggaacagggggaccagggaggaaacctggttagattgggggaggtggggataaggaccagttccagctacagtcagatcaactggtcacagcaggagcctgtattggtgccatctcagactctgccaggaggccggtgatttcattcactacccttaccccacaggaatgaattctccagcccattatcacatcagcttggggtgttgagaagtgctttcccaatgacatcaggctccccattgatggatacatattacagggaggtcacattgcccagctctgctcaaaggatccattcacccacagtgccgccgctttccctggcaaggccagctgtggcttggaagagatgtgtttatccagagttttatgttcactctggtgcaaggaggagattcagggtgaattccagtgccctcatgttactggattcatgggtctccagggtcatgctgcccagctcatcccagcctaactggctcttgttcctgacagctggacatattcattgttcatggagctggcaaggagcctattggagtgatgctatggattcttcttacgtgttaagaagaatcctgggcagtggagcctctatatggaatctttgagttgaatcttaacattggataaatcttaagagctgggtaatctcaaatcttagagctgggaaaaattggagagtccatcttggataaaccttagtgttgaatcttagagctgggtaaaattggagagctcattttgcccaacatcccaatcgaagcagaaatttcttctgcaacttttaggataggttcaggtatttatgggactgagatgggtcgaggaggggaaagattgtggggagattgagccttgtattcgagacagcatcaccatccgtgacactcagtaggcactgtcttggctcctgttcccatttgcttccgttcatgatcctgtttgggaagagcaaggcaatcatgccatgctagtgggggcatcattgagtgaggagacctgtctcactttgcttgcatttctgtttccagacattgatgaatgtcgctatggttactgccagcagctctgtgcgaatgttcctggatcctattcttgtacatgcaaccctggttttaccctcaatgaggatggaaggtcttgccaaggtatgtgacgtgcatgataacttggacatgatgtgagacactagctgcagccttcttcagcacctggcagcttatgtttgtgggaaatactgctgctacagtatattcccattccttgccactgcccgcccatccccattactacagaaacgtgagacctgaaccttgctatgcgaagcatctcaaaaagtgctctgaatatggctgagggtaggaccccaatcctccactggctgggagtgtacagtttcatggattcgcttcttttctgtgtctgctatccagaagtagccttgctggctttcttgcctaatcagaaatttggttgcatgtcctgtagcctaagttcagttcctgaggcctgaggagggttggtcagggtccctggccctccaagaatcataaaataaacacatccacgctaggcaggggtgtcgtgggcgattctgaggtctcttgctatacttttccctccaacctgtgccaggatggcctgttcctcagcaaagggtctggtggtggtggtaacatcccctgctactcagcgtgcccccacaaaaccagactgaaacaaaggcattttgtggttttcacatgatcatttgaaatactgataagtaagaaaaacaagttgcatgcctattgtggtttccatctgaaggtttcttctgctcaggaagtgaatgggggacttaagacccaaggaattagcgcaaatcctgctttggcccccgacttccccctcaaattccagctcccggcccaggcctccagcccctggcagctgcttggcccaggttggagttggaggcagtgctgcagacgcagaatgaggtctttgtctggagacctcaggctttgcagggcccatttccttgtttcattcacccttggagttctggctggcaggctcctggccattgagtttggaggctattaggtctcctttactttaattgtatctaaatcatcggtaaataggaaggcatcagtgttaaagagtttgaccctggattctttctaagtctctcctccaaagcttgttctgctaattgttccaagaattctggactgtgttcctcacgccaaaagaggtcattttcttctgagagtagacaccaggccaggaggttgaggaagcggataaacaagggcccttccttcccactggagcaggagggggcgcctggctcccttgctgctgtgataagcagcttagggcagatgcaggcttctctgtgccaaggcctgggattggaggtgccagccacaggctggcaccgtgcccccagtacctcctgaggcatagccatgcccaagccaaaaggtgcctgcgtctttcaggcctctgagggacaggtgtgtgacaaagagcagataatacacctggcagtgccaagtccacagcataataaagcagcaggcccggcacccaggcctgggtatgggcactcagccactgggatgctgcatcagcagggcccatgggcagcacagggcgtcgcatactccggtgagcttttgcaatcctgactcttcgtgtgtggaagagtgctgtacacgctagagcattgtcacgtctgttcatctcactgaacccaaataataaatagcctcgtgaggtcagcaggcaggtgtttgtggctctgcttcactgaggaaataaaggctcaaaaaggttaagcaacttggccaaagtcacacagccacgtggtagcagatctgagagtaaaaccaggggcccagacttcttgtccaacaggttggagtggggccctgtgtgccctcagcagattcagaagggcatttggaaagggctggcaggaaagggcagtgagaaccccaggggggcagaatcattttggtcgccctgctcttcagaagcagctgagagcggtgagggggtggaatgagttcattcacctccgagtggccagcgcctggccagaggctgaggccaccagccctaacacttgccggcactgtcctgtctgaacttgcactcagtggcttagcacagtggacattttcctaccccctcctgtccccggtggggaaaccccaacctcccacgggcactggtgggggccagtgtcttgctagaccctctctctacagctgttcatttatttgttttctccctgagagctccagagatgctaggaggcaggaactttgtggccatgggattagcctcccctgtaagaaaagcctctcagtctgctcaccgtgaaggcttttagctctgaaaacactgacatctcttttcagaggcctaagaggtttacatggacttgggaagaggatagaaaatctctcagttggaactttggccattggtgtatggagcattgtgggatggtgcttacaatgggtcaaccaatgccagtgggaaagaggctcttccctgccctccccgcacgatgagctgtgcagaatgaatcttggtttttgtggaaaaacccctgactcatgttccagttcccactgtgtgtccttgttagctggtggacttgggtacacctctcaatcttcaaaaacaattatatgtatatgtgtgtgtgtctgtgtgtgtgtgtatatatatatatatgtattttttttttttttttgagacagagtctagctctgtcaaccaggctggagtgcagtggcgtgatctcagctcactgcaacctctgcctctggggttcaagcgattcccttgtctcagcctcccaagtagctgtgattacaggcacctgttaccatgcctggctaatttttttgtatttttttagtagagacgggacttcaccatgttggtcaggctggtctcgaatgcctgatctcaggtaatccacctgccttggcctcccaaagtgctgggattgcaggtgtgagccactgcacccagcctataattttattttatttttttttgagacagggtctcactctgtcacccaggctggagtacagtagcatgatctcagctcactgcagcctcaatctcccaggctcaagtgattctccctcctcagcctcccgggtagctgggacctcaggcgtgtgccacatcacctggctaatttttaaattttttgaagagatggggtcccactatgttgcccaggttggtctcaaactcctgggctcaagcgatccacctgcctcagcctcccaaagtgctgggattacaggcatgagccactatgcctggtccttcaaaaatgcttaaacaatcttattgatgcatagtcagtgtataataaactgcaccatgattttattaattttgacatacgtgtacccgcatgaaaccaccaccaccacactcaagataatggatttcccattagtccttgtgtcccttggtggtcttctccttaacctacttaacctctaaagtgggccaatggtcctcgttgtaaggatcaagtgagtgcaggatccttccctaatgagcaaagttatttatgcataataaatatattattagaatcatcatggttatttgttaacctgaaacttccaagtcagtgagggtgaggggtgttcactgatggaatgcaaccggtgatggaaggagcaggtattgcctggaaattcctggttgggggggtgcgttggagcatagacttaccagcaggtgtatatgtgtatatgtttatatcatgtgtatacatatggtttccactttgcctgacttttgaccccagaagggacatgtggatggaggccccggtccttaagtgaacacttttggatctaagatcatgctcccaaaggtcctgggtggagagccttggtacctgggactctggtctcctggtggtggtagatttcgttgctggtgctttttctgcctagttattgtggctgttctgttgggaggacagtcagcaatgtgccttggctttccacagatgtgaacgagtgtgccaccgagaacccctgcgtgcaaacctgcgtcaacacctacggctctttcatctgccgctgtgacccaggatatgaacttgaggaagatggcgttcattgcagtggtaatgggctttcgcattggaaacttccacctgtacttggggcctgggcaggggttgaagggcaagggcttccttcataggtgtttcctctcatttcctggacacatgtccagtttgggacatcctccagggcagtggggtcagaatcacacagaacagagatgagtcacttcccaaaaggtgaggtggagtctcatcttccttgtcatctgacccttgatgcaaaaattaatggggctaccttctaggacagaggtggggttgaagagggagagcagtcacccgatttggcatgttggtttgagagctgtctgtcctcacccagcaccgactcaagtcttggggatatcacagaaagtacttacagagggcagtgacccaggaataatagcatgtcttatcgggtagggttggggggaacattgaatgaatgagaacatgtatggaagcacatatgttctgtgaacttctgaaatctctacaaataatcagtgcctcactccaggcctggcacccagggaacatgcaaaaaaaaatagttctcgaatcaatggataaatgattgaatgttgaatgaatgaaatcgtaataatttgttgtgagaacatagatatgatgggttagttgaccttttataaattccttccaagcccaaggaaataagattttctgcccacactagtttatggactctattataattttcttattaactccctctttttttcccctagaaagttaaattttttttcttagttagaaaaatattattggattgtaaactccttgagaatagggaccacctcttactcacatttatctctgtagcatcccacatagggccacacacaactccttttctttctttctctctctttccctttcttgccttgttttttgtaaaggttagattaaagtacactccatttcagccacttctggcatcatcagcagttgtgaatttgcaaagtctaaattaataatgcttcactgtgctttcaaaataagtgggccatacactagggcgtgaaaaatctttctgtcctgcagaatggaaagtttcctaatccgggttttattgtaacaggaactgacccaggtcatgaatggaacttgtgtgatagtctcactgacaactgaagtgttctggggacagcgtcccatgaaacagatgaacacctctccctagggccaggacagtcagagccacaagcaggaagttccagagagccttgggctgattaaatacaaggcccagaaacagaaataaaataccctcaggcatgaaaagccactttcttcctagatttcagttccctccgtggcactccttggggagttggggccaaggaactaagaagtgtggaaaatccaacattatgtggtgagatgatttgtttctccagaatcctccgttaatccacagacgtttattgccctactgcataggccatatggtagagtgaccctggaggacctgagttcaaattctagctctgccatttactatttttcttgaccaagtcactccctgagtctcagtttcatcctttattaaaaaaaatcaaccagccaaccaaccaaccaaccaaccaccctcatagagtggtcaaaaattaaataagttggcacggcccagagggtggcccagctccaggctggttccaggctggctggaagctgctgcttcccatgtcccagggaggatccaaggtaggcgggccactgagagacaaatattcctgcctaccccacaacactctggacttttctctttcaaggaggttttttttggacacagtggagttttagtcattacatgttaatttatcttccctaagtgtaggtgtaagagacttttggcttcttgagaagcttacatccttgccgatttggccaagattttcagttgactcattttgccccaaatggccaacttgtcctccatggtctccatgatgcacaccctcctgaagacttggtgtgaccccgggatatgtaggctttctagagcagactggcccaggataacagggtgatggagagagtctgtttctgcaccttcctacttaacccctttctgcacttctccatttccgcaggcactgttatcctcactgtgttatcacggctggggtggcctctccgtgtagccccagacccctcctagccttgtctctcagggatttgctaagctgagctgttcctggaaaccatggtgggttctcatgtggaggagtgaaagtggcctaatacatgctccctgccagaaactgggcttgtatttcagctttccactggagggtggagccacagccctaagcaaagtctgggaattgcagacccaaagataaaccgagtagggtctgttacagcccctccctgcccagtgggagttgggagtaggtgctacgctctccatctgccctggagctaaccctgcttgggtgcttgccccaacctcagggctccccagctccgctgatccctcagcacagttactcagggagacgttacagtgtcgtgtttctaagtgtaggatctagaggctgggttcaagtcccagctttcctccttactggttatctgtgaacttggtcaagtcagctaacctctgtaagtctcagtttttcttctgtaaaatatggagagtgatagcacctccttcatggggttgaggtgagaattaaataagaggaggcatgtaaagcatttaacccactgcttggcatatagggagcctcaggaattgacagacatcactactactctactgaaagtatgagtggaatctacaaacttggaaataaaataggacactcagttatgatgggctggagccagagacccggggctctacaaggcttctaggggaggcggggaggcacaaccaaatcagatattacctgagcacacgtgacttttcaaatcagcatcctaattctgctggctgataacccatcacctgaggacccctgagagagacaggaaggagtttttccttctgggatgtgagaggcacaaggcgtgtaacacccggaattatctgatggtggagaggcagcttcttttgcgttgacaccctctctgggtgactccagccaccagtggtctgtgagtgagagagtaatccgaggacatgtcacatggggaaactagtgaaagcaagtttttgggaaacaacaaatgcaagaacaacatgttttctttggcatgcttatcgaatgaggctcaaacaggggctctgttgccaaactctgtgtgtgatgaagagttggcttttctggaacgtctgcttctgcgtctgcatcaaccgccatagcccatgcggatgagttgtaaatcacatggacaggggctcccctccacgtcaggctggctggaagctgctgcttccattgtcccagggaggatccgaggtaggcgagccacaaagagaaaaattatatccctgcccatccctcaccactccggagttttctctttcaggcagtttttttgtttgtttttgtttttgtgtgtgtgtgtttttttttttttttttttttttttttacacagtgaagttttaatataattaaaatcctggccttttggatatgtcccttaattgtgactttaggaacaatattgttcctgaagttggggaaagaggtgattggaggggagttggcattgcgaaagttgccccttcagagggccctctagggccagggaatgtttttttgggaaacccccagaaaatcccagtgggcaaagaaatctcagccccttaggcaggtcagaggcggagggtggattcccctacatggtgaaataggtttataatgaatggaaggtgcagccgagtgagaggcagatgttgaaagctcgatggaggtggatttcagctccatgtaggaaataattttctgacaattagagctgtacaaatatcaatggttatcctcagtaggtagtgagctctccattgctagaagtgctggagaagtgaattgacagcttcttggcagtaaagccattgtatgtatcaagacagtgtgagagttggagtagatggccactaagctcccatccccatgtagactgggattacaaacagcaggtgtgacttgtcaccccagatatggacgagtgcagcttctctgagttcctctgccaacatgagtgtgtgaaccagcccggcacatacttctgctcctgccctccaggctacatcctgctggatgacaaccgaagctgccaaggtaaggctgtccggaggggcctggctggggtgtatgtgtgaggtggagctgcttcaggggctcatctggatatcctcacctggggaatcatgtgcagctttgggaaggtggcaggggtgggggtgtgagtgggtgctggtggctctcatagtggcagctctgggcaggatgcctggcctgttgtcttccttccctgtaacccgtcctttggccaggatattggccacttaaacttctgtaatgaactctgcagatgcagacggcagcctctaagcgtggctttctgcctccccaggcagatctctgaggctcctctgagaaccgctccagagctaagcaggacttttatggcctggccagagcccgggctttcttacgtggcccggagggcagtttggttagcctttctccaagtgatctcctagagcatggttgccagggagacctcatgcacctgactgctctgttcctgcaagggctgggaccccagactgtaaaaggggtgggccttctcctgtttgcctgcttagcctgggttccagccccatgctccacccactgaggggtcattgcagaagcaactgacccattctcagcctccttgaacctgccttatcccattgccaagcaagaattctccgtagtagtgccaggcaatagaaatatcatgtgagctacagatgtgagccatctatgtaattttacattttctattagccacattaaaagaggaaaaaaatgggtaaaattacttttactactatattttcttttctttctttcttttttttctttttgtgacagagtctcactctgttgcccaggctggagttcagtggtgtgatcttggcttactgcagcctctgcctcccgggttcaagcaattctcctgcctcagcctcccaagtagctgggactacaggcacatgccaccatgccgggctaatttttgtattttgtatttttagtacaggcgcatgccaccatgccaggctaatttctgtatttttgtattttaccatgttggccaggctggtcttgaactcctgtttttactactatgttttctttaatgcagtatatccaaaatattatttcagcatgtattcaatataaaaattattattgatgagatgttttacattctttttttaaattaaaaaaaattatatatataaataaataaaattaagagataagaccttgctttgttgcccaggccggtcttgaactcctggcttcaagtgatcctcctgcctcagcctcccaatgtaccgggattacagacgtaagccactgtgcctggctcacattatttcttggtacaagtcatcaaaatctggtgtgtattttctacttacagcacatctcaatttggatcagccacattccaagtactcagtagccacatatggcctgttgctgccatattggatagtacagctctgtagtaagatccagcctaccccacccccacgcgtctggcctggccaataatgccctgcctccgcttcttgtctcccctgcatttcagacatcaacgaatgtgagcacaggaaccacacgtgcaacctgcagcagacgtgctacaatttacaagggggcttcaaatgcatcgaccccatccgctgtgaggagccttatctgaggatcagtgataagtaagtcacggcgtccccctggggaatagaaacctgatgagggcctggctcaggaggttggaggtgtggtgtgaaagagagtgcaccagccaggaagtgaggggacctggcctactacctacgtcatgtgctcatgcgtgtgtgtgtgtgtgtgtgtgtgtgtgggtgtagaatagaacagagtagaatagatagaacagactggaatagaaaatatcagagtacattgcacatagcaagagtcaatattgttttttgaaacttatcttttagttttgtgtgctactgttttgcagtgcaaagtgtgttactgtaggttgtcaaaaagtttgcaaaacattccattccaagttatagggtctgaaacacatccctacatacaagaaagaactatttttcaaaatgtttgaccacaacacacagtaagaaacacatgcaaggctgggcacggtggctcatgactgtaatcgcagcactttgggaggctgaggtgggtggattgcctgagctcaagagtttgagagcagcctggccaacatggtgaaaccccatctctactaaaaataccaaaaaaattagctgggcctggtggcacgggcctgtagtcccagctactcaggaggctgaggcatgagaatcgcttgaacctgggaggaggagggtacaatgagctgagatcgtgccactgcagtccagtctgggtgacagagtgagactctgtctcaaaacacacacacacacacacacacacacacacacacacgcacgcacactcacacagagttctctatcactccgctactcatgccagagctatgcaaagattctctagaaagctaaccaagccgagagttgagtcagggttctagaatctcctcttccctctaatgactttgttctggatacatggggtctttcagaggttggcttctaaatgtaacactcataggactcacctggtgatctcgttaaagtgtgattcagtgggtttggggtggggcccaagattccgcctttctggcaagctcccaggtgaaatgaatgcttccaatctccctggactgctccgtgaatattgaggtgctggagagttgagtattgaggtgctggacagttgagtattgaggtgctggagagttctctcgttggtgctaatcaagtttctgacgtcatcttggtcaacattttactaaatcaccagacggcaaatattagagttgaggagagaattaaagtgaagacaacttccaaaaggtgaatgcagtaggacagtggctttctgttcctggcatagtaggagttccttttccttctcttttatcccttttttaaaccatctcagttcctccttggcctcctatattccaaatgttcacacatcgacttcccttgagcaacaccaaaccccgcatgggagacgaaaggatgaatcaggcacacccatcctgccctctcggaatacagcctctaagagaggaattcatggcttaccagtggtacccactttgataacaaattggcaaaagagaggataatgccgggacaggcggatcctttagggacatcttcacttgttgctaagagctgtgctactaagcaaccctttagaacagggctctttgacccccgacgtaaggcctgtttgtggcagagcagagctccaggctgctcttcccagcttctattcctggttctctctgggtttttccaggccacccctgtctgtggctggggagctgacccatttcagcttgcagcactgagctggagttactggtggagtctctggcatgacgctgacaatgctccgtgactccctcactccaggctccagtccagtcagactccggcagccccttccagctccttgtccagttcaggtgtcctgtgctcctgccagtctgaacaggacttgctcatgcctttacccgtgcccaggaatggccagcctcccttcttgtgtgcacatgcttccggccatatggaaggcattcctttcatttccacatagccagacctgccccatctttcagatttcagctcagatgccacctctcccagctgtttgtggtcctcttcagctgggagccatcactccctcctccaaacttcttttaggaaacaatgattttctatgctgcacatgatactttattgtggccattttggcactagagacattttgacttggctattttgatgcagccttaaaaaaatgaaacttgctctgccacccaggctggagcgcagtggtgcaatcacagctcattgaagcctcaaccttttgggctcaaacaatcgtcctgcctcagccttttaagtagctaggactatgggtgtgtgccagtgctcctggcatatatatgtatttggtaaagccagaggtcttgaactcctggactcaagtcatcctcctgcctcagcctttcaaagtgctgggattataggcatgagacaccatactctgctcagaatgaatggaaatttataaaaaggaagagtaggctggatggtttagatggaggagtccaaaggcctctctgaaaaatgacacttgggctggaatgggaaaatgagttgactttaactaaatagagagtggaagatcagaaggaacagcatgtgcaaaggcgagaaggcaagagtgcattgaaggcactggagatggttggatgtggactctcttttggaagtagaaccaacaggttttgtggatagattggaagttagtggcagaaacacagcaaggttgactcctagcgttggccaccaccgcgcgtctcaacagacatcttcatcctattgtgaaccctggcccctaggtggagtctcagggcagggtcagagacagaggaagggggtgttaggggtgaatcaaggggtgtctataacaggcattctttggtagtaaaagtcagtgattttatattagggcactctgttaatagttgctttgtattagagatatttgtgtctgtggtttatttctcctattagaaagtaaactatctgaggtcaggatcttattattcattgaatttccaaaatgtccaatgtcacatcttgtacatagttctaactcttgcttatcaattatcgaatgacaagatttgattatattcgattcagtaacattccatgcagactgggctgagcacaatagagaatgtacaaggatccccaagacctgttaatccagtttcttactttaaaaatttctttctttcttcctttttttttgttttgtttttttgagacagggtcttgctctgccgcccaggctggagtggcatatttggcctacgtggcaaatgtaaagtatcttggagaatgttctaatgttctgaaaaccagagatctaaggtttgtattctatttagtagccagaacatctggttggtgagaaaagtccattctctaggaaacagagctcgcctacatgctggagagattttagactcaagccaggagcagagacattctacagttatggcatttggatgctaaaaatggggtggcctcattttcagtgttttaagagaggaagtaggcacagccagcacctggaatggatttcttgagttctcacgtgatttccctttccacagccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcgggtaagagggagtggggagtggggacgccatctgtaacagtggccttgtgctgtctctcctaggaacatgctgtatgcaagcaggtaagagtggggctgggggacaggtaggcagagagaagagtggagggtgtggttcaaggtcctggtttccaccactttctgtgtagtcttgcaaaagatgcttctcctcctgagcctcaggatcctcatctgtgaaatgggaagttaggccaagatgcaatcttaggtctcttttctcctaatattctgttggagaggcattcacgtctccacttttcaaccaacccatgtgacaagtatttcttaagtacctcctatgcaggccaggcacgggggctgatgcctgtaatcccagcactttgagaggccaaggtggacagattgtctgagctcaggagctcaagaccagcttgggcaacatggcaaaactctgtctctacaaaaaaaaaagttagccggtcatggtggcaggcacctgtagtctcagctacctggggcagtgtggcggggaggtggtgtgagatgggaggattgcttgagcccaggaggtcgaagttgcagtgagctgagatcacaccactgtactccaatctgggcaacagagcgagaccccatctctgaaaaacaataaaaacttggtgacttaaggcaaaggaaatttattctctcatagttctggaagccaggagtctgaaatcagtttcactgagctgaaatccaggtgtcagcagggctgtgctccctctggaggctctagaggagaatccgttccatatctcttccagcttccgggggccgccagcacttcttgactgtggctgcatcactccaatatctgcctctgtggtcacgctgcctcctcttcctcctctgtgtgtatcaaatctccctttgtctccttcttatattaacacctgcgagtagatttagggcccattcaaacaatccagataatctctctgtccagattcttaatcacatctgcaaaaacccttttccttataacggaacgggttccaaggatttaggacttgcatctttttgggggctactacccagcatactgcacccaggaatctgcatttctaacagatgctgctgtgatcttccagggtcactgtggggagccatattgaaaaggtccatgggcgtttatatgctttcattagagactgggccctatgaagtcatgggccacaaggcaggaagacagaaatcttcccgataaggctggctttccgagggtccatgctgtctgaagctgcgggaccctccccgggaaaccactcagtcattctaatgtgagctctggagccatgtcttctacagtttaacaatttcacaattgtgtgatgtgacctaacacctctggacctctagatgagtgtttactttaggattagatgagattatccacttagtgccctatctggaatacagtttttatcaaagaagtggagtttggtggtgggggtgaaacagtcaatgactttttctttttctcacgctgttggatcaaacctgtgagcacctgggttacatctcacgtcaattccctaggattcacaggcatgttccatttctattggattgtctcattctctcacgtcaaaagtctgtactagtttaaatggaaacttcaacctctctgtctcttacccactgtgaagtttctccctgtctcctagttcagagcaggcaaggggtgtggttggcctctgccctgtcctcttgtcaccctcccggtaatggtagtgctggccctggctcctccagggctggcaggggaggagcaggtggtagaaagggtaaggctggaagagtgaggctcctccccgattgtagccattgtaaccaggcattggtattccctcaggagcagagcccccaaagctgttgctctcacagggtgcttttgtgggtcttttggagatttgcctgaggacttcacactgaccagtccctgatatgggcagtagggcctgtggttggtcacctgctactccaaacctctcagcccctaattctggggctatgtctcatacagatgtgccgtggtggtagtgaggtggagggtatcactgcatcctggcagcagaccttacacaagggcctttcaggatgtcaacatcagctccttgcattccccgttcctctctatggtgtggggcagctcagggctcacatctccagacttctcctggagacagtctggtaccactttctgcatccttgaacttcaggggcctgcatctctaaacagtttttctttttttgaaaacccctcttgattgagatggaggctagtaagtgtgtttaataaaatatatgtagagttgggcacaggggctcatgcctgtaatcccagctactctggaggctgaagtgggaggatccctggagcccgggagttcaagtccagcctgggcaacatagtgagaccctgtctctacaaaaaaagattaaaaaattagccaggtgtggtggcatgacctgtaaccacagccactctggaggctgagatgagaagataacttgaatccaggagttcaaggctgcagtgagctatgattgcaccactgcactccagcctgggtggcagagcgagaccctgtctctaaaaacaaaaacaaacaaacaaaaaagtatgtatgtaggctggagggggtgatggaatgagggaaacatctggctttggatcacagctttgtaagtcctgtataaccccaataactccacacacagcatcagcagcaagccgtgtatagtgcctgtatgtgccagacactattctaagtgctttctatacagtaaccctttaatcttcacaagaatcctatgatataggatggttttatcgtccagattttacagatgagagcactgaggcacagagctaagcaacccgcccgactagtctcacaactaataagcaccagggcaggatttgaacctaagcagcctggcaccaaaaatctgtgctgttatacttttcttcagaatggggaggtatgctttacctactcttccagctttggggtctcagatgaaatggagatcacaagaaaagtctaacatccagttacaatagaaagtattccagaaatagcagttatgattgtatagatactgttgtggccactgctactgttgctgctactgctgcaaggaggctgggagctgctgggccatggagagcttgggaatgctacccaggggactggagcatcgtgtgggaggtggggctggatggccatccaggctctcacaccctgagattcattgatttgattataaccacatgggaggagcttcatctcaccccgcaggcaaaccacacacacacacttgcatgcacacatgcacacacttatgcccacatgcgtacgtgtacacacacacacaagcccattcataagccttattggctgcctgtctctcactgagccctagaaagaggactgatgattggctttggccaggtggcttgggggtcataattagggccagaagaaggagcaaggtcatggggttcagactgtgccaaagtgcacttactccatgacacacgtggatcaagtgacagggcccatggaagctggcctgctacagcgtggctgcttgccacaggtcagaccatgccatcccacaagttgattagaataaacctgagtgtgtttgggatcagggccaagaagacacacagctggtgggctgttggcagccgactcccagcgtggtcaagtccactggcgttcagtcattcgtgtgcattcttccgttaccagcgtgcattcagcaccactgcatatgaggcttcaagtcaggcactgagcgttgagaaacaaacaggatgtggtctctgccctggaggaacccacacacaccttagcggagagggggaaaacaacctagcaaacacaacacaaagtggcgattctcaagtcaagtcaagacccatgggatggtgagtaaatggagaggtacagagaccttatcagagagtgtagtggttagaagcatgatttttggagccataaagtctagtaccatgcagtagtttggtggccttatgtagtatccctaacctacttagagcatagggttgtgaagattaattaagaggtgtaggaaaggttgtagccagatgcctggcatcataaccaccaccgtcatcactgtcgccaccatcctcctcctcctcatcttttcgcaccaccaagcctactaatgcccacgggctctcaggggtttatttcattaatgccctggctctgccctaaaagccgaatgtggaggtggctgtcctcagctcttgtggcaggtacttgagctcttccaggtgcttgtgggtagggtggacccaggtggaggccggactcaccagcttctgcagttacttccaaatgggagagtctaggatttcaaatgggatagttgaggattctttcgtactcaggagacatttaccaggagagcccaaaggaacaacttggaagtttgcacttgcccccttctcccttccagaccttgggctctgcagatctccctctggagggctgtccctagctcagggttctcaactcttggtctttgttcacgcagtgaaagctggtgagatatttgtatatgtaaaggctgcaggcatttccttgtgtggctttaccctctgaagccctggcccagggctcaggtttcgtaagggctgacaaggaagtccaagaaatctgcgtgaggaggtgccaataacgtggatgctgacgggaacaggaggaaccagtgccaagaggaaattgtgtggctgtcaggctgccgatagcctcatggataggggaggtcccagcgcctggcctgcacctgtctgccagccccacccttgtcttacttgtggtggctcttggggatgttcagaactttatggggcgccctccttttatggagacagataaaacatctagtgtagctttaaaccagctaggttcctttattttgcagagactgttgcttgcagcttctgggcacagggctgggctctgcagtgtatgggaagtgattgtccagcccatcccttttcttcttcacactgtttcctctaacagtgccaatatctgtcccttgcactgaccgcgagcatctctcattaggtgggtgctaggaagaagtgaaacacacatcagcctcttctgatacctgctgtgcagtgaaaaaagcctggggcttggggtcagaaatacctgaatggaagcccttggttctgcccaagactagctgggtaaccctaagcaattatttaacctcatgggacctcagtttgcttacttataaaacggggaagtaatgagtcatacctttcatacagcacttagacaaggacagccagggcccccccacctgggtcctgtgcttttagatcaatatttctcaatacttaatgtgcacacaaagccctggggattgtgttaagccacagattctggctcagtagatcctagccctgagattctgcatttataagaagctccctggtgatgcccatgctgctggtccagggaccacactttgagtggcaaggcctttcagggttttatgagaatttttttttttttttttagctggagtctcgccgttgtccagggtggagtatagtggtgcgatctctattcactgcaacctctgccccccaggttcaagcaattcttgtgcctcagcctcccaagtagctgggattacaggcacctgccaacatgccctgctaatttttctagttttagtagagatggggtttcaccatatcagccaggctggtctccaactcctggcctcaagtgatccgcccacctcggcctcccaaatgctgggattacagttgtgagccatggtgcctggccattttatgaggattaaataagcagatgtacataaacatggttggaagagtgcctcacacatgatgggtgctcagttgatgtcattcctctctgccttcctccttgaaagttttagaaaaagactcagtggaggagagagttcacgcgaaattattaggaccacagtgatcaggttacagaatggtgaagctggagatgactctagggtgcctagaggggggttcttaaattccacctttcccaggcatcacctaaaaatatactgacatagaaaatcttggaatgggcccctggaattgttagtttaacaaaaaaagttccagtagcctttgatgcctttttttttttttttttttaaattactgatctggtccaaaccctcattttatttttcctcaaaaacgttttttaaaacttttattccactttcaagagtacatgtgcatgttggttgtatagataaattactgtgtcgtaggagtttggtgtatatatgatgtcatcacccaggtaataagcatagtacccagtaggtagtttttcaatcccctccctcctcctgcctcccaccctgaagcaggccctggtgcctgtttttcccttctttgtgtccatgtgtatgtactcaatgccaaaccctcatttgagagatgagccccagaggggtgaagtgacagccctaagccatgcagaagtttcaatcaatgattcgttcatcattcaatatatgttttctgaacaccttctgtgttcaaggcaccatgctggcttctagggggactcagtggtgaaaagcctgaccccagtacctgttcttacagaactcatagcctagtgggagcctagatatcagacacggatcaggtagacagtatggacaatcatacatggtcataaatgctttccatcctgtacaaagtaaaggctgcagcgtcagaggtcgcagggggacctgacttagattggggaaccagagaaggctcctcttaggaagtgacctttcagatgagacctgaagggtttgcagaaaagaaccaggtggagagtgggcaaagccagggaaagagcatggcacagttgaggcaccgagggggtgccagtttgactgacggaggcaagggagcgcccaggtggggctgcagggccgccatgcaggccttttctcactggtgttccccggttctgtccatagcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagagagcttgtgtttggttcattttgacatcatagacgagtcagcctttggggttctagttctgtttaaacctgtttattgtgcgctggcttagaaagctctccagagagctagggcattatctgtgactctggcaaattgatgggaggggggcggtggggcagagaaataggggtcgtggggaagttagggggaggcatcatccctgagtcctgtttcatctgattagaaaacaaccaacaatccttctcttacgtagattatttccggtgctcctgcagaacaggaatgtattcaagttactttaaaccagtggccttcaaccctggctgcatagacggataaccagtagaactttggaggaaagattgattccccgggacatgcccccagacactctgatgtcattgggcttaggtagggcccggccatcaggatttttgaaaacttgactacgtagccagagttgagaatgtattgttataaaccctagaaagagaggtggacagatggggctggagccctagctgccttgccctcaatgtcttttctgctcattgtaggatacattattcttttcctggtcagggcctctggacatccttcaagtcttagaaccctgtgcaggggccaagagagtcaacattgcaagtcacaggagaacaggttgggatggctgtctttatgtgccatcccaggaatcaacccaaggcttcaggaaaaaagtgcactccctgatagctgaggtggagtctacagatccatctgagggtgctcccatcctacctgttggtgaggtattcattaaggacccccacagtgcctatcaggagttgtgtcctggacccctagtcttagtaggcattccacagatccttgtgatatggacaggagacagggaaatactgggtagaagagggtggttccctggcaaaggccccaccctcaagcctgggtacccatggccctaaatgaggacagccattcctgttttcatccctaaaaagttgccttttggcctgccatgtcccctatcctgtacccatataaaccctgaaccccaggctccaggctccagaagcagacggggagacaagaagatgagcagacatgaatggcagaaaagcacggcaaagaaggagagaagagaaggaacattgggaggaattcgactggagacgatctgaaaactggccactggatggccaaactccaggggaagatcatcttcccactccatcccctgtccagctccccatccatcctacttagagccacctccaccactcaataaaacccctgcattcatcctgcaaatccatgtgtgacctgatccctccgggatgctggacaagagctcgggatacaggaaactgtcacactggccctctgccctggcaaaaagggagagggtccactaagctggttaacgcttaagctgtccacggatggcaaggctgaaagactgcactgtttcagtgcctactcgggctttggaagtcacagacaccgaccccgggatgctgtcatggggctggggcccaaaagtgctcaccctggttcctgcacctgcctgtctgcgtgctccccttcccataaggggttttagcttggggtggctgaagagagagccacacccctgttgcacatcctgtgagggggccagggaattctcctgttccacttagtagtatctta

SEQ ID NO: 13275 - DNA, 74528 bp, Human
ggctgattcctgccttaactgatgacattaccctgtgaaattccttctcctggctcagaagctcccccaccaagcaccttgtgacccccccgcccctgcctgccagagaacaaccccctttgactgtagttttccactacccacccaaatcctataaaactgccccacccctaacaccctttgctgactctcttttgggactcagcccacctgcacccaggtgaaataaacagctttattgctcacacaaagcctgtttggaggtctcttcacacggatgcccgtgacaagtgcctgccaccacatcccactaatttttgtatttttagtagagatggggtttcaccatgttggccaggctggtcttgaacgcctgacctcaggtgatccacctgcctcggccttccaaagtgctgagattacaggcgtaagcccctgcacccggccctgtttttttttttttttttttttttacatcccggagtcacactggatatctgaatgtgcttaaaataaaattcacatctcattctggaagtgtttattaaatgctgtccctgcattcatgtgaacatcacagcccagcggttagatgtgcagactccaacgcctgactgcctgggtctgtcacttactagctgtatgaccttggatgggttacttaacatttctgggcactggtttctcattagtaaaatgaagaatgggcgcctgtagtcccagctacttgggagcctgaggcaggagaatcgctttaacccgggagacgaggttgcagtgagcctaggtcccgccattgcactccagcctgggccacagagcgaggctccatctcaaaaaataaaatttaaaaaaaaaaaattcagctttcacggagaattactactgcctggtgccatcagatcccaaatactggaggcattcccaatgttctgttcacaaactgtgcaatctgtgatagcccctcttgtgaatataatcaaagtgaaagatgccagtatacttattgctatgcttaaaagaactgcagatctatcatatccttttgaaaccaaaaaatgtggaagtctccctggctagatgctgtgtgtccacgtatcctgcaccaattgcttgaaagtcacatgacaacctttcttcctttagggaaggaagcaagcaaggtaggactctgtgtgttacagccagtgtgggtaactaaggactgagggaggtgtgggcacttgcatagctagtgccgccaataccataggagcgttgacactaaacggcacttctctattaagttgccctgctgtcttctaacgagtcattttgaaaaacggttgtccgtttttcaactacttgggtgagggcagcttcatgaaaaaagctcatcgtatgttaaagaaggtagggtttcaattgtgagctataaagccaccagaggagatttctcctatagaaggaaggtgtgtttcctgcttggacacctgaatttgcaacccatcctttcttttttcctttttccttttttttttttgcaacccatccgttctatctttgtagcctcagctcctaccatagtgcctgtcacggagcagctaatcgacacagtgacgcgtgtaagttatttgaagccacttcctgcgcagtggaacgtccccgccaagtctcccggcactgctgggtgtagtcccaattaaaacactaggtttcaacaacacaaggagggtccgcagggtccccggactacccaccaagggtcggctctgctttgaaacgcagctgcaggaggccgaggagcgccgcgatgccccagttatccaggccattccttccccggccgaagctggccgcctgcatgcacctaaccttgcgctaggcactggctgcggttaatccagcccgcgctcggtcctccgcgatcccagcctcccttgcgccaaggacacgtccggcggcttcgcggggcctgtctacgccaccgcggcgcttttctatgatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaaggtaacagctggagcgagggaagggagggcttttctaagaccctgggaacgtccgtttggtccctacttccatcagtcaggagacgcggacaggtcgcaaaggaatgctgctcctcccttttttcttcacacacctcctcttgcctcttctcaacagattttctatgatgaaagaccactgggggccaggggaagagtcctggttctcctctctttaaatattctggatatctcaaagtacagtagagtgaaactgctcctacgttaagtcgagtttattttcgtttggttgatccacgcccaccactttgccctcagtttgggggctgatctcattcttaacatcttcctgtattctgacccagtttaaagaattgtatatctgttttctatttttgtaacagttgaaataactcataatttaaacacttggtgagttttgctcttttctgtcttgagtatgttatgaaacacggccatgtttttctatttaattattttttacttttccttattgtgatgatacattatagcgttccagctgagaatgtatttttgtgtataatcgcccatttcgcccatatttcgacagtagaatagggaagacaaccctattcttaaggtacccttagcaatcttcactcatttttgaagtcctcaatctcgttttactaatgaatagtgacccagagttacatggtaatcaatggctacattagttactatccattaattactattttgatttcttggcattttagtaagcaatgtttggatcaaaacagtttttaagtttcaatctaagtctgctccagggagataatgggctgttcttttgggtgagagctgctgctttgacaattgtatttcttataaataaatttaataaattagtattctggcttagtttttttttttaattgctaatttaacagatccttcatatttatttggtagaaatcgggaaagattgtttgatagaaagataatgcttatgttttgaatttctgtggggtctatttagatggaaggaagaatagactggggagctaccgaaatccattttaccgctttacgttccccatgccataaaggtgcatcagtgagacagctttggggatagaaatgaaagggcttctttatgtgtgggggaaagcatgggaccttgagggcagtcagaagcacagaagggctggataactatgggaaatgactggtcgctccttgtatcctagataggggaaaacggttggctgttccttagaccctaagccagagaatatgcatccctcaacctggatgtcttccaggtttaaggtggtgttcattttgttctcctgccaaatgtgctgttttctcattcttaatagcttcactctcagtttcctaaactgtaaatcttcgtgtccttgttttatgtcttttttcatctcctacttccagttggtcatgatatcttgtttatcctatgccagaattgtcctttgctttattactccttattctttagatccctataatctttcccagggactattcctctttcatgtcctgtcacccatttctccctaccccagtccattttctattgtattgtcagttactttctaaaaacaaacctgcgtaaaaatttcttgaccctgttacagaataaaatccaaacctcttagttttggactgagtctcactctgttgcgtaggctggatgcagtggcgcgatctcggctcgctgcaaccttcgcctcccgggttcaagcaattctcctgcctcagcctcccaagtagctgggattacaggcgtgtgccaccacacctggctaatttttgtatttttagtagagatggggtttcgccatgttggccaggctgatctcgaactcctgagaccgcaggtgatcctcctgccttggcctcccagagtgctgggattacaggcgtgagccaccgcacccgaccttcaatgtaccttttctagttgccataccagttgctgtacatgtgcacatatatatgcttgcttgtacgcacagcttctgtcgtgtgggattttgtcaggcacttacacaacttcaagcctctacatggaaagccctttcttctctatttcctccttcacccagaaaacaattctcctgtacaaccctgctcatatgtcaggtacttaagtacttggtgaaccattctgactcccacacaggttgagttgttgagttgaatgttggtgatctgtgttctaacagaactttgtggatctctccctgacagcatttaacatgttgagttataatttatctgttttcctgatgcccagcgtgaggactgaatttttttgctccttatattaccaaatatgtgacaccttccttttggcacatagtagatgctcaataaaaatggcacaagtgcgtgattagaaatctgcaaagttgcttaatgcctttattctttcccctttgtatttcaatcggacttgcttaacacctaatttattgattttgtaaatttttaaaaataggggtctggccaggtgtggttcatacctgtaatctcagcattttgggaggctaaagtgggaggatagcttaaagccaggagttgaggactagcctgggcaacatagggagatctcatctctacaaaaagtttttagctgggcatggctgcatgtgcctgtagtctcacctacttgggaggctgaaatgggaggtttgcttgagcccagtagttaaaggctccagtgagctgcgattgcaccactgaactccagcctgggtgacagagacgaccctgtctaaaaaaataaagggaatggagggtcagagtacagttcttttattcattgaacaagtatttattagtgtttaccctgtgtcagtaatgaaaaataaaacagttccaaaatagcactatgtggacaacttgaaagccatccatatttacaatatcagaaggttgcagttttacctaacactactgatttattcaaggttaggagcttgggcttttaaatcagagagacatgggttgaaattctgcttttgtgcattacaagttgtgggatttttggcaaattattagaaattaacctccaaaagcacagtttccttatatgttgaatagggataatcatacctattgtgaggttgagaggattaaatgaaatcatgagtgtaaaatgcctggaattgtgtctaccgaatcgtaaacattaatgaatggtaaatgtcatatttgcccttattgacaaagtcagaatatttttgtctgcataatatctcccctttgtacttaaaaaggccaagtttttcttgttgggggaggtgtggagtttgcatggacttgtaaaatccctctttaaaatagttgctgcttttaacaattaccttcctaaacaaattagattataacttgtcctcttcagagtagcaattaaacagtcctttcatagtttcaagcaagatgtacaaccaaccacagatgtaaccctacctggtgattttctaaacaagagtgtttgtcactgtaattactgcatgcttcttttgatttaaaccaagcttgtccaacctgtggtctgcaggccacatgtggcccaggatgggttttgaatgagacccaacacaaattcataaacgtgcttaaaatgttatgagtttttctggctgggcgcggtggctcacacctgtaatcccagccctttgggagcactttgaggagggcctcaggatcacctgaggtcaagagtttaaggccagcctggccaacatggtgaaacctcgtctctttactaaaaaatacaaaaattagccgggcatggtggcgcaggcctatagtcccagctactggggaggctgaggtgggagaatcacttgaacccaggaggcagaggttgcagcgagctgagattgtgccactacactccagcctgggcgacagagcgagactctgtctcaaaaaaaaaataaataaataaataaataaaaaatgaggttttttgcgatttttttttttttaaagctcattagcgattgttagtgtattttatgtatggcccaagacagttcttccagtatggcccagggaagccaaaagattggacactcctaataaactgtagtccagataagttatttttatattaaagagctgtgagtaatgaaaaaaatactagtacttagaaaaaaaatctaactctggatgatgattttcttttcttttcttttttttgagaccgagtcttgctctgtcgcccaggctggagtgcagtggcacgatcttggctcactgcagcttctgcctccccagttcaagcaatttctcctgcctcagcctcctaagtaggtgggattacagattataggcacctaccaccatgactggccagtttttttttttttgtatttttagtagagatggagttttgccatattggccagggttgtcttgaactcctgacctcaagtgatccacctgccttggcctcccaaagtgctgggattacaggcatgagccaccgagaccagccagatgatgattttctaacagcattagtggtgccatgttgacactgctgggctctcactctacttttaaatgaaaatgtacaaaaccaagggccatgcatggtgacttacacttgtaatcccagcactttgggaggctgagtgtggaggattccctaaggctaggagttcgagacctgcctgggcaacacagtgaaacctcatctctccaaaaaagtaaaaaaattaggtaggtgtggtcgcatgtgcctgtagttccaactacttggaaggctgaagcgagagagtttgaggctacagtgagccatgatcacaccactatactccagcctaggtggcagagtgaagtgagaccctttccaagaaaattaaaaaataaagatgaaaatgtagaaaaccagactgagctcattcccatttttaataaattgtgtctatgttactttaaataagtgttctcagtgtatttttcttcgtttataggtcacttattatttgatagtattgagagcagaagttagtgacagagcaggagcactgttgttatctcagacaaacagtgccactttaagttccagctccctttccttttttttttttggagacaagagtctcactctgtaacccaggctggagtgcagtagcacagtgtcggctcactgcaacctccacctcccaggttcaagcaattctcctgcctcagcctcctgagtagctgggattacaggcgtgtgccaccacacccggctaatttttgtatttttagtagagacgaggttttacctgttggccaggctggtctcaaactcccgatctcacgtgatccgcccaccttggcctcccaaagtgctgggattacaggcggtgagccaccgtacctgacctccagctccctttctagcctcatgcatttcaaggaagtcacttctcttctaactacaagcagccagaaaaagcagacagtaaaacacatacagagggagtgctcgggcacaaagggaggtgggggtaaagtctcttgggtaactgccaaacttcactctcatacagtgggccccagtaaagcagtgggccttagaaagcacattcctttcccttcaggtgcactaaaatagggaagctaaagcagactcggggggtatgcctgcagctctagaataaatggaacaaatacacaactctccctcccagataagcactacaaaaaaacacagaagcagtctaagcctctaataaattctcccaccctaaatccttaaaaactcttagtctggaaaagagtgtgcctctaacctaactcagccgaacacccctctcaggtttgttttctctaaaataaacctgtcttaactggcaagccaccctttgtgtttctctcctctttctttaattcttacagttagaaataaggcctaaagccccagttgagtaagcttcatctaaaattatagcagcattagcccacagagaaatagttttaatttctaaagcttaatttcccacaacaaaattctaatgaacatttctaaggggtaaaggtagacatcctaagatacagggcataggcaaaaagaatgacttttatgacaatgaagaacattagtgtcagtgaaaagttgttatggaaataaagcgatttgtttcttctgaatgctttcatatcagcctactattctgtgtaaactcagtgaaatatattttcttgaaaatacctatttattacttcatatggtattgattaaatattcaatatttgttatttctcttgtagcagaattacctgattctaggacaaaggaaattgaagccattcatgcaatcttgagatcagaggtaagaaaaatcaaagactacttagatttttcttttttgaagtcatgaaggttactcaaacattactttgatcctttctttttaaatgtactgcttagcactttttttctcttcttgtttaattttgattgttttttgagcttttatcaaccttctgtagatgaaaaatatatttacctgttactgcagtttgctattctttaatattcccatctctatttctgtataagtaggaaaactgccaaatgtagaaataatagtatcaataatttatcataatccagagtttactgtgttctaacagcatactaaattgcagtggcacatttatttaagaataattttttttttttttttttgaaacggggtctcactctgtcacccaggctggagtgcagtggcactatcttggctcactacaacctccacctcctgggttcaagcaattcttctgcctcagccccccgagtagctgggactacaggtgcacgctaccacacccagctaatttttgtatttttagtagagacagggtttcaccacattggccaggctggtctcaaactcctgacctcgtgattcacccgccttagcctcccaaagtgctgggattacaggcgtgagccaccacgcccagctaagtataatattaagaatgcaattctgtttaacctggagctttttaaacactaaaatgataataatatttggatacaaaaaagttaagaatataggaatagcagccaggcacagtggctcatgtctgtaatctgagcactttgggaagccgaggtgggtggatcacttgagatcaggagtttgagacaagcctggacaacatggtgaaaccccatctctaactaaaaatacaaaaaaattagctggatgtggtggtgcacacctgtaatcccagctactcaggaggctgaggcaggagacttgctggaaactgggaggcggaggttgcactgagccgagatcacgccattgcattccagcctgagtgacagagaaaaactccatccaaaaaaagaaaaaaaggatacaggaatagcaaattaattttaatgttttattcattattagggtctagattgggcgcagtggctcatgcctgtaatctcagcgctttgggaggtggaggtgggaggatggcttgaggccaggagtttgagaccggttacaaaaaataaagataaaaaaattagtcaaggtgtggtggtgggtgtctgtagtcccagctacttgtgaggctgaggtgggaggatcacctgatcttagggcccaggaagtcaaggctgcggtgagctgtgatcctgccactgtattccagcccgggcaacagagtgagaccttgtatcaaaaaaagaaaaagacattttaataatttaaatacagcaaatccaaatttttatttaatttttttctggttttgaaagcataaagactcaaaataagcaatgttctttgaattcagtgaactgctttttaacccttaattgtataacctggaatatctttatcttgtaaaatattgattccaaagttcagttacctctctaatagatttcaggttattattacttctagttcttttcgttgtggttgttgctttgagacatggtcttgcttttttgcccaggctggaatacagtggcacagtcatagctcactgcaaccttgaacttctgggctcaagtgatccttctgcttcagcctcttgagtagctggtaccacaggcatgcaacaccgcacccagctaatttttaaagatttttttgtaataggccaggcacggtggctcatgcctgtaatcccagcactttgggaggctgaggtgggcagatcacttgaggtcagcttggtcaacatggtgaaaccctgtctctactaaaaatacaaaaattagctggatatggtggtgggcgcctgtaatcccagctacttgggaggctgaggcaggagaatcacttgaacccgggatgtggaggttgcagtgagccaagatcgtaccattgcactccagcctaagcaagactccatctccaataaataagtaagtaagtaagtaaataaaaaaataaataaataaataaaattttttgtagagacgatgtcttgctctgttgcccaggctggtctcaaactcctggcttcaagcagtctttccaccttggcctctgaaagtgctgggattacaggcatgagccacatgcccagcctggttcttgattgtgtcattaaaagcaatacttttgaaaattttaatggctcatgattttattgaagagatgatggctgtcatctttgctctataatttcaaaagcatgtttattcttagatttataaatgccaattagaatgatcagtccactgagtttttttcatttctgtgtcatctgtttcctcccagttgcctttgtgtacacacctgctttcagccttctacatatgaacatatcaagtaaatgttggtgtacaaatatacatgatgaaagaatactgtcacatggccaggcatggtggctcacgcctgtaatcccagcactttgggaggccgaggtgggtggatcacctgagttcgagaccagcctgaccaacatggagaaaccctgtctctactaaaaatacaaaattcgctgggcgtggtggcacatgcctgtaatcccagctacttgggaggctgaggcaggagaatcacttgaacctgggaggtagaggttgcggtgagccaagatcccaccattgcactccagcctgggcaacaagagcgagactctcaaaaaaaataaaaaataaaaataaaaaaagaatactgtcatgtatctgcttagcaaaatgaaatggtttaagtccttgtcacaaaataatgcagagtgaagtattttcctgttgaatgactaattgatctgaaagccatatttcttttttgttcttaaaaatatattattcactcatcaattcttttttttttttttttttttttgagacggagtctcgctctgtcgcccaggctggagtgcagagtgcagtggcgggatctaggctcactgcaagctccgcctcccgggttcacgccattctcctgcctcagcctcccaagtagctgggactacaggcgcccgccactacgcccggctaatattttgtatttttagtagagacggggtttcaccgttttagccgggatggtctcgatctcctgacctcgtgatccgcccgcctcggcctcccaaagtgctgggattacaggcgtgagccaccgcgcccggcccactcatcaattcttgacttttagaaaattcttccaggatattgccatctgaagatttgtgtaagatttcacttctacagtcagtttcaccataaccattagactctaggatgctgctttctgtctctgcattaatcttctaagttgtctaataattgtgaatgttttcctttgtcagttttcttctcttcatcaaataattaaaaattctgagtttttaactgtgttcgatgaaagagaaaaaacaaaactacaaaaagtggtgtctgtagacagctgttttcttttaaaaagatgatataggccaggcatggtggctcacgcctgtaatccatgattacaggctcatgcctgtaaactttgggaggctgaagtgggcggatcatgaggtcaggagttcgagaccagcctgaccgacatggtgaaaccccatctctacaaaaaatacaaaaattagccgggtgtggtagcacgtgcctgtaatcccagctattcaggaggctgaggcaggagaattgcttgaacctgggaggcagaggttgcagtgagccgagattgtgccagtaaactccagcctgggtgacagagtgagactccatctcaaaaaaaaaaaaaaaaaaaaaaaaaaaaaaaaataatactttgggcaatgcagtcagaaaactggttattttaccattgcatcattctcctaggtgatttcataagttttccgttttcttgttattgtcatttttaaaatagttgggaataattttttaaatgattttttaaaattcccatgatagtaaaagagccaaatgttttaagatacagaaaatacaagttgattttgctcccatgatttttcttagatttataaaaagatccacggtaccctatggtaattgtaagatagaatgttttattctatttttgaaaataggtaaattttctctttgttggtagacccctcagaaagaataaaaatcataaatatcaagttttacgaatagttaggactgcctaaaaaagaaattaagttgatttcagtggaccctaatggtataaccaaagattaagcaggacggaatattttaagatgtgagtgtcctatggatttcaatagcagaaatgtagtctgactttagaaggactgcagctagaactggaggccatcaggagtctgtctctcttttcatttgtactctcttttcttctttctatgcatttattcttttctcctttcagaccagccccctctgttcaatattccatataatagaaaatattatctctggcaactcttttcatattttatgggttcggccacatgaagagaaactgtccttcatttgctctctcagcctttctttttgttttgagacagggtcttgctctgtcacccaagttggagtgcagtggtgtgatcatggctcccctgcagccttgacctctcaggttcaagcagtcttccctcctcagcctcctgagtagctgggactatgggtgcaagccaacatgcccagctaattttgtatttgtattttttgttccttatgttgcccaggctggtcttgaactcctgggctcaagtgatcctcctgcctcagcctcccaaagtgctgagattacaggcatgagccaccacgcctagccctttctcaatctttctgactctcatatggctatggagatgagggcagacaaccaagtagatattgaccatattcaaagtttcacagttctatttattaatcagagttaaataaataaccttaggtatttttgtgtgaaaaaaaacctgaagtgaacttttataaccagggtttgacttcagtatattatatcgctgagttatgtatggtgtttttcatataaacagcttacagaaagtcatgcaaaagcagccagtagaatagaaggtaatcagctgttgggaccattggtcctgtttcttactactagttcttcaggataattaaggtctgtgttagatttctggggatagagtcccaaactaggatttgtggatgctgtaattattcctttgattattccattggttttctctgggaatttatgtaatcttcctggatcattattttcacatctgttgacatcagaagttcctagaatctaagaagaaaacaaatgacatccccaaagtgaaaaagtcttcaccttttagcaagagctttctttctcactatcagtcttctttttctcattcattgttgttaaaccgtgtttgtgggtatattagtagaatgcttagtaaattgttatctgcaattatttgtaaattcttttttgtagagagttttagtgtccatttcttttgccccattatgttctttttgttgttgttgttagaacaactcagcaaaacaaaattcctgtttattgttggacaacattgtctcacacatacatcagacaggccaaaaaaaataaacagcaacttcatagacaaaaaaggaaaaaaaagaaaccttttatttttggcctttttaaccatctcatacaaaccaactacttatagtacagctaagtacatacacaaaaaagttattggaatgctcggaataagattgtttttctgttgtcgtttttgctttttttacaaggttttttttctgctttgagattataatgaatatggtcacaccacaagtaaagtcagaagtaggacaaagaacactccgaaggctggtttggtcatccgagatcattaaaaatggctgaccctaacaatatgtacaaaaatataaaatgaaaataaaaaatacaaatttcctttttaaaatacttttaagaaaaaaagcagggccttggaagttttggttctttttcctcccctgttgcaaattctcatggtttgggttgcgtggtggagagcgcgtgtcatctgctggtggcactgcccacggtgggcgggcgggcctctctacttgaaggtgaccacgtttagattctgagaggggaagtggagggtgaataggtcgcggcggccttttttttagtttaacttttccttttttgctgtctagtcatcctcgtcggtcttctgcttcttggtatcaacatcgtcatcctcatcatcttcagctgcccacttgccggtagctgactcagcttcctcatcttcatctccatccttcttcctcaccctcaccttcttcttcctcctcctcttcctccccaccttcttcctgttcttcatctacttcattgtcagcctcttgctccccattttcctcgtcagcaggggcgtctcttccattttccgcctcttccacaacttccttcttctcctttaagtccttggtggtgatttcggagctggtgtccacggctgcgtctgacatggtagggcacgccagtgatccgatgcaggggattaaaaagaaagcgagagttcagggactctggcgataaagctgccggctgcggcgagcaaggaggcggacgaggaacaatgcaaagatggcttttcagagcagccagtggggcgccccattatgttcttattatttcattcaaataaggaatgataataggttaagataatttaatatttaggtacatacaatttgagtaatttttttcatgtttttcaacatcttaaaagacagtgtgtaatgtctaggttcattgaattaggctattttgtgtacttttaacttttttcaaacagttctagtagtggttttcaaattggattttttccgaggtccttcagggaccctgaaagacaagcaaattatgtgagattttagcctcctccctgtacttcaaccagaaagatttctttttaaaaaaagttctgtttggggaagaaaacaaaagttcaaacatgtaatccatttatttactagacatgtattgactgctgtgtgctagaactgggtatacaaagatggggaaacattgattcgtggccttttcttagcagaaaatcaatctgagcaaaatgttaatatttcactgtttggtttagaattatgcatattctgtctgtataaacatggtcagtgctttttttttttttttttgagacggagtctcgctctgtcaccaggctggaatgcaatggcatgatctcggctcactgcaacctccgcctcccgggttcaagcaattcccctgcctcagcctcgcgagtagctgggattacgggcacacgccaccacgcccgtctaatttttttttgtattttagtagagatggggtttccctatgttggccaggatggtctcgatctcctgacctcatgatctgccttggcctcccaaagtgctgggattacaggcgtgagccacagtgcccggctggtcagtgcatttttaactttaatttaaaagcatattttaaagtccagaattctgtccgagaccttttatatttgacatttttggggggggaaagcagtacgtttttcataatgctgtgcacataactaattacatgttttacttgcagtctttttgttgaaaatactttttttttctagaatgaaaggcttaagaaactttgtactgatctagaagagaaacatgaagcatcagagattcaaataaagcagcaatctacaagttaccgaaatcaacttcaacaaaaagaggtaaatgttatcacagttacttcatatgtacttcactgtaatgtatttaggtatgtttttagagttagaatataaatcgaggtatattcagatctgtaaaaatatgaaaaggtgatgaatttaatgattttcgactcagtttgatatcccttatttaataagaactttgtaaggtaatgtaaactttattaagtttacatatataaaccaacctgtgtgaagtataatttttttctttccaaagaagaagaaaaagtttttgtataaaatatctttagggatctgttgcttataatttctgattttatgaagcctaatatttgttgtattggcatgtgcttgattttccatggaaaaactattaaatatatgataatttacatataattgctttataaatgtttttgggttttttagtttgaaatggctgctttggaattgatttatctttgctttacagtgctggtagtagatattatataatttaatgttactctgaatccttaaaatacagtctgtgtcctcatgtgtcatgctgttactgaattctctttagtgtttagtacctaagtggcccccaataaatacttacattgaatggaaccatttcctgttatattgtccagatcatttggatgtttttcagtttgttgactaagtgttcatttctaccataactttatatttgggtttttaaaatttaggtgtcatgctttctaattcctatgctttctagttcctttagtgacatgctaaggtgaaagataaaagtatagcacgttaaagatatacataggttttgaaagtagtgcttaaatttccaatttgttgggaagtgataatttcataaaatacaatacaaaatgaattactataaaaataaaatgaatactaaaaaaggcaaagttgcaagttcaaataatttttttttttttttttgagacagagtcttgctctgtcgcccaggctgaagtgcagtggtgcaatctcggctcactgcaacctctgcatcccggttcaagcaattctcgtgccgcctgagtagctgggattacaggcatgcactaccacgcctggctaatttttgaatttttattagagatggggtttcaccacgttggccaggctggtcttgaactcctgacctcaggtgatctgcccgccttggcctcccaaagtgttgggattacaggcgtgagccaccgtgcctgtcctcaagttcaacttaaagttacaaggctactttttttttttcttgattccccatctctactaataatacaaaaattagccggacgtggtggcgtatgcctatagtctcagctacttgggaggctgagacaggagaattgcttgaacctgggaggcggtggttgtagtgagctgagatcacgccactgcattctagcctgggtcacagaacgagactccgtctcaaaaaaaaaaaaaaaagttcagcagatataaaattactactaaattgctttaaaagtcttaaaccttacttttcacattgctatacttgctctggactggtagtgagcattcaactgcattcgtctgtggaccacattttgagtagcattgagttataaacattatgatagaacagtagttcctcctacccaggggtttacagctgtgtcattatgacactttaaaagcatatacatgtttacaccacctaggagattctaacttagtgtactggaaagaggccctggtgcaggttgagcattcctaccaaaattcgaaatgctccaaaatccaaaactttgagtgccagtttgatgccacaagtagaaaattccacaaataagtactgaacacaagctttgttttatgcacaaaattgttaaaagcattttataaaattactttcacacgtacctgtgggtataaggtgtatatgaaacataaatgaattttgtgtttagacatgggtcccatccccaagatatctcattacatttatgagaatgttctcaaattggaaaatacctgaaatgtgaaacccttctagtcccaagcattcggataaggatactcaacctgtattggtcattttcaaaagctccacaggttattctgatgcctacctcacagttgaaaacactggtggggaaaattttggtattttatgttctacttaactatcgatattagagggcacattaagcattcaggtttggaaatatctgttattacagcttgcacttgtataactacaagttgatataaatatcatataatgatagctttttaaatatagctacatttgaaaaagatgtggattttagtactttttacgaggatgaaatatatgattatatagatctgttatttcctgaatctatgtgcggccctcattgtgatgttcatattctccaagatggaatttatctcatgtcatttgtgggaaaatgaatgaaatttgtacagtactataaatttccatttgagaaggggctccaatatgaaaaacttgtttgttatgacatacaacataaatgtgtttggtttttgtctacttgcttaactttatgcatatagaaatactgttacttgttggctgtcttcctaatatcaaattttcctcagttgtggcagtgtcttctggactactctactttatagaaaacttttttcagttctgtctatattgtttgattttgtgttttgaataatcttttacaagaatggatgtggcattttggtaggtcctgtgtttataatttcttttgcgctatgacttacccgcctttagtcaaaactgctggtaatttcagaacttcagaactgttctcttcctaaataggtcagattttcgctggctcctctttgccaaatctaaagctaagaccactttcagtatattatttctttttaagattcatgggctaataaccatgggctcactgtttcactgttatcttatctaaaaagattggatttataaatcaaagcattcttccagctgtgttgtgcaggtcaatacaaagttacctcagattcatggtgcattttaagcctacatccagccataatcagttacacaacacccttgtaacaggagatattctaagaaaatttccagtgcatagacggacacagctttcattttctcatcatttaagatttggtaatcacaaacagaaccctaagaaattgcctatactactccatgcagagaagatagcaaacccatgtttaactgagaaattcattgctttagttaacatacaaaattctgatatttctactatttgtaacattatttatgctttaattgtgagtgtgttttaaataaaaatgttatggttagaatgttatataagacttagattcagttgatagaggaccatcattggataatcttagacaaattattgtattgtgtcttttaatacaaatctataaaaagtcaatatgattgttttaaagtaccttctctaaaacttggattataaatatataggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcaggtagataaaaattttttagagtttttgaaaactttgagtaaaattactggtgtaatataaaaaactgtatgtagagcttttgatatcagaaagaaccctggactaggaaatagaaaaggtgtattctaattccgtcagtgactttctttctttttttttttttttttgagacagaatcttgctctgtctcccatgctagagtgtagtagcgtgatcttggctcactgcagcctcggcctcctgggttccagtgattctcctgcctcagcctcctgagtagctgggattataggcacacgccactatgcctagtttttgtatctttagtagagatggggtttcaccattttggccaggctagtctcgaactcctgaccttaggtgatctgcccacctcggcctcccaaagtgttgggataacaagtgtgagccactgcgcctggcctctgccagtgactttctttctttctttttttttttttttttgagacagagtcttactctgtcaccgaggctggaatgcagtggcacagtattggctcactgcaacctccgcctcccgggttcaaatgattctcccgtctcaacctcccaagtagctgggattataggtgcgtgccaccatgcctggctaatttttgtatttttagtagagatggggtttcactatgttggccaggctggtctcaaactcctaacctcgtgatctgcccgccttggcctcccaaagtgctgggattacaggcatgagccactgcgcctggcctctctgccaatgactttctaagtgattttggtcctgtcatctttctctcctagtctgagtttccctttctgtacactatttggaaaaaattttcaaaaaaaagcaacagatccttttttttttttttaataaaacatgagaggaaaaaaattgagttgctgtggttgaaccaagaaccttctcttctggagtccctgagactcctctggtgtaaacaccaggactccgaggcaccatgtttgaaaccgcttgcttagatgttgtctgaggtttctgctagctctagttacatgtaaaatgaaaatctggtaattgatattataaaatatgataaaccattttgtgttgtttctcatgcactagaaattaatattttgctatttggggctgtaaactttcttccaaggagcccttttttgtcttatatatcagattttatacaggatgaatatctcttatccgaaatgcttgagactagaagtgtttcagattttggattttggaatcttttcttgttctttcttttctttttttttttgagagagagtctcagtctgttgcccaaactggagtgcagtggcaccatctcagctcactgcaacctctgccacccgggttcaagcaattctcctgcctcagccttctgagtagctgggattacaggcgcccgccaccacaccgggctaatgtttttttgtacttttagtagagatggggtttcaccatgttacccaggctggtctcaaactcttgacctcaggccgcccaaagtgttgggattacagacatgagccacttcatccggccagattttggaatattttcataaacataatgagatatcttgaggatgggacccaggtctaaacatggaattcatttatgttacatataaactttatacccataggtacttgtgaaggtaattttatacactattttaagtaatattatataacttgtgtgtgaaccaaaatttgcgttaaatatttatgtgtggaattttccacttgtggcatcatgttggcactcaaatgtttcagattttggagcatttcagattttggatttttgaattagggattctcaacctgtatactatggaaattgtagacatgagacctggagtaaactggaacactgtttatttggatttaatttcatcaatgtaaaaaaaaattacatgagtaaagagattattttttgtgtttttatgaatgtaatctagttatgtaaaggagaaatcttcccacttaaaattatctccttctttcacaagttgctagacattctcagtacccaaaataagctttagagaggatgatctgtttgtccatcttatctccaaaaagcagtaaactttctatgtataagaaatgacctggagaacttggcagtattgtagatcttctgtggtaccttcagggatatcaatttgttagccagttttagggccttaaactgcatttaaacaaatagccctggtgattctgataacctaaggaacacattttaagaaacattgttagagtaagatttcatagggaagagaatggtttttggtgtgttcatttcagcatatcttgaatgcctactccatgacagacctgtactagactataaagttgaaaaaggcataattgggaccgttcagaggacttaattttctagcaagacgtaataaaaattaatatttgcattacattttatgtttccatatgtattatcccaatatattattatgttaataattatgagatagatgtattacctctattttataaataaggaaactgaaagttttttttttgttttttttttttttttttgagatggagtcttgctctgtctaccaggctggagtgcagtggtgggatctcggctcactgcaacctctgcctcccaggttcaagcaattctcctgcctcagccacccaagtagctgggactacgggcacccgccaccactcccagctaattttttttttgtatttttaatagtgacggggtttcacctgttggccaggatggtcttgatctcttgcccttgtgatccagcggccttgcctcccaaagtgttgggattataggcatgagccactgtgcccagccctaggaaactaaaagtttaagtcatataatccattgccacagtggttaagttatgattcaaacacacgtgttttgactaaatcctgtattttttctattatactttattctttctttcagtcctagagtagcttttggttcattaaaatgctacatagtaatattaataaagataaatgaacaacatacagctttgaatgagaagaatccaaaagttgttttatttatttattaaaccaaagattattctctattgggtagagatcttctgggtaaaatcatttgattttgccaggcatggtggttcatgtctaatcccagcactttgggaggccaaggcaggaggattacttgcagccaggagctcgagaccagcctgggcaacatagtgagatcccatctctacaaaaaaaaaattagctaagcatgctggcatgtgcttgtagtcccagctacttggaaggctgaggtgggaggattgcctgaacccaggaggtggaggctgcagtgagccatgatcacaccactgcattccagcctgagtgacagagaaagaccctgtctcaaaaaaaaaaaaaaagaaaggaaaaagaaatttccttttagaaagctgctcaattatctttacccttacattttgtcaagctaagtaaaatattctataaatttttctaccttaactttagttattttgtaaaactgttgtcccccccattagttaatacattcttaaatatgatatcttttatttattgtgtattattcactattagactaggttctttaaaaggtccatggcattctttagtcggaatctgtgaaaatccccctttttacaaaagtattcttgtaatgaagttagtttgtgactttctgttgacaagaaaatcagtataattatttactaattctctttttctgatctagacttccaaagcacaaggaacagataactctgatcaaagtgaaatatgtaaactacaaaatatcattaaggtaagtcaaattgttgattgatgatgggagttatacatctaaatctgcttattaaaagcataggcctgaattagtaaaagtctcagttataaaagtcattatcattatatagattatggtacttctttttcttttagagataggatctcactgtgttgccctggctggagtgcagtggcatgatcaggtcactgcagcctcatactcctgggttcaggtgatcctcctgcctcagcttcccatgtaactgggactacaggcacacatgccaccatgcctggctaattttttctgattttttttgtatagatggggtttgctaatggtgcccaggctggtctggaacttctagcctcaagccatcctcctgcttcagcctcccacaacgctgggattccaggcatgagccaacgcgcctggtccatttaaaaatatttttttttaatattctttattatttatgtaaagtatataaaaatctctgtctttccagaatcatttggttttgaacatttattacggagcttatctttcgtaagtctctatactctattgtatcttgtaaaaccgtctttattaaaacctaattgcagggttgctgaagtttcaaggtttagagttaaaggatatggacaaaataaaatactaatatcatgcattggaaatacttattttaccttagcggtagaatttcgctagtttgtgtcaattattatttctttaaagaaaagtcttagttgcatatattattgtggcagtgaattatttttagtgttaaaattattgtcagatatagaatttttagttttgggttcattattattacaatactagagtggatagaatccggatcagacctgtgtttgaatcctggctgtattatttacatgctatgctaatctcgggcaagttacttctgttttattatcaatggagaccatgataatacctatcttgtaggattgttttgaggtttaaatgtaaagctcttagcccagtggtggcacataagtaagaagttaatttatagattaggatctttttttttcttttttccataagagcatcaatttttctgtagattaggattcttggttacaagcaacaaaaaccatctctggccaagtaaagcaaaagaggatttactggaagaacccagggtagtccatccgcaggattgaaggaggagttgaatgttttggcctcaggttggataggagtgggaagagtgttaggaatctgggtggcgggacccagtggacagactcttgagagggcacctgtcctggtgcttcccgtcaaaccagtttccctagtcgatggactcagctcaagatccaggttcctgcgagagacacagtgggctcaacttgggtaggaaggcgccaggttgacagtttgggagtcccaataagactggtgaaaggaaaggctgagtgagaggatggaagtagtggaacagcaggtacagattggtcagaggggtgacactggtattggcagaaagtgtcattaggaaaaggagaagttcatggtcacagatattaaggaaaagacatttttacttatcgtttgttttagccttttcttgctgatgttccctcattagaagtagaaaaactgtttttgagacctaagaaaggaaagggtgaagttgttcagaatagtcctaattttgggtctgtgtttaaattcttttcagccttaacatgttctgagaattctttttaataatgcacacttttggacaacagttaaatatatagcttacataaatttattgattataaatgtgaataactttgtttttattttttaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggttattagttttatttctttattattattattttttttgagatggagtctccatctgttgcccaggctggagtgcactggcgcgatctcggctcactgcaacctccgccccccgggttcaagcgattctcctgcatcagcctcccaagtagctggattacaggtgcctgccaccatgcccagctaatttttgtatttttagtagcaatagggtttcgccatattggccaggctggtcccaaactcgtgatctcgggtggtccacccacctcggcctcccaaagtgctaggattacaggcatgagccactgcacctggccagttgatagttttattaatttaacatattagatgacataactaaatgatagacctagcattctaagaccaggacagtgctgtaaacttgccctaagttataaggaagtgtaaatgactagttctgcttatctgccagaaatttgcagtggcacctctgcttttaagattctgtggccgggagtggtggcttatggctataaccccagcattttgggaggccaaggtgtgtggatcacttgaggccaggagtttgagaccagcctggccaacatggcgaaatcccgtctctactaaaaatacaaaaattagctggacgtggtggtgctcgcctgtggtcccagctactcaggaggctgaggtgggaggatcacttgagcccaggaggcagaggttgcagtgagccgagatggcaccactgccctccagcctgggcaacagagtgagactccatctcaaaaaaaaaaaaaaaattctgtgaaaatggaaatgtcctttttacctttgtggtaaatagttataatttatagatttctttgcattgtttggtgatgatactttggtaataaatgattagagatattatcactttctttcaaactaagatacataggcctttatgtagttgattcaaatattttcccccaacttatttattttaaaacacttagtttattatagtaatttaacttttaagctttccaaattctgaactgtcttatatctcttagttgtatatagcaaaccgtttatttcttggtacttgacatttgatgtcattgttttgtgtttatgttctaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctggtatacagtctttggaacttatttcagattgctgtttcattgcatagtagttgtttttagagacagatgcttcactaactgaatacttagtggaaatggcatattcctggaaatgactgtgtgtcatttgggtagaattgtgtggtttggattcagtgtaagagttaatagattgcaaataggaatttcctattaaaaaggattaggtattgctatactttctgtaactcatcacagcccacatcctccagttagggaatacagcctttcttcttcaaagtcagttgttacctgtttgaaacgatctcctatatccaagcaaagccctgagtgcttagagccataggtcttccaccattttctatgctcatgatgatatttagttactgtaccagtattctgtgttacagaaaattagtactaaatgaaataggccaaacaccagtaaataaaataaattttaaagtaattgtacttacgttttaaaaaataagtttacttatttaaaaaataaatttacttacataagactaatacatttacttacttatcatattgggtgatccagatgagtttatgtgcttaaaagacaaacccactgccttagtccttcctcttttttctattccattgacacagaattacttcagccagtcataattgctttttgcctatgttaactatggcagctctctgaatggagcagaatagcgtagtggttaaggacatgactgggttggaatcgagctctatcactaattagctgaccttggacaggttaacatctctatgcattggttatttcatctatagggttgggataataatggtatcttccttgtagttttagtaatgaggattatatgagttactttctgccgctctttaggatagtgtctagccaatagtaaatgttgaagagttagctttttttttgtttgtttttttgagacagagtctcgctctgtagctcagactggagtgcagtggcacgatctcggttcactgcaacctccacctcccgggttcaagtgatgctcctccctcagcctcccaagtagctgggactacaagcatgtgtcaccacgcccagctaatttttgtatttttagtagagacagggtttcaccatgttggccaggatgatctcgatctcttgacctcatgatctgcccaccttggccacccaaagtgctgggattacaggcgtgagccaccgcccccagctgaagagttagcttttaaaattctctgttctccatgattccttcaatctatttttttcattctgcagccagaataatttgtcagaaatgcaaagcaggttactcccctgcatttagtactttatagctgcctgtgaacttcgggatgatgtttaaatttcttagttagacatgataatgtctctcatgatctagttcctgcctatctcttcagtttcaactattcccatgctcctgacattctaaacttgaaccatattgaattttctatagctccttaaagcagcaatgttacctcttcactctgttacccttgcattttctgctttctctgtgtggagtgtctctatggctcttttagccgactctcagtatattgattcagtgcaggtattaacctccactgagaagtacctagcactgccacttcttggccccatttgctcctcctaatctagattaggtgtttaccctgtttgttctcatagcacctcgtgcttgctctgtcatactatgttataatcctgtgcttactagtttttcttcctctctgaattgtaagctcttcgagagcaagggctaaattttaccagctttttgtctagcacctggcctcatagtaaatgctaaatatttcctgagtgaatgttgaatcaatgatttcagctgtgtttttttgtgtaccctcttctttttatagatctatctataataccaaattgaatggtctttttctcagcattcatatctaaatcacgttagataattgagagattatggtattgtggtggtttaaatatacataataaaatactacttttaaattgttttcctccaatcttaaaccatgtactatttcctgcttctcaaatgaatcaattcattttgaaacctggttgtcattagcatttttatcaaggcaataacttgtgactcatctacaatacaatttcaattttttcttatgcttatccatagacttggattttaatgtggtttttaactggcatttacattatgatttatttgatatgacaaaacaggaatacaaatatatgtttcactcagaactgttactgcttgccagtggtgcttatatacactttaattgggttgcatttctgagtttaatattgaagataataagttactctaaataattttaatgtcaagttcatttgctgtttttacagatgccgaaaatgaaataatgagattgagtagtttaaaccaggtaaattaattttgacaaatgttatgtgcatagagacagtggaagcagatcctataccaagtgagaaatgagttttaattttccttaagagattcaaagagttgtttctttttctaataattagaagttattttgtaaatatatttttatatttttccaagcataataaggaagtcttctgtaagagtgtcgaaaatgcatgactggtttcattcgttttagacacttttataagtgttgcattcttttttttttttttttttttttttttgagacggagtcttgctctgtcacccaggctggagtcgcgatctcggctctccgcaacctccacctcccaggttcaagcgattctcctgcctcagcctcccgagtagctgggatgataggagcgtgccaccacacccggctaattttttgtatttttagtagagacggggtttcactgtgttagccaggatggtcttgatttcctgaccttgtgatctgcctgcctcagcctcccaaagtgctgggattaacaggcatgagccaccgtgtctggccaagtattgcattcttataattactacatatcattaaagaaatactgaatagaaacacacaattgtatagattgccagcttttttataaactggaaatttcttgttacctgaaaacactgctttaacatttttgtaggataacagtcttgctgaagacaatctgaaacttaaaatgcgtatcgaagttttagaaaaagagaagtcattactgagtcaagaaaaggtgggtgctgtaaaaatgggggcagaattaaaatggtatgtgtaacaggtcacagccaagggccagttgatatccaaatggaatgttgagtaattgagctcaagtccttagaataaagctgatctcactgatgcttttcaggctaggtggaagtacctgggtaaagttcagagtataagtggctggcttgagttcgtatttagaaataagctagtaggcacacagaatcaagcagaaaagataggtggaggtcctgttttggtttctgatgatgtcctgacagcaggaacatacacaggtaggtcaggaggtctggagtagcatactgtaataactgtatatgctgcttgtgtgcttcagaatgtgtccattttggtggacagtactttcttagtggtgaggcataaagagcaacagtttcagtggtagaaagaagttctatttttttttttaatgagatggagtttcgctcttgttgcccaggctgtagtgcagtggcgcaatctcgggtcaccgcaacctccgcctcccgggttcaagcgattctcctgcctcaacctcctgagttgctgggattacaggcgccagccaccacacccagctaattttgtatttttagtggagacggggtttctccatgttggtcagggtggtctcaaactcccgacctcaggtgatctgcccacctcggcctcccaaagtgttgagattataggcgtgagccaccacgcctggtgaaagaaggtctttataggggtacagagcaacagtttcagtggtagaaagaagggctttattgtatgtattcatagcaaggaaggaataagattctgaaagggaaaggtatttagaagtatttttatgtttgaaccactttggggaaatttcttggctaaggcaggtgcttaaatataggagagttgtaagctagtattattaagttaaaggccagtgtcttaatttaaattcctaattttaaaaagtgatgcatattttctgatatatgtgttcagaaaacatacatactgaaaaccttcggatagtacaagtagagtatcttttgtacctctgtggcttggcctctttcccagaggcagtctctgttaccaatttctagtgtttctttctggactatgtctatgcatgtatgattgtatgtatcagtagctttaaaaaatacaaatgtcagcatattataaatatcctttttacataccatatttccaacatctttccacattagtatatatgcagtgtttctcaaagggactgctattggcatttaagcaggaaaattcttagttgtgggcactacactgtgtattgtgggattcttgctgccactctttctacccactatgtgccagcagtatctcccagtcgttttaaaaattactatattatatatattttatctttcctgtttttgctcccattgtattctgctctttacctgactgacctagtcgtttgtagtttgcagaactctctgcacttacctggcagggcctgtaaccttttcatgatgtgtttggtttctgtagcttgtcctgatagctgtttctcctttcttttgatgttaaagtagtccattgtaactcttccttgagttgtgtctgcttactgattaagaataccaaaagtgcctatgagggccgagtgtggtggctcacgctgtaatctcagcactttgggaggccaaggtgggatgattgctcaaggccaggagttcgagaccagcctgggcaacatagtgagacaccatatctacaaaaaaacactaaataatttttttaaaaagtacctatgaggctgtgtgtgcttttaagatctacctaaagaaaatgtctgtgattctcctaatttgaacagataactttagaaagacttaagagaatgctgtttccatctttcagctgtagttagaataaatttttgaattagaaggaaataagaattgtgatacagatactctagtatagcttttatcggatctctgttttttcaaccaactctccatagcaatgttgagtttcttttataaggtttatattaggctgtttctttgaaggaatttgagattcttatttttttaattttattttttagagagagagagtcttgctgtattgcccaggttagagtgctgtggctgatcatggcatgatcatagtgcactacagccttgaactccttggctcaagtaatccttctgcctcagccacctaagtagcctcctgggactatagataaatgccatcatgcctggttcaatactctatttaaagtagattccatatgggtttgatttttaaaaatctgtcaatgaaagaaggctttaatatatagtttattacaaacatcataactagagactgaaataatgttgaagcatagagaactgtcccacttctgagattttggagaaagcattaaataccaggtagtagactataaaatgtatatatactatctttaggaatgtcaggtgtgacagaggggaacctagtctggttaaaaggtaaaggaaggaaggaggattctttctagggtcaagaaaaagttccatgttctaacagaagcaaaagtaataagggaaattcctttagtaagagaaaagaaaccttttattttctaattagagaggctaaacatttgggtgaaggagtgttgattttttatatttttatttagtctgaggctgttgatgactggatgttagagaatggaagtgaggaaggcagaaagacttgcggacattttggaaagtatgtatgtatggtaggtggggccaggggatggataaagggtagccacggtggagcaggataggagaggctctcaaatgggaacgttttttataaagaagaacttggtgctagaggacaaacttacagtcgctgcatctgtctagggttatagaaatgttttgcttgaagctacaagtaaaattgcacatgaatgaaggatgtggtttgttgaatttcacatacaattattgaggtattgttcaatattatttccaatatagagcacttaaatagaatcccaagttttgcttctatgtatgtttttaatcttttggtgtctccaattgaaagtatgtgttgcttttttccttttatcatttcaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaaggtaacactgtattaaatacagtaaggcagcacattctactaagtaaactaaacacagaaatggtgggtgtgatttaattaatattttagttcatagagattgacaaacctttttggtaaagtgctagatagtaaatatcattggccttgtaggccatattgtctcagtctactcaactctgttgttgtgataccaacaaatgagtgtgaccatgtttcaacaaaattttatttacaaaacaggcagcatccctgagttggccaatggctatagttcgttgactcttactctagtgtagagttaaaaataaacaacatgccgggcgcagtggctcatgcctgtcatcctagcactttgggaggcagagacgggtggatcacgaggtcaggagttcaagaccagcctggtcaagatggtgaaaccccgtctctactaaaaatacaaaaaattagccggccgtggtggcaggtgcctgtaatcccagctactcgggaggctgaggcagagaattgcttgaacccaggaggcagaggttacagtgagccgagatcatgccactgcactccagcctgggcaacagagcgactctgtctcaaaaaaaaaaaaaatactatttaccatctttggttttaaattcttatccctaaaatgctttaagaaatgacaagatggggccaggcacagtggctcatgcctgtaatcccaacactttgggaggctgaggcaggcagatcacccgaggttggaagtttgagaccagcctgaccaacatggagaaaccccatctctactaaaaatacaaaattagccgggtgtggtggcgcatgcctgtaatcccagctactcgggaggttgaggcaggagaattgcttgaacctgggaggttcaagaggtggaggcggaggttgcggtgagccgagattgcgccgagccgagattgtgccattgcactccagcctgggcaacaagagcgaaactccgtctcaaaaaacaaaaaagacaagatgggtttgctgtaaaataataataagtaattttgtagtgggtgtttttgatagaaaaacaatgtttttaagaaggattagaaatatttgaggattattttctattatgtatgagattttataaaattttctttgagtactaaaatgagaacatgttgtaaagtcaccatgcaaatttttctttcagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacaggtgtgttctggatggagtattgtagaaggaagttgggggtggaggagactttttttaatgttatttcatttatattgtctttgaaggggactgtgcatttgttcatttagaaatatttatttcaaggtgtgattcattctaagtaaattttcctcagagacatctggaagttctccctcaaattgttagatatttccaaatgcttttggtagtaaattaattttttacagattgctaagtagtacttaatatttttctttaggaaacagatgtgtctcatgagagaattttgaagttacttcaatttaatcaaattttaggtattacagtagctgttaacattttagagattcttatatataaggaaagcactgtaaaatacacatatgtctttaaccatctgcagtaagaaatacatttcacgttgtgacacagtaagagtatgtatgtgtgtgtgcgtgtgtgtctaactgaaaagtttgaggaaccagaaattgctcttattacgtgtgatactctgtttgaaaaagaatgtgctggctgggcgcggtggctcatgcctgtaatctcagcagtttgggaggccaaggtgggtggatcacctgaggtcaggagtttgagaccagcctgaccaacatagtgaaaccccgactctactaaaaaaaatacaaaaaattagccaggcatggtggtgggtgcctgtaatcctagctacttgggaggctgaggcaggagaatcatttgaacccaggaggcagaggttgcagtgagccgagatcatgccattacactcctgcctgggtgacagaacaagactctgtctcaataaaaaagaaaaagaaaaaaaaaaaaagaatgtgttattcaggtagagtgacttgggttagaaatttttttaaaataataagaaaatgtgctgagtgactcattaaattgatttttatgtattgattagtcacaacctggaatttgaaaagtattagccatgagtaatacttttctcatagtaggctcagtaaatattctaatcccagttctgtcactgatgtgattttgggtatgttttgaccttattggtttattcagctataaaacaggagttcatagcagttatatggatagtgccagtagcttttgataatatttaaatttttatatgcaattcattttagtaagaattattgaggatttcctgttacactgtatactatactgtactatatgatagtatagtgtagggcttgtttggcagtgtatagggtgctgtgtagggtttgtttagtagtgcctttttactgtgatttctatgcttttagtagcagaaattttgaaaagagatgataggcaaaacaataaaatattcaactagcacttcttgagcattacttgctgccaggcataagatacaaagtgattcaacttcatttgccagttaggttccctcttagagtcttggattaaagttgtgaaaacttcattttttcctttgtcatctgatgaagtaggcacactgattatcagtgttaaggtgttcttctgagataacttcttagctttaatggtactggtctataattgatgtgaagagagtcctagaggctagagcttcctattgttcactagcccaaattggctctagcttcttaaggttataagagtagaacagaggaataaagtacaatgatgtcttctgtcatttatagatattttggagttttagcgttttgtacaatttagttctatttcattgacctttgcagatctaaagtgtgcagatattattaacactctcctcacttttaggaagcttccctaagttagctaagtggtacttaactattgtattacttgagggtaattagtgtaaactaatttcttccaatactctgtatataatataaaagtacctttagattatatcttgaatataatgagtaacatctttttttagggagaaaaggatgttctcaataggagatattcagatctatttaatttctcaagcatttgctctttctttgtagtgtgaaaaaaaaaaaaaactgaaaaactatttggaaaatattggcctccctatccagaagtgttaatattaaaggaacagattgttttatattttggttataatgatttatcctgggggatacattacatattcttaaagaagtggaaagtttacatgaaaactaaaaatatactaaactgtaaataggttcataagatatgcatatttaaaatggagaaaagaaacggctgtagaccgggcatggtggctcacacatgtaatcccagcactttgggaggctgaggtgggtggatcccctgaggacaggagttcgagatcagcctggccaacatggtgtaaccctgtctttactaaaaatacaaaaattagccagacgtggtggtgcatgcctgtaatcccagctacttgggaggctgaggcacgagaactgcttgaacccaggaggcggaggttgcagtgaaccgagatcgcgccactgcactccagcctgggcaacagagcaagactccgtctcaaaaaaaaaaaaaagaaaaaaaaagaaagtggctgtaaagcagcctgacacgtttttgtgctttttagaatttcagctattgtctgaaacttgtggccctacttttgcagtgaagttactttctctcataacaattgtggatactttatgaatggacagcacgcacatacgtgtgcacacacgtacactttttgttgatttgggggttctgaatactttgttgtatagggtaaatttgaagacatttttgtcctttgggttccttttaaaacatttctaataaacttattcttttagaatagttttaaatttatagaaaatttgcaaagataggtctcatagacctcatactgagttttccttgttaacatcttacattgttatgaggtatttgccacagctaatgaaccaatattgaggtgttactgaactaaagttcatacttgactcgaattccttaatgtttactaaatgtccttttcctgtaccggcaggataccgctttatattcattatatttagatgtcatggctccataggcttctctagattgtgacagattctctgacttttttggtttttcatgactttgacatagttaactacgtttttaaattaactaggagtctctctgagcctactcagagagtaaatcgggaggctgccctatttaaaaattaaatgaattaataattgagtgaagaaaatgtctcttttaaaatatgtgtgtgtgtgtgttttttaaagctaaaattttttctttccaaaagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggtatactttcactttaaaagaattatgaatcaaacaataagtttaataactattaagagaactggaaaggtgatcagtgaaaatgaatttctctgttaggtgatttttcttattcttcctctgctgtgcagtagtaaaattttaatctcccatggtgcattttatttcagtcttcaaaagtgaaaatcatggcatatctcggatataagaaaaattgcccacccataaagtgtgaaaaaaatgagatttgctgaaaaagtggcctgtcacaaagagtactttatacagaatgaattttataattccattttccattatagccacaggggaataagattctgggaagtaaagcttccagatgcatattcaagatgatttcaagataattttttcctagcataaatacattttgcagtatgagaaattggtatacaattaatatcttcaataatgggaaaaagatttgataacaaaatggtttgtagcagtggaaagggagcattttgtaaaagaaaaataatgtcctctacctaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaaggtaattttttcatttttttgcattaactttaactgaacacttcttaaatatcagactcagtaagtattttttgtatgttagctcatccttgcaaaattcattatctgtattttatggatgaagaaactgaaggtaaagagattaaataacctgcccaaggtaggcactcagagtgtgtgtgggggtttcacatttgagtctgtgactctttagatctggcattcaaactgtctgtgttttgaccatcaccctagatcactgcctcttaccattttaggagtatagtttgaaattctgactgattttaattggctctgttcaactccaaaataactatttatgtggttgtatttttcatcaaatgatcttaagttgaacaggatgtggatgttagcaggaagagagtaaaggaagtagcagagtagagaccaaggtcagtatgaagaattaactgggtttattagcactcttgagtgacccggtccctgtttatatattttagatttttatttctctcaagaaaacttttttcttgtttttttttttttagttgtaaaaaggttatatttttcatgtttaggaaaatcacacaaatcacacagagccccacatgcccagagataatctttttgtgtgcctttttatacttttatgtctgtgtgtatacattatataccctttttaaagcaaaactgagattataatattcatactgttttgtaatctgtttctatcaataatatgaatgtcagtacatgttaagccatgtatgtttgcaatattttgtggctacataatatgccattatttggatttgccatgattaacgcagtcatttattatgtgttttaacttttcaaaatcactgagtgttgacatgatatcccaagacatgtatttttgtgttgatgacagattatatccttagggtaagttttgagaaacggaacttctagatcaagaagcattttaaaacttctgagattatactgccaaattatttcacaaaaaattgtgtccatttgtattcctattagttgtatatgcatctttgtatttatctttttactatttatgacacaaagggagataaaatgagataatcatttctatctgtctgcaaataaattataggctagtagagacaatattcctgcgaattaacccctaccccacctttgcagagtatattattataccttcagactcagctggaaaacttgtttaaaacggggattaaaacaatgagtgatcatttggctatatgtttcagtttggcagaaatgctgtaacattctgtattctcactctttttttgcacttttcaagcccttattttctcttaattaaaatagtttctagtctctgcacttttcatttatttttcataataactttgagaataaccttccttacatagaggtgtgatctttttactccttttttcaaaaactggtcttgactcaaggatggtcccaggctcctaccaccttagccttatttcatgttatcagctacatccagccaaactgtattactcactttctcagagccactgttttcctgtttctttttcttctgctttttcttttcatatgccttcttctgcctgaagggtgaacctgatcccctgcaagttgttctatgaatcttgcctattcttcaattccattttcttcctaaagggtgctttatttagcaccccacttgtcatatccaaaaacaaatcttcctggtgtgatgtttttcctttgaacttgcataatatttagtttgagtcttatagtttgagggcacttatattttaatttagggtacaggtaattgtcgacgtgtcctatactgcctcccacccaatgaaatgtaaagtcactgggaggtaggaatgggctcattcattttctacctatcacatagcatatattacacagagtttaatagctattcagtaaatacttgttgtatgagtaactcagatctacaaaccggattatggtggtgtgagcccttacttaacaatagtaacacctggtatttattaacttctagagtgccatcatagctcatttcattcctacaatcacccactgagtgattgctaaccaacaaagttgaacaaggtccagagatatttgggagctgaatttagatcttctgattaccaacttgtgctctttccacaagagggtgctaatgggtaaagtctcttcaaaatgagttgatcctaatgagctttaatgggctgctcttgaataagaatttaaccggaaattaaaacccctgggagactattgcagtattttgaatgtaatcattatacattaaggaagtacaccagtgacataagcctagataggtgctttatctatatctacctcttaggactctctggagtcagagatagaggttattgtgtttaatataggcagaaagatgatagtaaaagataactaatattcagagcagttcatcagtgggatagcctttggaaagttgtgaattcaccatgaatacaagggggtcaaaggcaagggagtgtcatagaatccattttgtattaaattgggagctggacaaaatgacttccagggttccttacaaaacattttatgataaattacatcttagagttttagcctggaagcacaaaaattgcaggctattcatttgtacctttttcttttatttgtagtttttagagacaggatctcactctgtcgcccaggctagagtacagtggtgtgatcatagttcagtgcagcctcaagctcctgggctcaaacagtccttttgccttggcctctcaaagggctgggattacatgtgagagccgcctcacctggactacatttttattttgctgacttttcttatttaacttaattcttagtctttaaaaggactgccatttgttcaaagtcactttcacaggaagagtgattgaatttacaaaaacagggcaacaggtaccagaagaactcttcaagtttctttgaaatttaacttgaatttaatgcaataaagtgtaggaaagatcacattaacagagatagatagtaggatggtagttttcaagggaaaggggaattactatttaatgggtatggagtttcagtttgagaaggtgagaaaagttctggagatggatggtggtggtggttgtacaacagtgtgaatgtacttagtgccactgaactgtacacttaaaactggttaaaatggtaaattttatgtatattttaccataataaaaaatgtaggatgtttcatcttattaaagtatctaaatactttgaaatctaacttgaatttaaagcaataagaggccaggggcggtggctcatgcctgtaatcccagcactttgggaggccaaggtgggtggattacctgaggtcaggagtttgagaccagcctggccaacatggtaaaacaccatctttactaaaaatacaaaaattagccaggcatggttgtgcacgcctataaccccagctactcaggaggctgaggcaggagaatcgctggaacctaggaggtggaggttgcagtgagctgagattgtgccactgcactccagcctgggtgacagagcgagactctgtctcaaaaaaaaaaaaaagaaataaaataaaataaagtaataagatgtagggaaggtggcttcttcttgttaaagtatctaaatagatgaagcagtttgacttttattctttttgtttgaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaaggtaagctctacggtcactctttcaatgaagaaaaattgtagttattggtaattttgcctaatttgagagctattttagatgaggcacggggaaatctctgaaaggttacccactggtagaggggaagggtgagtagccatcaaaaagttaatttagactccttttacaattaagacgagaaaataaactttatttagtaattattaaaaatttgttttagtatcctattaccagtgagagatgagagttgaggaaatacaaggaaagatgatcaagtaataaagaggagaatacaaggaaagatgatcaagtaatgaagaggagaatacaaagaaagagagatacgcacatacaaagaatagttaggttttaagataagggctggaggttgaacctacttcagataatcatcattaattattgttctttgaaatggtgattcacatgttcatagctattcatctatgctttgaggtaactacattttctagtccatatggaaggtgcttttttggagacacaataatagtaaccagagcagttctaccctgagaaacaaatataccttttcacattctacctcctatccttacatttattcactttagatcattcatccatccatttgtttattcatgcattcagtaattattgacagtaaattaactgctagttgtcggaggtgattaggggatatgagaatgaggaagtaacaaggacttgtagttttatgcctaagcaaaactttaaatttgtacctctgtgttacttcagggttgaaatcttaaattttagatataagaattcttgccgggcacggtggctcatgcctgtaatcccagcactttgggaggccaaggcgggcagatcacctgaggtcaggagttcaagaccagcctggccaatgtggtgaaaccccatctctactaaaaatacacaaattagccaggtgtggtggaagatgcctgtaatcccagctactcggcttgaaccctggaggaggaggttgcagtgagtgagccgagatgacaccactgcactccagcctgggtgacagagtgagactctgtctcaaaaaaaaaaaaaaaaaaaagtttttgaggtctactttacagtataatgtaattattagagtgggtatgtatacaaagcagtgtggaactgagactgtagagaaagtgttgccaaagaggaaatatttgagaagagttacgaagggagagaagaatctgcaagatagacaagatggagaagtgtttaggcagaggaaagtgatctcattagtttagtaccgcttaacattatcactaaggcatatattcttttctgtttgagacatttgaactgttttcgttggattattaaaatttaaaatggcttaacattctaacttaacacacgattgcaaaatactaatgttaactttcttttctctttagaggaaaaagctatgtattctgctgaactcgaaaagcaaaaacagcttatagctgaatggaagaaaaacgcagaaaatctggaaggaaaagtgatatcattacaggtaggacaaaatagttttctcttgtaggttttattattcatggaacagttacttgtagagtctttgtcttggaaataatctcctaaactgttcatttagtaaattttctaccctgaatccagccctctgctgtagcctgacagtgaacaagatacccaggatttccctaaggtgtcatagtttagagtagacacggcaaatgtaagatgacaggacatttaaatttttttggcacatagaggtattttagaggtctccggggaaaaaacacccaaattaatctataatttaactttataattttctctctttttttttttttttttttttttgagaccgagtttcactcttgttacccaggctggagtgcaatggcgtgatctcgacccaccgcaacctctgccttccgggttcaagcaattctcctgcctcagcctcccaagtagctgggattacaggcgtgcaccatcatacccagctaattttgtatttttaatagagatggggtttcaccatgttggtcaggctggtctcgaactcctgacctcaggtgatctgcccacctcagcctcccaaagtgctgggattacaggtgagagccactgcgcctggcgtgtaattttcttttttcaacaaaattttaaatttgtacctctgtgagcactcatttcacatggattaaaacaatatatattatcccattaaatctttttttttttgtataataacatcctttaaaatatttttctattccatctatatttcacacataggacaaaaattatatataaggaatatataaaaatgaacccctatgaagagataggacaccaaaacaacgtgcttttagatttaggagaaacttgtcttttttttttttttttttttttttttttttttgagacggagtctcgctctgttgcccatgctggagtgcagtagcgcgatctcggctcactgcaaactccccctcctgggttcacgcctttctcctgcctcagccttccaagtagctgggactacaggtgcccgccaccacacccggctaattttttgtatttttagtagagacgaggtttcaccatgttagccaggatagtctcgatctcctgacctcgtgatccgcccgccttggcctcccaaagtgctgggattacccaccatgcccggcctaggagaagcttttctatgtcataaatagactgtcaataactggtagaaaatgataaaattcatttacctgacattagtggaggtaattatgctgttcttcaggaacattaacgtcccaagtaagtgaagatatacttcctaataaagttttaacattttaattaagtattaaatggctgcaaaacaatttagataatatgtataaaatataagactaacaatgcagcaaatacccacactgtcaccacccagtgtaagaaataaaacttcatcctttgaagttccttatgcaccccttcacatcccattctcatcttccacctcttaggcaaccactattccaaaatgttatgtttattacttccttattttgtttggttttcttttttctttttctgcttgttttctttatggttcttatcacataggtttgacgctccaaacaatccattgtttggttttgcatatttttgaagtctatgtaaatggaatttgaactatatgtaaattcagtaatttttctgagacttgctttttttttttttttttttttttttgagacggcgtttcgctctttgctcaggctggagtgcaagggcgtgatctcagctcactacaacctttgccctgggttcaagtgattctcctgcctcagcctcccaagtagctgagattacaggcacacaccatcacgcctggctaatttttgtatttttagtagagacagggtttcaccatgttggccaggctgttgttgaactcctgacttcaggtgatccatccacatcagcctcccaaagtgctgggattacaggcgtgagccaccgcacccggctgagacttgcttttttaaaaaacttaccatagtgtttatgagattcagtcatattactgtgtgttactgtatataggcgatttgttattttcacttctgtatgcattgcattaatatataatttacccattttattaataaagggtatttcagatatcttctaaacatacaagagtttttttagatgtatatcttgattggaattgctgagttataggacatatatggtcaacttcagctttattagatgattaattgttttctgaagtggttgtgctaatttactcccactagcaggcacatgacttcttgttctacatccttgtcaacacttgacattatcagactttcaaagtttttgacaatctgatgggtaggaagtgtcttagtccattttgtgctgatacaatagaataccacagactggtttatttataatgaacagaaacttagtagctcatgggttctggaagctgggaaatccaagattaaggtgccagcaactggtaaacctccttgctacatcatcctgtggcaaagagagggtaaggtgagagaacaagagggagccaaactcctcctcttgcaaggaacctacttccttgattatgaacccactcccacaataaggacattaatctattcatgagggtggtgcccccatgaaccaaacacctcccatcaggccctacctcccaatactgccacattgggaatcaggttttcagcaaatgaacttgtgggtatacattcaagccatagcagaagggctgtcttcctgtggttttaatttgcacttccctaattaccagtgaggtcaagcatcttttaatatgtttattgaccatttatacttactttcttgtcagctcattaatacatttaaaagatgtattttatctaatactcttagtggtttctagtggatccagagtatacagtctgtggaactgctagaatggaagtccagatcttcttctcttttttcttagagacagagtcttgctttgttgtccaggctggtctcaaactcctgggctcaaacagtcctcctgtcttgacctcacaaaatgttggaattacaggcgtgagcctctatgcctggcatttttttcttattttaattagagatgaaatcttgctatgtttcccaggctggaatgcagtggctcttcaccagtgtgatcataatagtgcactacagccttgcatttctggactcaagcaatcctcctgcctcagccttttgactagctgggactataggcatgtgtcacagcacccagccaaatcttcttttaaaactagttttattttttaaaatttaaagtgtaatatacatttaaaagaagaacaaaataaatgagaagaaattgagggaattaataaaaataaaagctgtaattaatgaaataaaaaccaaacaactggtagaaagaataacaaaatctaaatgctgattttggaaaaaatctaagcgtagatttaagctttaataacttcataagtacaaatggtgtgggttaaaaaaatcatttgaaagtttacatttccttcacactaaatttagttttgtggatttttgaatagtaaatattttatttaaaattttcaatttcattccctctatatatcaatcaggtttcagcccctaaaagcaggatcagtagggtgtgtatgtatatgtgtcaaatttatatattgatatatatggatacacacatgcaatttattacaaggaattggctacaagattgcagccgctggataagcaagtctgaaatttgtagggttggcagtcaagatgggaagcccacatcaaaggcaggctggaactcagcaggcatgggccaaagctgttgtccacaggcagccaggaaaggaaagtcacaagcaggatggaactccataggcataggcggaacctgcggtccaaagaaggaatttcttcttttttagggggaaggctaaaccctggcttttaagaactttaaaactggttcagtcgggcccacccaaattatccagaataatgtgcctttcttaaattcaactgattaaggactttgattacatttgcagaataccttcacagcaacatctagatcatatttgattgaataactggggactgtgacctatccaggatgacacagtaaaaaggctatcacactgattgaagatggcaaaacttgaccttaaatttacatgggagaatacttgagaatagccaagaaaattatgagaaataatgcagtgaggagagacctgcctactagatgtcataatagagccataaatcgatacaatattgactagattagtggattaaggagaatccagaaatagagcccaggatatatttgagaatttgaaactaaaacctaaactaatttaatgagaaaaaggatagcttatctaattaatgatgttgataaaaccagctgtccataggaaggaaggaaaaaaaaacaacagaccctcaccttacatcataaacaaaagtaaagtctaattgtattaaagcagggattttcaactgggagtggtgctgattatctggggatagatggcatttattgggcaaggaatgccaaagccactcccattaagaaacactgtgttaaagatttaactatattacaaaatatcttgtaataaaatctggaagactacatttacattctaagggcaaggaggatcctaaccaagactaaaacttaagaagctgtaaaagcaaagtagaacatgtttgactatatagtatttaaaatgtttacatgacaaaagatattatagagtcagtagaaaaatggcagatatggtaacggtatttgcttagcacaggtgaaaaagcttcatatctgctatacaaggtgctcttacagatggacaggagaaatagaactcagtagaatcttgggcaatgtatgcaaagaggttttcacagaaggacagatccagcttgccctgtaaacatgaaaagtaatgctcaaattcactagtagtggtcagggaaataaaatttaaagtaacaaagtcataatcaacatcactttattagactttcaaaaatgaaaaagagaacatttgttgctatatttctggacttcctgtatctttgtttttttgtagtttatgttgttacttttttttttttttttttttacttctgtcatcatgttgtctttcagtggcatctgctctttttatttagttcctctaaatgaggcagtattgtattgaaaagaatgtgggttctgcctttgatacttattggttggatacatttgcccaaggtcatagaggtgcagcttcaccagctgaaatgtagaggttgactctaagatgtctctcagccttatagtttgtgaaataatttttgcatacttttttttaataaagttttctttctcaggaatgtttggatgaagcaaatgctgcattggattcagcatcaagacttacagaacagttagatgtaaaagaagaacaaattgaagaacttaaaagacaaagtaggtttttttcttttcatttttcccccactacaatactgatattaaatcaaatgtagtcttctgtcataaattggcatagttgagtgagaccaacttcattgatgtgtgacttccatttgtatcttccctgactgacttgcttcaatttaagtatggtcctagtgaaaccagagtcattaagttggccctggctgtccagttagttttcctggatgttgaggcaatgccattgcattggctgtcaccctgttgaccatcagaggggttgattggactgatttgactttttatggatatgatttctcccttatcagttcacgtgcatcttgcctaaggccatctgatctgttagagaaggcagaattctcaaataaaagagcaactttctgtagaatgaatgtctgggtatagctagatttttatgattgtagatggtgttttaccacaggtgcatcatgtattttttgatgtttataaggtgcctcatatgccctgtccataccctaaggtatgtcctatgcttaggattattaattggttcagtgatcaggtggcttacagggctttgttgaatccaacagctgacaaagatggcatatcctcatttcatctctgatttagaggcaaccaggaagtcaaaactattctagggctgcatttagtaggtaatgattcagggttattggaaaggtgataacggagcctagaaatgcatcaactttagatgtctaggttaggcacaatagtaacaaggcatgtagttaagaaatacataccacctaacatgaaattagaaataagcaaaaatagaaggagatggtacagcagaggagctgtcaacaacagaagcagtgacttagacactagggaggcaagccggcaggaaccactgacgcatggagaccaaaggacaagccaaagtaagctggcctaaatccagcaggagacaggacaggggagatttttaggaatacagagaaaaaaagatagatgtgaagtaattgtcctcaaaatgacttgattctgaggcaagttactgccaaaccaaaagtcttctaccttgtaagtcttgaccaggctaggatctctaaatctagtagagggcctgaaaatgggcagcaaggaaacaattatgtattgagtgtctattatggacatttgacataacatttatgtatttagtcttctcatcatttactttttataagcatctctaaaataagtggtattatccattttatagattaaagaggcaagatttgaactccgatctttttaactattaccataattcgtggtcttttcatgttattgtagccctatcaggaaaatggttatttatagtctgacttgtattttgttctgtatatctccagtttcccctgaaaatatggtagcatcttctgtattgtgccctaacgttgaaatggttgcctttaccaagagcagtatttatttagaaaacagtctagttagatcgaaggccagtgcaactacaacattatctggaagacatatgggcaactgagaggagacacactgggaattgataatcttcgggttgggctagactaatggaggtgaaacagcagtgttgtgaaccagctcattgctttgtgacaactcagtgctatatgttatgctactataatatctaaggccacatcctcttttagacacctacctaagtaattcccaatagttgatggtaaatttaaaattctaagatttattgtagttaataaatattatcagagttcttgaaatacaggttgagcatccctaatccaaagtctgaaatgctccaaagtctaaaactttttgaaaggtgacatgatgctcaaatgaaatgcttattggagcattttggattttggatttttggattagggatgctcagccagtagtactataatgtagatattccaaagtctgaaaaatccaaaatctgaaacacttctggttccaagcattttgggtaagggatactcaacctgtatttagtactttttcagacactcatttaagcccccactagtagaatattttcagatgttcttgattatagatgataaagcttaggtggaaaatactaatattcattgtaaacgtatacgaactttggattcattttgtggaatcaatattagctacagagaaagctctgattatgcttgtataactggtatttgaaagggcaggcaagaggccagtgttgcacaaacaggaaggggtgtaaagagacagttggttctgttatgtctgtaagtcattcttgccatttacagctcttcttaacaatctgttttcttatattacctaagtgctttaatatcacttttatatctctaaatacaaatgcaattttattttctcaaagctgcactcttgatttgataatgtaaacaaaactttgattagctcacttgtttcaaaagaatcgctgtatattttctctcctagatcattaagtactttaaatgttgattgatgttgtaatactgtactttatttttaacacaaaacttggccagacagcaaaaatatttgccaggagaaacaattttgaaaaagacagattgccttttgttggaagaaagtacatggagacttgaatcgtaaaggcaaagtattggttacttctaagcatctgtagactaatgattaattgatacacagtttcagcatttaaacaatattaggaagctcacttttaaaagtattttattccaaatggttgattatatcattgctaccagagatgagatgattcagtctggtcaaacatatgaaaaagagagctgttgcaaataatgccaatattgaaacagtagactgttgataatttcagtcatttcttaagagtatgtatgtgcatctgtgcttatgaattaagagtatttttgggccttgtgtgaaaagtatgaagacagatgcttatcaggcactaaatatttaatgagaaccaactacttggcttcccattaggtgctatatgagatactagatagtatcccttttccaaggagtttagctaaggaaatgacacatcgtgtagataccccgtaggttagtaattgaagacagtgatgcacaacagtgatcataagacagggcatatttagttcctccagaatcccattaagggtcaggcagcattccatggagaaaaggaacttgagtagagacataaaccagcagtagggaactgtttaaatatttctccctgtctccctccccctctatccctcttcccgggaaagtaacgaagaaaataaatcctacgatcctaagtactatagtttaatagacagtgttggctgttaaaagaattactgctatccttccttttaaaaaattattctttcagcattttacctgaaagtgttcttcaatacagttccaaagacttcacatgccatcccatatccaaactcagtagagtggcctatgaagcacatatgacagtggttttcattaactactctgagctgatcagagttcagaattccatggaattgctattgatgagaaattatacacctgtgactgaaccattaaaatgcattatcttgctatatttatggtcaaatttgacattttcctttccttcttgttctctgccatcatccttgacataaattcctgctaattgaaaatgatttggccggacgtggtggctcacacctgtaatcccagcactttgagaggccaaggtgggtggatcacctgaggtcaggagtttgagaccagcctagccaacatggtgataccccatctctactaaaaatataaaaattagccaggcatggtggctcatgcctgtagtcccagcttcttgggaggctgagccacaagaattgcctgaacctgggaggtggaggttgcggtgagttgagatcacgccactgcactccagcctgggcaacagagtgaaacttggtcccaaaaaaaaaaaaaaaagaaaagaaaaaaaatgattggataaattgaaataaaaagcacaagatattgttattttgataactatgattcagaaaggtggtgaattttatggtgtgcaaagaaaagtgagttttcataagcaatacaaatttagttctaacatcaggaagatcttttggtctgtctgctagtttatacctgtatctgaaagggcagcataactgattttttttttaagaaggttgaatgactacttttaaaagtctcctaagagttgagaatggaaaatttccttggaccattttttaaaagaaaatctagaagaatgtataaaatgagtcccagtaaaacttactgtaatatgaagcataaaaacatgttttaaagctacagatataaaagaagcttaaaatatttttcgtggaactacctttacggtgctggatggtaaagtttttattttaaataaagacattccgttttccaggacatgatttatacaagaaaacatataatgtcctgttgaacacaggccaaatacattcccagacgctttgttacccaaaccttttgagagatttctttatagatgtttttggcagaagtggtgattttagaggaaacatataagaagtaccagatgcagttttctgagttgccataaatggttaaaaaattattttgatgatataaacatctgggtatactagacaatgccaaaatatgagttaagaaaaaagtgtatgtcaattaggtaaataattaaacctttttcaactgaactgtattttagaaattgcagtttaaaaaaattcctctaagtttaaagggaaaagtaaatgatatagcaataagaatgttttgagttaatgtgttttgtgtccttgcccttatttctttatgtatggatgagttcataattcagaacataaattgttctttttgtccagtgttctgttctttgcagatattctcttttcccagagaaaatcaatcattatttgacttacttctcaaatattcattgtttatttgctgtgtgctaagcactgcagtagaactaaagatataaataaagacaggagacaagggtcctgccttcaggaggtttacagtcaggcaggaagggaagatgacatgcatcaaatacatgaaacaaatggtttagaaaggaaagagctatcctttgtacttggtgttggtagcatggaagggtagacaaggttagtgaagggctcacttgaaattacttgaatggtgaataggtatagctaagaaggcagaaagttggggaaaagtgttctagacagagggaggaattcctgtgaaactgtgtgtcataatctggaaactggctgaagatacagttgactagtaatgaccaagggtggtgggtatgtgtgcacatgcatgtgttggagtggagtgctgaaaaggtggaggtagaagtgggttgccgtgtggaaataagaatctcttagtatggatcacaaacacaaattgtaaactgaggctatgatgataatataaaagagcacatgaaactaggtaaagactgatcatttgaagtgtttcttatggaggcagcagattctcagctccgcccagctgctgccatgcaggaatgtgggcccagtgttgccatgtcttcagatctttgaagagaccctggatatctgcaattttttcatgaaatatctcattaaaaaattaatttcaacttgtggattcaagggtacctgtacagggttacttgtataggtttattactgcttgacactgaggtttggggtacaaatgatcttgtcactcaggtagtgagcatagtacccattaggttgtttttcagcccttctccccctctcccttttccccctctggtatctccagtgtctgctgttcccatctttatgtccgtatgtacccaatgtgtggctcccgcctgaaagtaagaaagtttgtaacacttttaaaattaaatatatattctgtctcacatgccagaggagtaacaagtatataaccactcataatatttactctttttaaaaaattagttctgtttcaatatggagaaatatagttcagattatctgaattcataataaagggttaaaggaagagaatggtgaggaaaaataaatttgatttggttatattaaaaatatttatataaaatcaagtgtacatagtaactctggtgaataatccaaatttggtctacaaataatccagtagacctcaaccaatcacagattctgatctagtggaattcagattaatgaagttatactgtattaatataattcttttcctgtgagttcattgctaagaagtagaagtttatttttatttttaagaggcaggatcttatttttttttttttgtggagacggtttgtctatgttgctcaggctggtcttgaactcctggcatcaaatgatccttctgccttggcttcccaaagtgctaggattacaagaggcatgagcaactgggcctggcctagaattttaaaagatacttttcactcagcagtgaacaattatgattatgggacaacaaaacatttaccatatactctagaccttcaaattctgtgttggatacagttgaaaataattgagttaaaagacaaagcagggctgggcacggtggcccatgcctgtaatcccagcactttgggaggctgaggcagatggatcacttgaggtcaggagttggagaccagcttggccaacatggtgaaagcctgtctctactaaaaatacaaaaaaattggccaggtgtggtggcacatgcctgtgatcccagctactcagcaggctgaggtgcaagaaacgcttgaaccttgggaggcagaggttgcagtgagcagagggtgtgccactgcactacagcctgggtgacagagcgagactctgtctaaaaaaacaacaacaaaaaagacaaaacagatgcttgtaaagcttaacctcaaattgcaaatagtataatatcttttaaaaatatattatttgggccgggtgcggtggttcacactcgtaatcccagcactttgggaggctgaggtgggtggatcacttgaggtcaggagttcaagaccagcctggccaacatggagaaaccccgtctctactaaaaatacaaaaattagccaggcgtggtggcaggcgcttgttatcccagctactcgcgagaccgaggcaggagaattgcttgaacctgggaggtggaggttgcagtgagctggggcgccactgtactccagtctgggtgacagagtaagactctgtctcaaaaaaaaaaaaaaaaaaaaaaaatatatatatatatatatatataatatacatataaaatttgatgttaaaagtgatcttgtataacttgaaattctgtaataaaaaagatctaatttctagcttttgctttgattatatttaattaaatgaagaggttaaatttccttattaggtttaatattgtatcagatttaaatttagttttaaggtatccagatgcagataagacaccagatgcaatttatttattgacatatatatatgtatgtgaaatcatctttctaacatttttttcttccttctgttgactccttggcctcaaagatgacaaacatgcaaaatggaggggggaaaacctcacaaaatattaacattaaacagagtaatatatgtgatactgattcaggctagattgaaatatgaactttttagttattttaagaaattggatgataagtactaatgctttatgtagcactttactatttagaaaagtcacatttgatcattcagttgattctatcaaattctttgagataagcatgttcattttacaaaataggcaacaaagtctggccctggtgataggaccatgattcatatccacttctgactctcaagttctgtgttccttttttttctcagtcaggtgactgttcagtaaatctgacttggatcttgcctacaggagcttactcatgaaatatccaaatgactttgtaagcagtatgattcattttaagatgtagtatgattcattttaagatgttctctgaaggcagcattgtagtgtactgtcattaattacaaatgaaatgtaaaattatgatgtgccaatttgttgcaatcaattacattttatgttcaatttttattttaaaccaaatgttgaagaccatggcaccatgtctaggtgttccagagaagagactctgatatggcaagttttactatgtcacagatgtagagtaactctttctccaaactagactaaatctcagttgctttattgctgaacttttaaagttcccccctccacctttttttttttttaacttccaaaaaattattttggcatgtgagattatttcacagaaatattttatttggcttaaaactcatttctgaataaccatattttccctgcccatataaatacagttctgatttcaaattgtggtttgaattagggttcagtttttgtagagaaatattcagaatctctgatgggaggaaaataagggtgcttgaagaaaaagaggcatctgtagggacctttgtagtaggtgtttgactttcttttcctttccaaacccctcatagttaataccatccttctagcaccgtcccttaaattctgagtttttccccctagactcaaatatcagagtacattctaactactgcttgagtttgcaacagccctttgcattccacatcacattagctcagggacaaactgtatgttctgatagtgagtttaggaaattttaaccctgtcattttcgccttaaggatgttttgactctacctttctgaatacagagactttaataaaaaccataccaatcttagtaagttttcatcaagaaagtatttttgatttggacttctacgcagtttgatttcttgatcagtttttcatagagcaaagttaaaattttctactttattttactaaaatttttatcaggctcagctctgctttgtgaattttactctgaagatgtctgtcatttcactttctctctctctctctcttttttttttttttttggagacagggtctcgctctgttgtccaggccggagtgcagtggcacaatctgaggtcactgcaatatctgcctcctgggctcaggcgatcctcccgcctcagcctcctaagtagctggaattacaggttcatgccgccacacccgactaatttttgtatttcttgtagagacagggttctgctatgttgcccaggctggtctcaaactcctgagctcaagcaatatgcttacctcggcctcgcaaagcactgggattacaagcgtgagccactgcgcccagcctctctttttaaaataagagatagtatagagtagtgttatatcctggttatgttctaaaagcagtactgtccagtaggaatatactgtgagccacgtgcaattttaaattttttagtggccatgttaaaacagtaaaaagctataggtgaaattgtttgataatatgttttatatagggacaggcacagtggctcacacttgtaatcccaacattttggaaggctatggcaggagaattacttgaacgcaggagtttgagatcagcccaggcaatatcgtgagaccccatctctacaaaaaattagaaattagctggttgtggtggtgcacactggtaatctcaactatttcctgaggctgaggcaggaggatggcttgaccccaggagtttgaggctgcagtgagctgtgatcatgccacagcctgggcaacagagcaagaccctgtctcaaatatatatacacacatatatattttatatataacccagtataaccaaattattatatagacatgtaatcaatatacaaattactaattttagaggaaagtaggtaggagaagggaagtctcagggaaagggaaggtgggggttggaggtaggttagctaagcttgacctctgtttttctgctatctttctgtagccttggggaggaatggaggaggaaggaggagaagaccatgcccatctttactctgtctcctactttagtttgtgagtgggacggttaagtcaaaacagtgacgagagattaacttatttgctgagttctatttacattcagaatatagtgctagaaaaggcccagataacaccatgtgctagtagtatacatgtgcacattaggaatctaaagtgtcttttactgactcagactttaataatagtcctgtccacccccaccttttcgccctctctctccccttctctctctccctctctcgtccaagtttaaattccttactggaaagacaggaaaggaaaagttcgtagtagattttccaaatacaaaccttgcttttataatatggttatggcaaccatctctattttggtaaaattggcctattatatgaatgacattttgcaagttagatttttgcaatttaggaaaaccacaagccatcgtaaacagttaaacgagacattttatatacgaatttagtaccataaatcggaattttgggcattgtgcagaagcattgtacagagcagaatgaaaacataaagcaaacagacctggcctaatctgtaaggctcaaaggaaaattctttaagaaagtgagttggaaacagagacatgaaaggtgagggcagtcctgatggaaaagagctttccaggcaggaaaaaaaaaaaaagaaaagaatgacaaaacatttgcagaattcttacagtgggaatttagagtctagaaatataccatacatttatggtcaattgatttccaacaaggttgccaaaagaatagtttcttcaccatataatgctggaacaagtggatatccatgtgcaaaagaatgaagttggacccctacctcacaccatgcacaaaaattaactcaaaatggctggtagacctaaattttagaattaaaactataaaacgcttaaaacaggtgttgggttaggtatagtttcttagatatgaaaccaaaagcacaagcaacaaaagaaaaagtacattggacttcataaaaattgaaaacttttgtgtttcaaaagatatcatcaagaaagtgagatgacaactcacagaatggggaaaacatgtttgtaaatcatatctgataacggaacttgtatccagctactactaggaaaatgcagcataattcaaaggaaaaggtttgtggcagagtctagcgtttggatgtgaatgtttctagatagagctctcctctttatttctttcagaacaaaaacttataatctagcttaaaattactgagcatctctttcagctcaaactattcgtttctggcataacagaacaggtgtaaactctgtttgactgagagttccttagtccagaaatccttgccctgtggcatggctgaatttaggaacagggtatctcctgttgtaattctagactttgcctttaatactgcttaaattccaactattccaccaagattttatggattttgcttcctttttaaataataatttaaaaataaaatagtccaggcatccttctaagtcagtcataagctatagtatcttgatttgtatattagagccgattacctgaattatattttgcaatttccttacccccataatagtttgtcctatccactgcatcctgagccatggtcttagttgtgttagatacgcttcttagtcagctcaccaaaaacagagtctggccaggaaaatagaaaaaggaaaatattaaagtcctttctacttcctcctgttaataagagtggctctggaaatgtttcatgcaaggaggcagtgatgaaaatctcttctttgctattaagtttttaaagaggatgaaaacgtttcttggtttttcagtattgtattacaaagttgattactttcttgggagtaaaccatgtgaattaatgcactctggcttttagaggatttctatatgagagcctagttccctggaccaaagaagagatagaagttattgaatattcccaattagaataagtgtatatattcagaggttataataaagatctcataaatttcattatatagtcatccagactattttaatcagttaatggctatctttattcacatattttacaacagatgagctccgacaagaaatgctggatgatgtacaaaagaaattgatgagcttagcaaacagctcagaaggaaaagtagacaagtatgctttttgcttttaatgtttgtatattttgtggaaatcacttttatggttaaaaaaaaacttctaaatgtagatgtttatatgtgattaaatttttcaaaagccttttttcccctcactcttagtgaggaaggatgcagctttaatgaggagtcagcagaatcacttaccttcttttatttttaatgtggatttttttccagctcattctttttcttaaaaccatatagaagagctaaaatatcacctcagtaagaagtacttagaaaataaaaaatttatttttaccattcttttttgcttcttttactgtccttaaatgaacataatcttgctcaaatgtattagatctgaaacctcagtatatatgcaacagtagctcatttaatattttttaaatgtatatattattagtaaatttttaatacatttggatggggaaatataagcataacattaaacacaacagtcatcaccatttaagtttctgcttcaggtgaacattagcccagtcaggagcttggaattactaaggaggcgccacctcggtcagtaactgggttgaataaagtgggtggctagtaagtgagattttaaaagatacacattttgggatgtttgaaatattcttttttattttattttttttgaaatattagacttgtcaagattttttaaagacactttaaaatattttgtttagacttttttataagtaaatatttaattgtttaatataattaaatatttctatgcttagtgtttgagtgtacttaatgttgagttcacttgagctgtttctgcctttattttcatagagtcctaatgagaaacctcttcattggtcatttccacacaccgaaaaatcagcgtcatgaagtgttacggttaatggggagcatcctgggcgtcagaagggaggagatggagcaggtgactggacgatgaaagccatctgaacacattcataatccagatagtggctttgtagacaattacttccttttactgtatgtaacttttactgagtgtaattttctcagtgtggaaatggaattacttcatacaacattgaagaggcagatttgttcaatatgtatgatattagtttaaatgttttgtaacttacaaactactcatatcaggatgctgaaatgttgaaatatccccagactttcatttgagatggtgcttgggatggcattttattgtatttgtagactctatcagtaggaaacatttactaggacttgaacttgaaaagcatgctttacaactatcagaaattatataaaagtggtccttgtttttttttttttcttgtactgataatatttgtctgttttaaaataatctttcagttgtttcatgacgatcagggcggtgttaccaggtggatgactgggtggcttggaggaggatcaaaaagtgttcccaacacacctttgagaccaaatcagcaatctgtggttaatagtgtaagaaacaattttattcttgcttaaggtgaatagtaaaatgactgtatattacattcatttgcaaagaatcagatttttttttaaaattattttatacaacccttttattttgaagttgcagaaactgagttccagagaggtgattaagcttaaggataacaagccagttttcataactttattgcatataggttttattttaactctatatggtgcttttatttttcaaaatattaacttttcctttgtacttgatcatgctgccataggcagtcttgctactaaattatagtagcaagatagaggatttattttattcgtctatgtatgttccaaatcgttgagccagtgaatacttactgagtacctgctgtgaactagactgttctaagcattgaggatgcagctgcaaactggatagaaacggcgcctgccctcataaaacttagattctcgaaggaggaagcagttaataaacatgaaaacacagtgcctggtatgttgtaggctctagatgaatattaattgaattgagtagtagtatcagttagaatgtggagtttctttctcttagcttttgttttgttttgttttttgagacagagtctcgctctgtcgcccaggctggagtgcagtggtgcgatcttggctcactgcagcctcagcctcctgggttcaggcagttctcctgcctcagtctcccgagtagctgggataacaggcgcccaccaccaccacgcccagctagtttttgtatttttagtggagactgggtttcaccatgttggccaggctggtcttgaactcctgacctcgtggtccgcccacctcagcctcccaaagcactggggttacaggcgtgagccactgtgcccggcctctcttagttttttaataaagaggacacgaaggataggtgatttacccagagctggttaaagataaaaccctattttacttggctggcataaaatttaatttaaaggaaaggtctacactacattattttaatctgacaatgttatttgtgatcttttgttattatattcattggttagacctgactagaaaattatgtctaatgtgtgttttcctttcatataattttttatgtttgtgttaatagttattaaaatgatcagattcattaagtgctattcattgatggcaagaaaaataagtattatcagttggctaattctgaccatgaggtgttagaagtgagtgttaccatcagactattgattaaattgttaaatttttgtaatgatgatcatctatctaaagtgctagtattttaggccaggtgtggtggctcacgcctgtaatccccgcactttgggaggccgaggtgggcggatcacagggtcaggagtttgagaccagcctaaccaacatggtgaaaccccgtctctgctaaaaatgcaaaaattagccgggcgtggtggcgtgcacctgtaatcctagctacttagatggctgaggcaggagaatcacttgaacctgggaggcggaggttgcagtgagccgagatagtgccattgcactccagcctgggcgacagagcaagacaccgtctcaaaaaaaaaaaaaaaaaagtgccagtattttcaattgttcataaagctgatttgtaaaaaaaaattattcaagtggcatgattaatttttaatatttaattagaaaagctggtacatttccttagttgtagtgaatataacttaattatctagcctaatataaccaaaatattttttcttagtctttttcagaactttttgttaaatttctagaaacagaatctcatccatccattccaccaccaaagctttctgttcatgatatgaaacctctggattcaccaggaagaagaaaaagagatacaaatgcaccagaaagttttaaaggtaaaactagagatttaatttttctataatttgaaaattgaatgtttaatgtatgattatgtttcacagtgatattaactaaatttttagtatttttggaaatgtgtaatcaggacttccagaattccaataaggcatcaggcttttccaataaggcatcaggcttttgcttcatatattcttgtagcaatctgatatttaattgacttagattaatttaaatggtaagaaatatattccctttgtatatcagaataattcttctctgtctgcctaaccagctatgaattattcctctggaagtgatggggaattggttacatctttcttggccacctgctttgctttctcactaatggtggttcttgctaatccgagttagatgtgtagtttatagtttgagaagggtttttctcctttgaaaatttaagtgctacactcagtaaccaaacattggcatgttaatatatataagcgcagtttaacaaactgacttgagactccaagaatgtagaaagcactcttttatgttgaaagatctgcctagagcggacggttggtggtggttaacgtgtacatatttttctgtctcactaaattgtaagggttttatttatgttcatatcatatatactggcacgcaagaaaatttatcaattgaaattgaattataatctgttggactataaacaaattctttattggaagagctcttctgaaatcttcatattttaatagactaatatgtttactaattggactgtaaaggtatatgttatatactcatatcacacatcagatgcttaaatttggataaaataataaagaatttatattctgaaatttttgaaacttctgtcgtttagacaaatatttctatttttctgaacttgtataggaagggaaagtagtaaaatttatcagtcctttaggtagtaagtagttttgcctgctaaattttgtgaaaagtcataactttatctaagaggtgtaggctatactgaaaacagtttttcttttacactaggttgtagcatcttgaaacagattcccaaattcattatggcaggctctttcccttcctctcttcccttccccttcttttcccacccttcctttcccttttcttcccttctccttctttattctccctccctctccctcctttccccttcttttctctcacttttcttcctctttcctacctttcccctttcttgtatcaagtccagtgcccagcctgatttgtattgataggatacaaaagctggtgatggcttgggttgatataggctttgcatgaacaaagcaagcttaatctttaatcttgaatttggaagtgtgtcagagctcactaggtaacaccagaagcttgcccagagttcggaaagttgtcattcataggaaagtacggcttgggaaccctaagagtgctcaatgataagcagatttgacaaatttgtcttagtgctttctttgctttaggaggtcttttttatttgagtttcccattgctgaagtaggcaccttcaaaggattgcttgtctgttaccattgaagttgtcagaggtcttgggcattaaagcagaatctgtccactaagacattaggaatttacctattccaataaaaaggaattgtattagcccaacttcatagaaaaataatctaatcaagattgttttcaaacctttgactgcctaaaagatgatcaggtaaggtatgtatatattgttttttcttctggcaaatattaattcaactgttatcattgtaatatgggtttgtttttctttattgtaattatttggggagaacgtaactccttaagcctttcattattcagatgggtaagtaaagagtttgccttgcaacatagatgacaccatttaaaaagctgttgttatggtaaatgaagttcatcagttacataactggtatttaagtataaaacaagagctgtaatgtgtttaataaggtattagataagcatacaaatattcttctcttgccttttctttccctattcgttcctcttattccttatcctctttcatcctcctgtatttcatagaccttgcttgtgggatccagaaccccgcagcatatgaattaaatttacttgggggccaaatctgggaacttaaaacacatgtatagcattgtttttttatcagaaaatgttttgaattaccaagagtgaacattagtcagattttagccatacaaattagtatttgtgtttaggaattgaggcctgtttgtgctttcatttttttttttaattttaattttttgtttttgagatggagctttgctcttgccacccaggctggagtgcagtggtgcgatctccagtcactgcaacctccacctcctaggttcaagtgattctccagcctcagcctcccaagtagctgggattacaggcgcccgccaccatgcccagctaattttttattttgtgtttttagtagagacggcgtttcaccatgttggccaggctggtctcaaactcctgacctcaggtgatccgcccacctcagcctcccaaagtgctggggttacaggcatgagccaccgcgcctggctgcgttttcattttgaataaagaccagtccaaaaagatgtgctggatgccagtgttattaccgtcaagggagaatttttaagttgataagtgatacattgattatttttatttatctatgctaatcaatttaacaatattacacagataactttatgctattacattcagagttatttcattttgacttctttgtgaaagataggagactaaatccatattttattctttagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgcctcttggtttttgcctattattatttctctgtgagttgttactccttggtttttatatgctcctaacaaagatactttcactgactatcctacattatttgctgcttgccattgaaatttcatttcagtgtggagaaatgaaatactagtttctaagttaaaaaagacacatggtcctttatttttaagaaatagaatatgtaaaaagttttctcttttaatttgaaaaagagatgcatggttggtatttaagtagtatgtcatcatatttgaaatgccttttgtgacatttttgagtatttccttctctgaccaaaacaacttgtccgcctctcatcccatggtttaacgtaagtttaaaagctgttgtgggtggattgcata

SEQ ID NO: 13276 - DNA, 100877 bp, Human
  misc_feature (1)...(100877): n = A,T,C or G
ctctatcttctactttcataaataaaggacagtttgactaagaataatgttcttgggtcataaccattacaaaaatctcaaaaccctctgtatcttgatccattataaccacatttggtgtttcagacaagcctcaaagccaggcttaatttttcctttctaagtaacctgttttggttgcctttttgttgtgctttgttttgcttattctgtattaataagacttatttattggtatatacaatttatttttcaatgttattgcctgctgatattttatcatacaaaagtaaatggcataaaaaaagtaattgtttacagcttcctgagtaagacgttttcatttaggtgtgtcttttttttcccatagagaaatgaactattgcttatgggtggagaaatgtcaaatacctttgctgaaattcttaacttgcctttgtatcttcacccttggcattgaaaattatccaaaataaattgctaggaaatctgctaaattatctctaagggagtgcctaaaagtagccgcaatctactctcttttgcaatacctctgaatagaatggaattaaattctgtctgatgacttaggaaaatagacaagtagtcttcatattgcttatctgtagtatggagagagtaaggaatatgttccttttgtacttggtaaagagcagtatcttcagaaacacgcagcttacaatttaatgcatagaagttgccaaagctgttacaaacttgttaaggtaatttgtatcaccttactttattagttacctattgctatataacaattatctcaaggcttggggcttaatacactaagattaattatctcgtggtttctgtaactcaggcatctagctgagtcctatactttaaaattcctcagagcattgggacacatcatcctaaggactcaaacatgagaaaatattttcaaatttgcctcaggtgaaaaatgagtgcagtaaatacactaaggacacatacgtatattttttcttgtctcaattaacttttaaaataatgtttgcctttcgtctgtctttattgctttatacagtgaataatagcgaatctagcagtcagaaaagcactctttgtttttttgtttattttatgaagtcttcttttaattttatttcttaattttttatttatttagtagtttttttggggggtacaggtggtttctggttacgtggataagttctttagtggtgatttctgggatttttgtgcacccatcacccgagcagtgtacactgtacccaatatatagtgttttatcccacaccccctcccactcttcctctgtgagtccccaaagtccattatattattcagatgcctttgcattctcacagtttagctcccacttataagtgagaacatactatatttggctttccattcctgagtcacctaacttagaataatggcctccagccccatccaagttgctgcaaaagacactattttattcctttttatggctgagtagtattccatggtgtatatatatacatatatatatatatgtatatatataccacattttctttatccactcattggtcaatgggcacttaggttggttccatatttttgcaactgtgaattaagaagagtgtcctttgaatattctcctagtgccaacattaaaaaaacagaaaaaccatagaataaattataggaatatacttttctgaaaatgtctatattgtcttgaattttcaggaagactatctctgaaatattatacttaaactagctacccatactcctaatattattgcgagctgaatataatacctaataattccttacataataaagactggtcttaattatatcaaaaaaaaatctgaaaataatgctatttgttgacctagaaatagctatgttaaaaatcttaactgagtgtatttaatactgtactattttccatatagttacaataaattccttgctctttctctctttggctacttttttgaaatagactaagatgcttggtgaagcagctggaaagaggtgatgttaacgtcgtcgacttaaagaagaatattgaatatgcggcatctgtgctggaagcagtttatatcgatgaaacaaggtaagttttaaccttcttctcttttatcttctttgattctctcccgtttttcttcctctttcttgaccctcctttatctcaaacaggaatttagcatatcttcctgtgaaaccaaaatcaaatcttattaaaatttgaaatgttcttcttcatgtagctaattaactggactatgattctctaaaattaatacacattttaatccaaatgtttgaatgtcataagatagtcaaacactaaagtgaaaaaaaaatctcctcttcccccatcctcagtctccttgggctcagacttttaaatgtcagagttacgtgtaggcttatactggttttcactgatgtaaggattttccctattatctcaaatgtcagagtccctttaggaaaatgggtgttatatgcccacacattctcatgagatgtgtctaacaggccctctatgcagggattgctaaggggcatcccaaatgtgtgtttttgatcatccaaacctagcctcataattagcagttgtaaggagattaggaaagggggacttatttgaagagggttgccagcttagtgctgtgaccctcaaagaggctgttcaccccctggaggatatttggcaaatccaggagatgtgaccagtgtctcttggtgttcaaagatatctggttcctaattctcttctcaaaaaggataaaagtgacaggctaatcagggctacctgtgaattcagagctaagagggaacctgtggggagagaggcatgcatttccagcatttgacatggaaaaggtgctaatttttttcacagccataaagcaggtagaatagaggtctcttaaagcaccaaagactacttaagtcaaatagtgaaaaagaggctgcatagagtaagtgatggtataagagccagggtaggaattataaaaattcagctaaaatagtagaaaatatatatattcaaagtactctcttggtgttagcaagttgtctctgaaggacccacaaatggtccccaggagaaaaaaaataggcagcatttgggcatttgtcacatagatgacagcaaaaccaccagtctagccagaccctttggtcctataatttcctgcctctcgcaccgcattgctaaacaaccagaagcagcagtgagtgggaatatggaggtgaggacacccactaggccccttccactcagcaggagtccatgcctgtcccaggcctaagcttggggaagatgagcaatgttaaactggatgggcaactaaataacattggtttttatttacctatgtgtactggacttcacaggcacgcagatacacacacacacacacacacacacacacacacacacattgtttaataagtaaaaaattcacatgatgaaattcttgcctctaccctggtcacagtctactctgtttctcataaatttcttatacatctttccagtgatttattacatatttttattttgtatttttgcctcatcctttcatggaaggtagtatactacgtaaacagtctctcattcttcttttttcactgaaaaaggaaacttaaaagtttccttttattttattctgattttttaaatatttgacaatgagaatttttactaatagctggcagaagaggccatattgagagctttgttgcacaagcgattctttctttgtctgcagagtgaaactcctctactaaagcatagcttggagaaattatttgaggaaaagaaaacaggctgggcacagtggctaacacctataatcctagcattttgggaggctgaagtgggcggatcacttttgagcccaggagttcacaaccagcctgtgcaacatagcaaaacctcatctctacaagaaaacacaaaaattagccaggcattgtggcgtgtgtctgtagtcccagctatttgggaggctgaggtgggaggatcacttgagccagggaggccgaggttgcagtgagctgagattgtgccactgcactccaatctgggtgacagagtgagatcatgtcaatagataaatgaataaaagaaggaaagaagaaataaaaaaagaagaaagaaagaaagagagaaagaaaaagaaagaaagaaggaaagagaaaaaaagaaaaaggaaagaaagggaaagaaagaagagaaagaaagaaaggaaaagagaaagaaagaaaggagaaagaaagaaattattttcttggtgaatgttcactgaatgtgtatgaatgtacatgattcttctaagtaaacagaatccaaagtgcaaattttaaaaatatctgatgtttttcccttgctccctcatttttatgtgtgctcttattgttcacaagatgattcaacttaacaggtttaagatttattcaatctgtccttgaacagatattttcttttctatttatctataaaactttagaaccaaagaacgatttgaagatttcgttattcatcttctaatggcataatgctaactacctggtttgcctaagtgtcctgtctgtcatttaatagattattatatgctttatttatttattcatttttctggtgcatttcctttccctgagaagtatgactccatggatatttgctaacttagttccctatgatccctaactcatttaaatgtgtattatacctaaagtatagccctttttcatttgaaaattgctcttttgcggggaaaagaggttgagcacaacgctgccctgcttcgtggtagaaattcatttatttttttccttcacataacaaaacattccatcttttaacaccacattattcctaatatttactccaaatttttattattttattataatgcttccatggcatcatgagttttaaattggattaataataataccccacatttgtatcatcttcaaagggctcttagtttcattatctcacattagtgtcaccacaatcctatgtgattggcaggatgattattactttctgcattttactaatgagataattaaagctcttagaagggaaacggtttgacacaggtcatggatggaagtgttggcaaaactgggactaaaacctaacccatgacttcttatttagtactccttcctctatacctgactcttctcagagtattcctataaaacagaatggtttttagtgacctctgaaagatttagatgacaacatataaaacattttgatagctggaattgtaaatcctgtagctaacacgtattaagggcccactatatgctaaaaaatcttctaagcattttatatataccattttatttaaacatcataaaagtcctatgaaatagaaactctattattaccagattgtatatgagaaaacttaaatcacagaaaagttacatagcttaccaaagggaagacagggagttgaagagttggattagggccttggcagtctgaccctagggcttgggctatgaagtgcaattctcatcctcatcccttttctaacatttgatgaaaaggtgacttcagagacactgaagtttgatgaaagtgcacaggttgtcaggatcatcagccccagtggtgtactgattgtgtggcatctctttccaattctgccttcagtagtttcatgtggctagcttgaaaatggctaccgtgggagtatccacacccatgaaaaataacatgctacaaatcagaatttatttttttctggagagtctgttgttaaacatttaccatcataccacaggtcagacctaagattacctcttacaaatctcctaagagctgcgatttcatgatcaaaatatcagcttaagattttttagaacaataataatttatgtggttgattttctatatacttagtaagatacacagcagtaaactgaggatgtttctgttgagatgtccatacaattattaaagtaccatttcccttaaaactatcagtaaaacagagattatgtaaaaggagtcaggtccaagaagcatttagttgcttttaaactttaaaaaccttttgacttctgaaatgttttttgatagaaaattcgatgccgtgagtattccagagaggtattgtttgaatgttgagctggactgaaagaaaaaagtcagcacaaaataaagcaatgtaaaacacaaattattaattggtttaaaacacacacacatacagagccttaatgattgcagaatttcagttaagaaagcaatcaaaacaaaaatctccctttaaagatgattttggtgagaaaaataaaaagtttctgaattctgactcttagtggagataatagcacaataccctaatgaatatgactgctggattttttaaaagacattttcaaatgcaaatgccaatcctttatgagtcttgtgttcagaactgtctctagaggctattgtttttcaaacttacaaagttttaatccagaaacatgtagcctaaaaaaatatgttcgattgtccttatttggattgggatattgccaagcaaagtagcatttttggcctcatgcatagcagggcaggcagctgcctgagagatatactttcaagatcggtattgtgcttactaatacctcctaaaaacacaatttataactttctttgtttaacatgaaccaatctgtctcataatttcgatgattagcgcttagactctggattcagaaagagtaggttgttcaaagtctggattctctacttaatactctttctttaaggaagttactttacatccctggctttatcatctacaaaataagagtaaggacaatgttcacttcgtaaagttgatatgagaattaaatgtgtaacaatgcctaagagtaaaatttaaataataacaagatatttctattttaaataaaattcttatttattacgtatgagtaaaatgcaaataactctgggatacataacacatgaagctatatgatttacatattctaataaaggtaacaaatgcttccctgagagcagtttttaatcctgagaaaatgaaaacgggtactggtcaccaaggaatgaaagcataaaattatggaaaagagtgcctttcccttaatacagagtcacattatctctgtaaaaacatcagttgacttttgcgtcttgctaaatctagggatccttaatttggggttagatactgcattgatgtcaatcagtactttgagaagttagtctggtagaaagaaattgagcgtcatttagggtacattagaggctaagatccttgaaattactgagtagagggactttccaaggaatcttcactcatttaacaaatacctgttgagtacctgaaatgaataccagacacactggtaatcagaatcaggagcaaaattgtgcaggcagctggtggctagaactgggtctagaattgtgaagacaaacctaggcacaagaacaaatgctcaaacaagaaacagagagatttagagagagacccaagcaacagtgacagattacaaggaggaaacaccaagtatcaacagtaactgataaccagagggagtaacatggggtaagaatggggtaagaatttatacagagtcagacttccaaaccagatatgtctagacttctagacttgcaggcatttttgagtattaatgagtttgttctctggcaaagctctccctgcctattcttaaagacatggcttctaacaagaggactaaaggtaaaatatgtctggaatatgctagatatatgtgcatggaagctcagaaatatagtgccatttagagatatgaattataactcaagggtctcagaatttttaaatacctttactttgatgctaacgttcaatagttggagctcctttactgtttgaatatgttctccatcctaaagttcttgagaatggtcagtgaatgtttacttatttcaccagtctgtcctggctgtcactttcctttgcagccagctctctggcttcagactgatgaattgttcctttgcatttttttcttcttacctatttttttcctcaagtccagctgtgtatagccaggatcccaagcatgagttcaatcccttcctcctgttctccaaactgaagctaaaatcagctataattgcaataaggcattagtgatagatgcttacttttttcttttttctttttttcttttcttttttttttcgagatggagtctcatactgtcgcctaggctggagtgcagtggcacaatctcggctcactgcaagctccacctcccgggttcatgccattctcctgcctcagcctcccgcgtagctgggactacaggtgcctgccaccacacccagctaatttttttgtctttttactagagatggggtttcaccgtgttagccagggtggtctcgatctcctgacctcgtgatctgcccgcctcggccccccaaagtgctgggattacaggcgtgagccaccgcgcccagctgatagatgctttcaaaaatctacaacttaagccctttcatagaggtcccttatcaagcatcttggtgcatcctctaatgcctgatgcccatgtcacagagaccttccactacagaagtccttttgacatgtcttgctgtcctgagttcaggacctcaagttctgtgactaaaataaagataggggccaatcaaaattaatgtcattcatctctaaggatcaacccctatgttaaaagactgtgcagtctaaattcacatttagaaaaaacatgacagttttctaaaggacacagaacctgagagtgatgcagctgtgctcatggtgaagacaagcttgagcattactttctggagatgtttagcctcttggaatcccattgtctcagtcttctaaatgccaaaggagagcccttactttttttagtgtaactaaaagacctattcaaagtattttttataaaacaaaagaattagtctgcactgaaggtaaaataaagcctatctatgtagactaaaccaattttttgacttttcaaatgtcaaagttttttcactttcaactattaaggtttaaaaaacgcttggaattccatatcaaaatgggctaccatgttatcccactaatttaaatcaagggaggggataaaattggaggtgtggaacaggagggtagttaaagacaggcaggtagttaaggaaaacttgagtatttaaggcaaggcatggagctaccaaagaggagactagaaagaatagacaccaaagcaacaggcatatatgacaaatatgaattgcccaattaacagaaagcagggttactgaaaagggtaaatcaaatgccacagggtgaaccactggatgagttgggagattcctaatgccctgaagtagagtttcagcaaagagaaaaagctaccagccagaagatgatactatgaggaattaatgtggaatggcttcgtgaagaaattagtatagactatttttccagaatttgctcgagtacaaaaaacagagatagaccaatctactgatttggacatatacttgaggaatcctttttgtatgtttttgttcacattgtttttaggatgaaaggttggtatctgtagcccagaaacgaaaagtttaaaaaacgtatttagcatgacaagaaaaaaaaatgcttcctagaaagattaggtcaagaagtcatccttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcaagatttatagtcctttggatatatacccagtaatgggatggctgggtcaaatggtatttctagttctagatccctgaggaatcgccacactgacttatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggaggggggagggatagcatggggagatatacctaatgctagatgacgagttagtgggtgcagcgcaccagcatggcacatgtatacatatgtaactaacctgcacaatgtgcacatgtaccctaaaacttaaagtataataaaaaaaaaagaaagaaaaataaaagaaaaataaacaagaaaaaaaaaaaaaaaaaaaagaagtcatccttgggaagttatctaggaagagagaaatagccaaacattggttgaaaatgttgatgtggccaggtgcggtggctcacgcatgtaatcccagcactttgggaggccgaggcgggtggatcattaggtcagcagatcacaaggtcaggagttcaagaccagcctggccaatatggtgaaactccctctctactaaaaatacaaaaattagctaggtgcgctagtgcacacctgtagtcccagctacttgggagggtgaggcaggagaatcgcttgaactcaggaggcagaggttgcagtgagctgagaccatgccactgcactccagcctgggtgacagagcaagactctgtctcaaaaaaaaaaaaaaaagaaaagaaagaaagaaaagaaaaagtgtagatgaacttggagctaactagtgcacagccaagggtcttcaagtaagcaaaacatgagtagcattgtaaaatccgaaagactcactggtatttcattttaaactcagctgcttagcatgggtaaatgcgctgcaagagttatggctaacgtatgaataatgagctgctaaacttggggaatgatgtggagggcaaactctttatgtttaatcactacaacctgcacatcatgatggcactcactcatgtgtgctcctttggcatttagagtcagaataagagagaggaaaaagagaaatagattgggctaatgaacggcttttattaatatttcaattgtaagtgataggaaacccaaccaagccagtttaaacaaacaaatgattaacttattggctttcatggccaaaatattgatggctagtggtgactataaacacaggttgatctagggcacaaatgatgtctgtcagcaggtccacctctgttttgcttgctctggaatggctcttttgatgttttatctggtagcaagatggtgacagtatttccaagcttcacatcctcacaccatcaaatccaacaggaatgagaaaagttttctttcccataggatccgataagcatatccttatgtttcattggctctagttaggtaacatatttatccctcaaccagtcattgtgtccaggggagttgaatatacaaggtcagtcgtcaagcatcccatgagaaagataggtggtcaactctatttaagtcatacgcttaagaactgagaatggaggaaagtgctttctcaaaccacaactgtgttgtctctgcagtgaaaactaaaatgtttctgttagtgtcacaagcaggggacctggatcggggtttgtgtgggatgtggtggaaagcccttgattggcagttcagcaactcctttcttggctttgctcctactaatgattagtctctaatcattgtttttttcacgtggaagataaagtctccagtccctttttgttctggaattgtgtgattttatccatggttccaaagtccccctgtaaagacttgctcatgactcaattactctgactaccaggagggtgacaggaggaaactgcttatcatttgcttagcatttataagtatgggctcttgtattcttcaaattatttccatttggaaaagtccctgaggaaatcagtttgaggaaaatgtgctaagacgttgctggaactcagtgaatcattaaaaatcaagtaatgatttttctgaattccatttttgtggtgtgagttgtggggaggggtggctgtttggagtgttgtgtttgtaggctgttctcaccctgtaggtggagtgtgaaaatcacttagaaaaagttgcaatactttttggttggttttcctattttctgtccatctgtggtgtgttactttctacaaactttcaaaaacagcctcactcctgaaaagggggaaaaaaacctgaccagatcttttgagaaatgactaacaaaaaagctctatgtgttgaataagatctgactattagtgatgttttgattcagtgtaatataaatgaatatttgctgcattttaaaaagatgttttaaatattattcttttccaataataataataatgaaaatcatttgacagttacatccaaggcaacatattattcaatttgcatatatgatttcatataattctcaaaaatgcctataaattagatacttatattctttctactataaagttaaaaaatttaaggcataaagaaagtaattgacttgcttaggattatataattattaagcatcagagacaagttcaaacttaaatggaatatatcaaacatctatttttctcttttttcctagccaacagagcccattttttccctaattatttactcccttttttaaggccaagtgattcaggggacaccaacatcagccccaggctcaggatggatgactcctaattgatattaaccagttattgttctccagttcactaatcagtgagtttaggcttggacatgtgatatgattctggccaatgagaattgcataaatggcagaatgaaggggggtgttggcagaaggtttcctcttcataggaagggtgtcatgcttctgggtggtgtatctacatctgatacttacagtgaatacagccatcttgcttcaagcagaaagctaaacctaatactaaagttgttcatgtagaaagacaaaggaaaccttagtccttggtgatatcattgacttcctgattttaaaaaatcccttactggagtcaacttacttttaactgtttttaaggaaatcaatcaatttctacattatttgagccactttcatttaggtttgatgtcacctgtcattgacagcattcttacagccaggtaggttggacttgctccaaattcatgttcttcatctctaatccttcccaggagtcactttaccctaacaataaatcctaatgcaaatgtttgatttctaagttaaccactaataattcataatctagtttcccatgaaatgaggtaataggttaagtttccaaggtaaccctcaaaacactgatcccatcataaagtcgaacaacataggtgtttcttgagcaagtatcaagtactagaaatgagggacttacatttttctacatacaaagatgtttgtacattctttactatatttatatagcctacttcccaatatatttttcttctgtctactctccatctcttttatctcatttccatccccatcagtctagctggagtcaccattatctgtgaggctgtctcaggcctatctgtgtagacacacattagtcagttccacacagggaccttgccgtcctgcaggctccacccaggagtaggggctggggatagggtggggcattcagctggcttctgctgcaggatcctggaaacttatctggggcatgctcccacccttctcacagtttgtcttggattagaggtcaggcaggatccagtgttccttctcaagatctctcctgccttcctttctgactactcttcgttaatctggggtatctttggacaatcacaggaatggaaactttactctgacttatcacatattcttctattatcttttcctgggtctctcttccttccatgggacatggatttttccctccttcaggtaggttattgtgtgtcatttacaacttgagtcagtgagtgaattcatggctgaccatatatacaaagagttacaggatcacagaaaatactttttaaattgtttttttaaacatttttacacatgaaaaatatctttttctacattaaacaggatgtgactaaaaacattgacatatacaacatatgcatcaaaataagcaaataaaaatgactttattcttcatctgggctaatacctaactagtgcaaatacttgaatattttaaaaatccctaaaaccagagaccctatgcctatgttttctatacttttattcatttattcaacaaatatttgtgaaggacacactatatacactgatacttattttgctattctgtttggctaccgttacctcccagttgtcatcatccctactattttggcctcatgggtgtagaaagaaatatattccttatctccccttacactcttgtcttccaaatatacccctgctctactaaggacacattctccacccatggtctgttgaaaattgacttttttagttctcagtcaagtaacatacagataattcccatttgtaacatcattataaaagattcattaattaaaatactttcatggggactcttctgactgttcctcccgatataattcaccaacatgcctcatcactgacggtgaaataatgtgcataaggaaataagcagtgccattcagcacatgtcatagaaaataagtaaatcgtattttcttggtatagagcttccattaattggcaagctgtgaatgaaggagaacagtgttctcaaaccttagtagtcattgaaatcacctgaagggcttgttaaaccagggtgctgggcctcactcccagactttctgattcaataggtcttacagcatgggaactttcatttctaacaagttcccaggtgatgctaattcttctggtctagtgacaacaatttgaaactactcttctagatgatgtcacaatgagaccatacacaaaaaaaagagaaacagagagaccattagaaatttggtggttagaaatttaaggtcttatcaagactatgccccaagtgttgttccaagttgtaaatgagataactttgtgctaaaatgccccaattccaacctttttttgtactgataaaggaactaagtctcacgcggatgaaatatttcttccaaaactacacagccaataggtgatgaagccaggagtttgactccagaggcagtctttctaactacacaggatgcttattaatcaaaatttgttaatcagtggagcattaggctctatgcctaatggaatattttcaaaaatgtttttgagccaagaggatttcctggtgggaagccaagagtcatcagcaaggctttgggcagttttctgcctcacccattaatcccaattccatccccaaatgactccaaaaatacaatcttgatcccagctctccaagcaatttgactctttctcaggcccttcccctcaacattctttgggtcctttctgcctctcctggaggacaggacctccactgcctccacctttgcttcctagattggatatggaggaggcaccaagcactccgtaggtcttaccttggagaaagccacatctaacttcaacattatccttacttgacctcatttacgccaagatttgccttttgggaattgagctaaggtcggcataactgacttctccacccaaaagttcagtcttcatagtcactcatgtacaatggtcatcttctcacagttaaaaaaaaaagttgggtcgaggagaggctaacaataccagaggaacattgaacaaatctatcaggaaacttttttttaaaaaaaagctattgagataaattggtaagcttgccattttaaatactttttggaacaaaacagggaataaataaacatgcttcagtggtggcctgaaagaaataattcaaatgtatttagcacttagtaagtaggttactgacaagtagatatggcatttcaaatgtattacctatttccatcctgacatttaatttattgtacttcaaagtgtcctgaaattttgtcatccagatatatttctctatgagaaaacaattcaacatactagcactggaaattaaattcaagcttcctccaactaaagatttcctgacagatcaagacagatcaaactcctttaagactttttaagatcaattctttttaaccataagtttcaaggcagagaggagatagagaaaatgattactggcattagcattgaccgaatgtgaaggcagtctgggtactcagtatgaaaaaaatgcgtttaaagtggaggataacttatcaatcagtaactcagaccctgaaaccagacatacatgaccaaaaaatgtgacatggacactcctggttgaatgactttgcacaaatcactcaagacatctgtgcctcagtctatttatcagtaaaatagaagtagcaataataattagatctttctcatggtggtattatgaggattaaataagctaaagcttggtttcttgcctggttcttagtaagaaagcaataaagcagctggcattatcatctatatcgatcctcaaacagttctgaagcctgagtgaaggattggtgttacctttagagttttggtttgttttctgttttttggtggggggttggggggtaagggtgaagaagggtacaagcagctcagaacgcagacataggttaatcaaagaaataatactaatggactctcctaggaggaaaccacttactccaacaagagtattcctactatggaaagatgaaccacccttaattcctccagctgtcctggaagatattcgcaacatatgagttcagtaccacctttagccccaggccagtgaagctgcttcccagggcacgattccccacttcagggggcctgacaagggctctctttggtgttcctctccccatggtgtgccccgcaagaccaagaagaacctgaagctcatggccctcttccccctccagatactgtaggaccctggaattccctgctcttcccagtatgttcctttaccttattttgggcagaagaccccagcattctctacccaaaggtccccaagcctgtctcctacatcttactgggctttcttattaggtctttcctctcaagggacccaggacgctattggtgtttgtaccctttcaaaccaaggagtggccaagaagcagctcctttcaaagctaggtaggttgatggagactgtacttgggggctgaggtttccacctgtggtgcagagtggagctgcaggttgctggcccagcgctgtcacacaaggagctgagaactttcagttcacccaacttgtctgtcttttatgaaacttattaaaaggtagaaggatagaacatatagcagtttagtcacctgatatataactttaaaatacttagttaaatggtatttggatgaaatatgctcctaccctgagcccatgaaatgttaggggaaagaactgaatgagttcgttgctgcgtgaaacatgtcctttataagaatagtaaagcaggaaaggaacatttcaaacttgagaaaccagtatctcctaactgcacctagcacttgaattttagcacttagaaggtgtaattgcgggtaccaattgcccagaaataaccacatcagtacatgaatgtaatcattttccaagagtccactgtggacagaaatattttcactgacatatgattgtaagagtcaaaatcccatgacctctccttccgtggccgcctccttctttacttcccttccctgcaaactttttagttcaaaatataagccctttgggagttatgtcatctgatttcaagagaaaattatgattataaatagctccgaaggattagttgagtcacagattggatgcagggtcagctttcacagttcaccggctgccatctgcacccaggtcgtgtttagaaacccttgactttatgctttattgactccactgggacaaaaactaaagtcgtatcaaacaccagtgggagcatttttcagaggtaaacagtggtaacattttacacatatattccttatcgtttctttttctgtatagcacgttttaagaattgcttttttcctttttttttttttttgacagtcttgctcttgtggcccaggctggagtgcagtggtgtgatcttggctcactgtaacctctggttctgggttcaagtgattctcctgtctcagcctccccagtagctgagattgcaagcatgcaccaccacacccagctaaatttttgtatctgtagtagagaaaaggtttcaccatgttggccaggctggtcttgacacattttaagaattcctaaggaaaatgtaccagtcatcattttttcacgttgtatgtttcttaaaaacaaagtcttcatttttaaaaagcatttacaatgtaaatgattatgcacactctgccctttaacattagaataaagagcaatgaagctattagatgtttgtaaaacaaaattaactatgatagttgagatcctattttatcatcctccttgcacaaatttctttcaaaaatgaaatgaggacaaaatatatgttttacatgtggcataatcttatacaagtattcagatattttcatgtcttagataaatgtataggaaaattctttataataattctctgcccgtgaaaaagtacaggatgacaatgactagtccatattacattatagtttttgttcctgcactgtctagcgtggtcagatgaaacttgaggagctgctcatgttgatcagacggaagaagacacagagtacaaggcgggtacgagggaaagggaaaatgaataagtaagaagaggtaaatggaggggagtagggagaaatatgtctttaggtttattagtttattttcaaaatttattcaaatttaggtttgatctacctgtttttcaactttcttctctccaaactggaataaccatcttaatgaacctgtgaacacttacttatgtcttcattagaagtttcttactcttctctatgtgataaatgagcataaaagagctaatatttgacagaaatactgagtttcttggctaaaggcatataaacaatgcatactttttttaagttttctttcctgtgactttaaaatgctatcaaaaatgtttagttttttttttctacaccaaatatatatgtttccccacaatttgtttcaataatatgcaacatgattattcaggaacaacttaatctaaaggcaatgaaggagatgattggcagcagtgaatttgctcccaagatgttgttgctgcataagcagcaataaatttgattatatcaatcaaattgcacaggagtatacattaaaacttctaccatttccatccttactccactcatgaaggtaatcagttacaattagtctaatgtaaatatttctagacactttatagccattcagtggatatatattgaccccctgctctgtgtcacacatgattttagaagctgatgataaagcagtgtacaacagaaggccaactctttgctctccaggtctttgcagcccaggctgctagactgtaagcataaaatgaacaaaccaaccagtggacatatggtatggcatctagtagtggtcagtgctaagaagattataacagggtaaggctgggcatggtggctcacacctgtatacaatcccagcattttgggaggctgaggcaggcagatcacttgaggtcaagagtttgagaccagcctggccaacacggcgaaacccaaccctgtctctactaaaaatacaaaaaattagctgggtgtggtggcacgcctgtaatcccagcaacttgggaggctgaggcaggagaatcgcttgaacatgggaggcagaggctgcagtgagccgagatcatgccactgcactacagcctgagcaacggagcaagactttgtcaaaaaaaaaaaaaaaaaaagagaaaaaagactatagtagaataaaaagacaaaataaaaatgaaaaatgcttactattgggggcaggcacagggatgccctctctacctaaatgcagtaaggaaatgattcacacaaatatctgagtacaagattctaagtagagtgaatagcaagtacacaggccctgaggcaaaagcaagcttggcagctttgcatccagcaaggctagtgtcactggagcaaaatgaataaaggggaactggttaaaaggtgaggttggagacttagcttgagatgacttatgtggagctttatgaataaggcattgtggtctgacttaaactttaaaagaggcattctggctgtagagggaagaagagactgacaggggtcaggagcaagagggggaggccagttagcaggctgcacaggaggccaggcaagagatgatggcagcttggcctctggctcattcgttacaggtgggaatacaaaatggtatagcaagaaagtttagcagtttttgcaaaactaaacacttatgataccatccagccattgtgttccttggcatttactcaaatgagttgaaaaaagctgtacctgtttataggagctttattcataattgtcaaaccttggagcaatcaagatgtccttcaatagtagaatgcatagactatctatgcacacaatagaatattatttagcaatataaagaaattagctatcaagccatgaaaagacatggagaaaaatgcatattaccaagtggaataagccaatattaaaaagtctagccttttactatatgatactaagtatctgatggtctggaaaaggccaaactaaggagacagcaaaaagatagtggttgtcagggaccagaggtgagggaaggaaggaaggttgaatagatgaagtatagggattttttttagggcagtggaactaccctgtatgatactgtaatggtagacatatgtcattacacatttatcaaaacccatagaatgtacaacagaaagtgtgagtcctcatagaaactatggatgttaattaataattatgtattaacattggctcatcaactgaaataactgtaccacaataataccagatgtcagtaatatgggaactgtgaaggtgggggtggagatgagatgaatgggaattctctgtactatacactcgatttttctgtaagcctaaaaaataaagtctaaatgaagaagctgcctgagattgtggctttcaggcagggatagcatagtacagagttctctaggtaatcatgcttattcaaaaaggaaaaattaaaaacttcttgaggagaataaaaaggtcaagttaagttggctggctttggaggcttcccccatttcacacactggagtagcagagatgcatgcataggcagatgaagatctcaaaggccattgttgtaactgggctgtagagcagagaaaaatctttgagaaacagacctgcagctactatttctgtcagctgaagagaaagttaagtcagttcttgcacacagagacatacaactgaactcatacccagactcacttcttttctgctgtacacattctcctggtccttctcttcaaccttctgatttggaaagaagttctctcatacaagaatgaacaattttcaaaaagaaaccaacatggaatccatataaaaaaataccacaagaacaaaggtggaaaagatagggaaaaacacatgacaaagaacccatgccagaggaatgtacaaatctgtgagctcatcctatgaactcaagaacttaatgaaatcatcaattctgtagaaaaaaataatacaattaaaataaagaaaaaggtttcaagaggtaaataatatgataatacaaggaggtgaaacatgggtacacataactcagtcagcaaatggaggaggaaaatgaggctaccctgtagagacagccaagccataagccacaaaacttaaaagagacataactgaaaacacagtagagtgtttgacaaataaaatactttaaagtttaaaaaaaaaagaaaaaggtaaacaaaacaggataagatcaagacattaatttttcaaaaaaagtttagtggaaaaatgatagatatggaaactagataaaagagatctctgataggcataatccatttccctgaagaagagaaccaaacaaatggaacagaaaaaaatgtatagtctgagaaaacattaataatataccattaaggccgggcgttgtggctcactcctgtaatcccagcactttgggaggccaaggcgggcggatcacctgaggtcgggagttcgagacaagcctgaccaacatggagaaaccccgtctctactaaaaatacaaaattagccaggcgtggtggcacgtgcctgtaatcccagctactcaggaggctgaggcaggagaatcgcttgaacccgggaggcagaggttgtggtgagccgagatcgcaccattgcactccagcctgggcatcaagagcgaaactccatctcaaaaataataataataagtcaataaaataatataccattaagactttgagccatatgtttataggacaaaatgatacccaactcaataccaattacggtctttgaaaagtagtgaacttccaaaataaaagaccatttttgcaattgtgctcagttaactaaactaactaaactcaaaacaccattcttacaactttgtctattcctctcacagcatgcacattggtcttttagatacataaatcatatcacatcctgcttaaaataattcaatgacctgccattgcaaatatgacagaatccttccaaggcctgatattagcttacttatacctatgtttgcctcccaacttgggtcactctctctctcagtcagtatactccagccacatttggcctccttcctgttcctcaaacatgccaatactgatcatgcctcgggcctttgtacttgcccttctttctatctggaatagatagaacagacttcccccagactttcctataactaatacttcctcattgttcaggtcttaactatctgatcatcttatctaacatagtgtttcctcacataattaaccttatgtcataattcttattttatttttagtctttcttttaaaatataagttctacctgataagggatcattctcattttttcaatttttaatcacttcatttagtttgacaataattctgtaatgtttaaacagtatggtgtttagatttataattgctaaaaaggcattttatttcattgcaaataggatttttacatgagaaataggactggtatgttctattaaatgaatattaatagagaactgagtctttatattctattttatttataacctacactggtagttatcacgcagcattcataaatgatggaaagatgatttcttatccaaaccaacagctacacaacacacaaacacacacacacacacacacacacacacacacacacacgagagagagagagagagagagagagagagagagggagagagagagggaggagaggagagaggagagagagagcgagatatgtattttaaggaatgggctcatgtgattattggtgctggcaagtctgaaatttgcaaagcaaactggcaggctggaaaccctggcaggagccattgttgcagtcttgatttcaaaggcgttctggaagctgaattcctttctctttgggggaccttaatcttttttcttaaggttttcaactgattagatgaggcttacccataatttagagggtaatctgctttattcaaagtctactgatttaaatgttaatcacatctaaaaaatactttcacagcgacatttaaattggtgtttgaccaaacgactggccaccataacctacctatggtgacacataaaattaaacctcacggaggtagttgttgccttttcaagattcccttttcaagttacacaatagcatattccatgctcttcccttaacacactgttgtcctttatttgtgtgtccctaattaatccgtatcattatttctccctaaaattatatgcactttcttctcagtagatgacctcatgcatcacgactaaggatttccagcctcctaagtaccactctactatgtggaatatcacttccatatgctggttttgtcatgtttggtgagctctcttggatcatttatgagtataggacatatagccttaaagccatcaacatgaaatttactgtggaggaattggcaccatcagccaggtttctgtcattctaaggagattagctgacaaaactaggctgcagtggaatgcttggagcatggtgacatcacaagattacaccacaatgattcctattccacttgttctacctaccctgtatctgatcactgcataagagatagtagaaatggcattatctttaaagtagtgatattttcaagccatgaagtttagtgacttgctgaaatgggctagggaatctaatttcaaatgggcaaaaagataaacaaactattttgctttaattttctagttcagtgttttaggggtaaatcaaaaccatccaaatgtcagatcagaaagaaagttaaaaatcatatagagtaagtattaatcagtattaacattcaactctaaatattttttatcgttatatgtatacacgtatctttgtgactccagaacttatgtttattttttataacgtatttcataaatacattcatgcttatttaataccatggaaaataaatattggcaaatgacttttctgcaggtttataggaaacagcagcatatgtgagaggtcatttaaaggaacatgaagagttcctctcctgcatattaccttttgagcctctctttagtcagattgagttgtttgtggagacctcctgttttttgtcctttgttttgtccctgctttttgagatggcccctgccttgtttctgaggcattagcatgtacaaccatctctggccaccttccaacattagctcataatcgttaggcctaggtctgggcaaagagattttcaaaagcagatgaaacccaaaggttgaagctaacatgtgccagagtttttagattggtgcacagataaggaaagaaccaagtcaaatggcaggcagagctggcctgtgttcttcctagaggcaaagttcaactgttctgtaagctgtttctgtatttggtggggagcctctgggatgttgccagttcagacctctaggaagttcttgactgccgaagctgactggccttaaaataacgatgtttccttagtttcctctttaatggcagctgttattactcagcagtccagtcaattttatctacctggagcttatacagagcgtggtcattgtttcagttcctattcactacctcactcactgggttgatttcctcagccagcagctctaaacccatgagagctccaccccgtggtcacctgaaatgcgctttaaacataatctatttgatatcatgtgttttcattttttttttcacttttaaaatctgtgacattgatagaatggatatcgttgggagcacttaagtggttattttcctaaaatttagaggtacttatccaatgaagtagcatctgtgaatgacttttataaattgcaaagcctaattcaaatagcatgtactatacttaagatacacacaagattattaagtatatgacaactattatggattcaatcccccttttttcttcccactccagttacttcctttaatagcagacatctgtttatgaattcacttccctatctttccttagttttattcattattagaatagcacactaaagatattaacagtcggtacctctagactggtgtatcattgtgctgaaatgtttgggaagctgcaaatgctcaagtctattcgttgttgtcttcatatgatcaatttgagaaattaagagctttccaaatgttaatgaattttttttctttctttagagagtacatattaaggaataatcagagagtgattggctatattttaaatcccattgcaatccttgtttttctgttatatgtttttcttcacttttttataaaaaagtttaatctgtataaatttttgtagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaaggtaagtgaaattgttggtatctcaagacagtaacatttgaaaggcagcagatacattcattttttcaagggtatgagcagtctatatttcacttattgacgaaaactgtgatcataatgataactagaatgaacaaatttgggactttatgatgaacttacctataacaaaaacacctggtcccggatgcattctttttatttattttaagttgacatgaagactgaaagcaaagatttttgaatgacctttctcctcaaatgaacctttgtgaacaactgtttaaaaacaattctgacacatgtatatgttacacaactaattttacctgaataaaatgtaacatttcatgaaatacattctacactgggtagcaatctacatgtcaagatcacttaggcttcctctgccctaaagacagaagaccatttgcttcccttctttccataatggaggaaatctctctcatgctcacttttgataggttattttttttttcaacatttctgtcactgaagcaagggatatttgatggcccctagaaacgcctagttatatcatcagagttttcaatgtgaaacacatgctaatatgacccaattttacattctttcagcccttaagaatacagcttattttttccatctaggaaacaagatatttcctagaactaaaactacaaaagactcgccaaaatagacattttatgtttgacagaattgaaaagtagttatcagaaatcccttagattaaaaaataattacatgaaattatatgtggaatgattatttgaatattttagaaactaataaagttgagaaacagagaaaaattttgccaatatgcctaaaattaaattttagagaaactgcattatttctcatcttctgatatctctaggcattaccgttaatcaatattacaaacttgaatttttttctgctaaagggacaatggaaaacacatttgaatttctaaaagtgtaaatgagaatgcatggcaacaaatataaagcttaaagatggttaaatacactgtgcaatttaaagaagatgacttttctctagcatcaaattaaaaatatctaaatagtacatcagaaaatctgtgagagaatcacagatgaaacatgagagtatgtttgatttgctaaagaaatgtatattttgtcttctttgtttaaaaaaatattacagaacttggcaaactgggaaaaaatgtaaactgtggaggaagatcaactgattttccatttccattcaagagaaggttataatatataaaatatctgaatatgctaaatttcaattttttcatatgttacataaaacacatttagtagcctataaaagtataaaattgttcttcaggtaactaaattagtaagcagtctttaagaaatcaatgtgctaagaacatatagaaataaagtcttttttaaatcactgttgaatccccactagtaggtgcataaaaatagtgggacaagtttattggaaattttcaaaagtaatcatcttcaatcctgacagctgaaagtctacttgaagtcttgttgcttcttcctttaaacgcttcctcccaagattcaattccctggcaagccctggcaattacttacccaaatgcattctgaatccactcacttcctcatctccactcctgcaaccacaatctaagcctccactatctgccttcagaaatacgacagtaactttctaactgggctcctctcctcctaacttgaccaccccaaccaagccattccacagtgatgtttttaggatataaattagttcctgtcattcttttctttttctttttctttttttttttttttttttgacgtagtctggctctgtcacccaggttggggtgcagtggcgcgatctcggctccctgcaagctccgcctcccgggttcaagtgattctcctgcctcagcctcccgagtagctgggactacaggcacccgcaaccctgcctggctaatttttttgcatttttagtagagacggggtttcagcgtgttagccagaatggtctcgatctcctgacctcgtgatccacccacctaggcctcccgaagtgctgggattacaggcgtgagccaccgtgcccagcctagttcctgtcattcttaagcttcaaaccaccagaaggtttcccaattcacttgagcctggttaggtccctttctgctttctagcctcatctactgcaaccttcatccttgactgaacacctataccagcctgatttcaatttcaagaacatttctaagctctttcctgccttggagccattcatcctgttattttctctgtcagaagtggttctccccacccttcaacatggcgggctggcccttttaccgttccagaggtcttcccggatcactctatgctgttcctcactattgctgcccccagccagtggtttacctcctagcacttatccctgtttgtaatcatatattgtatcttatttttcatttctcctcaccactggaataagccctgtgaaatagcaacaatatttcccttgccttccactaaataagtctgttgccttgcagagtgcctggtataaatagtgttgttttttgtttgtgtgtttgttttgtttttctttgagacggagtctggctctgtcacccaggctggagtgcagtggcttgatctccgtttactgcaacctccacctcccgagttcaagagattctcctgctgggattacaggcgcatgccaccacgcacggctaattgttttttgtatttttagtagagacagggtttcccatgttggccaggctagtctcgaactcctgatctcaggtgattcacccgcctcggcctcccaaagttctgggattacaggcgtgagtcactgcgcccgtccttaaaatagtatttttaaagagtttttgaattatatcttgtaactattatggaaacttccacaaataatccactacatttccagttagactttcaccacctttaggagcccaggaaattcactatcatttttcagaaacttgtaatatatcacctgtttactaaagtgtgagacaactgggttaagatatctccgatgctcattctaattcaaggatgagtcaccttaattttccatcttagtgttctatttctaattttccatcctagaattctattcctgattatagaattagaaaagtatgataatgggaaagttttgctatctctttggaagggtaatcctctttgtcttcctttacattccatgtaatgagaaagtatattggtattcatttctcaacctatcccaagtttaagaaactcagtagcatcagaggtcccattgaggccagagagctctaaagacataagattttgaaccaatgatattggctgcaaagtaatgagaacagttaaaataataataaaaatgatggcttacttgtactgagaatcatttacacaaaaagcttataattattctcattttacaaatgaatgacattaaatagtttccaaaggtcacacagcagtgagtggctaacatgtgattcaaagcatgtgttctctttgcctttctgtgccatgaagtcaagtcgagctaacgttaattaacattttaaaatttcttaatcctgaatgatttttatattgacgcttttgcctgttcatcatccttccatttcccctgcacctccatttttttagtattaatagtaatgactagaaacagatggaaaagactgtttccaaaaaaaaaaaacacctgagtatcactgttgatagtaattattctagtcttgtatagtatgattagtagtttccttgctttgcaagattagaataattatacctatatcaatggagtaattaatataagtatttttagttttaactgttctaaaatctttcaatagagatataggataatttcttattctacctaatcacccacatccaaaaataatttatgactatttaaaataaacgtaaagtggaagcatgaaagtgttgtgcttaaggtctctagaataaaatggagagctacttcatcaagaaagcctaggctagagatgtaattaaacacagtattttcattctgaacttccaactagtcaagacttaaaaggaaaacatgataaattgcttagctttgattatctttaacaaatgatggcttttacatagaaactgagtaatatgtcccatgcatttttaacataaggaacattgaatcaaaaaatttagtatcttctatagcggttttataaaagacgtagaatattgtccatgtgaccatttcttacatcgaccatatttatcgttatatttaattaagctatggcattgtccaggccttttgtagggagaatttacagccatgtagcctagaaattcagctcgttgtggactaacttgatataaaaattaagggacatgattaatctcaattgtattctttcttcccaggccttggaggaggaaacatgtttctttcagagtcccgaatagaagcactattactatatcacatgctaggctatcatattgattcttttctcacatgaattcatggagggggttcttatatttggtttatgctatttgggttgcccagcagaagatagaaaaaaatcaaatcactgattattaaaaacagttttgttggctgggcgtggtggctcatgcctgtaattccagtactttgagaggccaatgtgggcggatcacgaggttaggagtttgagaccagcctgaccaacatggtgaaaccctgtctctactgaaaatacaaaaattagttgggcatggtggcgcatgcctgtaatctcagctactcaggaggctgaggcaggagaatcacttgaacccgggaggcggagcttgcattgagcacagatcacaccactgcactccagcttgggcaacagagcgagactctgtctcaaaaagaaaaagaaacacaaaacaaaaacaaaaacaaaaaaccacttttgttattgatactattatggaaatgaaaataacattgttttctttctgaataactttcttaatattgaatgacaatttgaacaaacttaaacaatttttgctagtatgatttccccaatatcattaaataaaagaagggggacctatgtaaattctgatgatactacatatccccctctataattttaatataaaaatataaaggaaatattttaatgacatttagcttccagactaaaaattttggcatataaatggacataaaacaagaatgttctgctgtcagggatatggtggcatgttagaaagttgttgcatatgcaaagtgtagtgcatcttttaatatgatcaagttcagggaaggatatctttacatggaaactaaagtcacattaattttgcagggtgattgtgaatagagaatatattacattgtcacattgtagatgtttagtaaaaaggtgactatagttatcattattgacacaaagggagtctgtaactaatgataagaggtgaacatgtcaaaagtaatcttttccctgatatttaagaaatagttgaaaactttgaataaatgaattttatatttacacttatttttgtcttttttagaatgtaccgaaaaacatatcatatggttggtttggcatatccagcagctgtcatcgtaacattaaaggtgacataatttcattattttcgtgtataaaatggtcattttaaaaaattctcttaaaaaggctatgagaaaatgagaataggtctttactgcagcctacatcttagaacgttaaaaaattcaacatatcctaacaatttaaaaaatgaactgtgttccaaatcatgactcactgtagattcaaatgactgatttacacaaactatatcaacatatatatatgcatgtttgtatgcacacacacgtgtgttttttttcttaattttatttatgtggatcttgaattcattttgaaatggcactagtacttgtcaaaatgtacatattttgttatgaatatattatggaagagttaaatgcatgttataaaaagatattttagtcaatgatgtttaaatgacaaaacatacagaaggaaattatttaggattgtaggtctgaaaaaatacaaaatgtaagataaaattaagaaagaaaaaacacttctctctcttgtctttggcttctcctgtggctacactattctaaggcccaattgcagcgctacatatgttagaaataatcagagttgaaactctgaagtgagtaaagttattggctcacatacttgcctcattgtgtgtgtgtgtgtgtgtgtgtgtgtgtgtgtggtgttcatgtgccttgtttctaaatgttatttctacagaggcattttgtaggctcatccttctaaacttgtttcgattgcctaatttaatttaacattgtctcctaaaacatctgcatattggtttttctacattaaccaagaatttaaaggatattggcagcagcagatcttgggttgatttatttctgacttattgtactcctttttaattttaaatttgtgtttttaaaaaatttaagcatcttctttgcaattgttttttccctgctgcatattagattttaatctcattaatgttaaaagatagctcatttttctttggtgctttttttatatttatgtttctctgcctcctgtcagatcagaggggacactagattttgataggagcgcaaaccctattgtgaaatgtgcgtgtgagggttgtgcactgctgatgaggtggaacagtttcattccaaaaccatccaaccccaactcagtctgtagaaaaattttcttccacacaactagtccctggtgccaaaatattgaggaccattgcattaaaggatattaatcattcctcggttcttgagagattttgccttctctattatttccttaacaatgagcaagaaaattactcatttttattttatttattttaagaatctttgcttaaaaaccaactaacaaaatattttagtatgagagaatgtagtattttttctaaagtgttgtatagtaaaaaagatataaactaacaggttgagagagggaatatcaccaagtaaagaatgttttagttaaataattcttattttctgagaagcctccttgtcctgtttgttctcaatctgatgacataaaagccaagcatctgcagtagtttagaaatgtaaatcatcagggtttataaaaaattctcaagaaataaagaattaaccttttactcagtgggaacccccaagttggaactgtaaatataaatagcaaccttctaagagtctgaactaactcttgtttgttagctttggagtttgataaaagatttattgacctcctttgagatttactgatgtaaaatgccttctaacagaacttataataacttttaatatataaagagataaagcaagcatttggggatcaaataagggccaaatgcaaggaatttaataacgacatacaagcaaaccaaaaactgtttcattggtgcttgtttccaagtgattaaaaataccatttgaagctcttactattattttttgaaggaagtatttttaaaagagactgaatactttttatcagatttttagtttggttctagcatattatagcacatagagttggcctccagaaaaatgtgttgaatgaaatttgaaacgtgcctactcaaatagaaaattaacgcatagctttatggttgcccacttactgttcaatactaaacctactgtatgtgtataaacagtaggccttcctgctagcagtttctgataaccattagaatggactacagtgcttctatagattttcaaagcaaaatcatgaggtggctggagtggtttatatccctgctcactctcctctctctctgttagggggtactttccagtttccctactggcctgcttgcttccctagggaactgcatgaaatgcgagtattactatcctcctcctcaatcaaaaggcccacttccttttcctcaccacttgtccctcaagcaaagtattagtaagtcagccaaagatagagcaaataataatagttgaaaagtagtgtaaaaaataccttttaataattaaagatagtgtatactctatctcgctatgatatttacatatttttctatctttctttctttctttttggagatggagtctcactctgtcacccaggctggagtgcagtagtgcgatcttggctcactgcaacctctgcctcctgggttcaagcgattctcctgcctcagcctcctgattagctgggattacaggcgtgcaccaccacacctggctaatttttgtatttttttgtagagatggggtttcaccatgttggtcaggctggcctcgaactcctgacctcgtgattggcccatttcagcctcccaaagtgctgggattacaggcatgagccaccacaccaggccgatatttacatcttaaaacaggacataaatatcaaaactttatgccaaactgcaaactcttatggtgaaatttcaagcaatgtagcaagtgagtaagaaagaaaaaccgggactattttttctgtatttcccaattgacatcatctatgtaactagcaattctaccctaaattgaggtccactctgagaaaatgatttatggcaggaagttggagagagattaaagataatggcagtattatggtattatcaaatgtattaaatcactttagtaactttgggattaaagaaaaggttttgatgctttataaagcattatggcctcaattttgtggacccatggatactaagtggtcctgtcctatgaaactctggtcaaagtgtagtttgacatgctaaattgaaagatgacctgctaaatgtacaatgccttatcttttgaataaattctcgtagaaacagtatgatattggcacctaaagtatttattcttttttctacaggatgttgataaatggtctttcgatgtatttgccctaaatgaagcaagtggagagcatagtctgaagtttatgatttatgaactgtttaccagatatgatcttatcaaccgtttcaaggtcagaaacatggaacaaaagtgaaatgctcttagaattggttatttgagtaagaatgaaaatgcagaacatttgagtaattaagcaattcattttaggatgttttagttagcaggtcacagaattaaggtgatgaggtctttatatgatagaaccattctccacaagtcactgacacatctatatatccacctagagatcatgaggccactatagcctcattccagcaagatgccaatatcccctgacttattcacaaaacactcacatagggtttggcagctatgtcttaaagaaatatgactactccagcattcctaaaatacagaatgaacctttattgccagcttttcttaaattagaatgaaggggtttctaattaacttcatttagaaccatccaagcaatagatttgatacagactactgagcagattgtagcttattactttcatcatttcctgtagaatcatcacatttttagagctataaagtactgagagttaatctattttaacctctttgtattaagatagaaaaactagactccactaattgtaactggaaatatttacccttctacgaattagccttcctactctccggaagatactaaaatttcaagcctatagtacaagtaaggctattatttaatctgtcctagtcaaatacttgggggttacaatctttctttttgggaatgaaagttaacatgttcatgaagtggtttttcagaacaatcaacatttgacataaagaaactactgtccacatctgactcactaatatgttccatgacaaacagtgctcaggttgatttagtaccacttttttggtcaaaatataattataattattactttccacagattcctgtttcttgcctaatcacctttgcagaagctttagaagttggttacagcaagtacaaaaatccatatcacaatttgattcatgcagctgatgtcactcaaactgtgcattacataatgcttcatacaggtatcatggtaagacagtctttgtaactgaggtttgttagtttggaagcattccaaacttccattcctataagtttctattgtctctttaatgcccatagaggtattctaagtaataagtattataaagaataattgtttggatttttgaagcttaatgtgttataatacacatttttcaaaaaatactttaagtcagtgcaaaaaagataaccagaggcaaaaaaaaaaaagtttcccaaaatttggactaccaaacatttttgtttgtaaattcctttattctgcaggagtcaaccaaaaaaagtgacctagagaaaaagtctttagaaagaaagttatagcactctttttctcattccttatgtgctcctaacctgaccttagtcgcttttgctctcttactcatattactaatcacagtcaaattctaatagggatttggggaaattattaatgtcaatttttgcaaaatttccttcctcttctttgcatttgatgaatcagtgaatgggtgactaaacgattcagtgatgcaaagcctgaaataacagtgagtgtatgacaggaactctgagagagttgggaatttttgtaatgtcttagaactcaggatgattcccagaaggtaaaaagtgaggaactgaccttcctgtgaaggtgcaaaactgagctgggttcaaaaaaggagcaggccatgtgagatttctaaatcctagcacctgctttaatcgtgaagtgcagtgagaaaatgccatttcagcctaggaggcaaccagaatttcatcatttaaaaaaaaattcctgcttgaatgcattttttttacacttgctacaagtgtaaagggagccaaataaaagtctactatatcagcttcacctggtgtgaaggtgacattgaagagatgtgggtgtcatattaattggtaaatagagaaaatcaaatccacaatgtggttttaccctcagaattataaggaagactgttatgggaccaaataagccgttccaacttctctgtaagactagggaatttggcccagcctcgcatgactcctagaaagttaaagttgttagcaaagatcacatagtcactttctgagacagctatgacttaccaaatataaatgtaactttctgattttattcatcctttagcaaaaatgtgtcactggcctctttactcatccattaatttaaccattacaaaaatagtctggtggtagacctttagtgttttccagaaccaagaaaatacctttgaactaaagagaataatgagaacttttaccatagatggagaaagggaagacaacatgagtttatgaatgtattgactattttgtctaaactaggttacactgtcagcttgacaatttttggaaagttattttaacaagttttctctacattaaaaagtagtgataggtgactattaaatttcatgtatatgaatgtgttggttctttgaaacaaaaaagctttatagaaattttcattaggaaaaaatctttagttctttctcacccctcagatttgatataaagaagactgggccatctactttagtgttttagttgatgccctgctatttcagggtggccctatcagtgtgacatttatgaagcactctagtagcagcccagtactgtcaggagactaatgcatgttgtcatctgcaagatgttttaaggaccattcctgaaagggattgcaattaagccattgtccttctgtttgttaatgtcataagggacgccctcaagtctggatgtagacaatgccgaggagagttgatgctcatacacctgcttgtccccctatctctctccttttgtcacttgatacatttgtagtcctgtgccatggtgacagtgatgcacagtaactcagtccatttgctaaggagcaaatgttttataaagtgctgtcaagtcaccttcaaatgtctctttgaacatggaattatacaagggccttggccagaaaacatttgcattagagggctcctggccctgcgttctctctaatactaagagtagaaggaggagagatgactgtaaatctagttcctttggaatttttagtgcactgactacacagaaacagtcttccacactttggaatgactgcatttttctctgatcagtctacagaacatttagtactatatctttctacaaattatgtggaaattctgttcttataaatggcttccaatatgatactgtttggaagaggaaagagagcatggactcaggaagcagtcagacacgagtttaaaaccatgccccaccactttctaattcactagctctacattgcttcccttgtcactaaaatgcagttaataataccagccaccttatagaatggcaatgaggagtaaataaaacatttgcaaggcacctaacctagtgcctaaaacataatagctattaacataccttaattaattaattgtaatatgccaattttctatactggtaacttacagcaaacttcttcagcctattcaaaggaatagagaaaaatagtgtcaaacctcataaattctagctaaaagaattgttaattatgtgtttttagatacacaaggaatcaagaaataaatgtgattttctgacttgaaattctccccaccctttatataatacacatacatactttgtataatacacatatttactttttctgtcccacaggcacacactcacacatcctgagtaattcagacatgaaaattacattttaagtcctaagtcaaaactctattagcttctacccattcatatactaaaattagctagaaatcctacttttgaaaccttagaagcatgtgttcagcatattgccttctttatgtaatgaatgctattgtgatccgttgaaaaaatagaaactttgaaatcagacagatttgggtttgcattcctgctctgccgctagatacgtatgtgacctttgacatgttgatccatttctctaggattcagctttgttttctgcaacataggcataaaaatatttacctataaccatcttataaagtggttttaagaattaaatgagatcagctaactaaagtgtccagttaatgttaattcccttcctttgtttctgttataatacatgttattaatagcagtcaatacctccttataagttgatgactgcccgctctagagtaagccaacctgagcatttctgcagacaaaatacaacctaaaattctgatgaaatacagtgttgcattgctcatgatttatcctcttaaccctttatttctgcctattaggaatcagaagaaccttggatttgtattgaccagtgctgtagttgggaagagtgacaggatttaacctcgttctctctggcttgccctcaggagtcatttataaaatttatgaatttaagcacctgttttctgagttagaattccttctgataccagcacaaaatgaatcagcagctaaggaactaacaatcagtccagaattctacttttgctaatgcaaagtagatgtgtttttaaattaagtgtgaaagttcagtgtttcctctcttcctatattagtttgtagtggaacttaatgatatagtccatagtgcagaaataagtaagggggatttgtggagaaagtactatttatgggaggcagaaatgaaccaaagtaaaaacaggaaatgtatttataataaattttcacagctagcaagataataattgtaaatatttatgagtcaatcactaattaattccatctctgattttctaatttaatttctttttactattgacagtttatattctgtgttatcatagtagataatgaatgctgccttttttaaaaccacagctatatttataaatacataatttgaacccactcaaaaatttaaataagtgatttttttccattttctttaataaaacaatgggtttctagggtacaaaactagtttaacttcaattgctattcatttcatggtgtttagttccatagtttcattgggaacattggaggctcaatcccaattcagacctctataaggtaactttcttccttttaatgactcacaattaaatgtgtctatgaacacagaacagctagttatattaacttcttttggctctgaaaattatttctgcttcactcatccagttgtgaggcatttgtacatgaattacaatcactaatgatatgttagctattatttcccagatttaatgcctttatcaattcatttaacatagtaagttcctagcaaaatgccatttattctttattttaccatatgacaagacatgataggtgcagtgcatacattaacccaaaacttctttttaaaccccataggggaaagatcactaatgccattttcaccacaactgtagctaagagggtaaataacttattttcctgaggattaacagagatttaaaaccaggactgattccatggtctcttaccactgttgcctctttttaatgcaaaactacaatttaacaaacaaatactaagttcctaatatgtgccgaatatcatgataggttatgtgaagggagctaagattaataagattatacctttggtacctatgagattcaacaattgtcactgccttcatttttgactcatggacctacaatggctttcttttaccttttacacaaaatttaaattcatcaattctcatcaaattagtccattaactctttccatactctccatattcttcagttacacttcacttgattctccaacacgattgtactattgacaattctattttaatacagaccctatagtatgattctacatttgctctttctatttgaaattcttctgtctccatccttgcacttaactatcagcctttttccagccttttcccaagatctactgccaccaattagcctttctctctaggctcttaaattgcatctttattctgcaaacttttatcaagtgtgcacatagtttacatgatctctttctgttgtttttcgcaaagtcttttattgttttaagtgtacagaataagaccactcagagtgagtgtcatagcattttggattccgcattcgtaccatcaagtgccatctatttatagtgttctctagtagaacttgctgtggtgatggaaatgttttgtgtctgtgctgttctgtatggtaaccacttgtcacatgtgaccaatgggcatatgtaatgtggctagtgtaactgggaaagtgaatttaattttacttaattttctttatttttaacttaaacagtcacatgtggttaccatattgggtagtacagtataagggttttacaaaatatgagtgatgaaaaaactattgaattatttctaaatgaactaataatagcagggaacttttgttaaagcatctagttagtaactgaaagatgaatgtatgtaaagcggatagtcatggatttttacatgaaagcatttattctttcttttaacattattgaagttaattgcacagccatttttatgtgttatgaatagaaaaatttgtgaatttcagaaacttctaaatctctaaacatgaaaatgaagtgcactttctctagtaagaaagtgaatatttttaatttttagatgaaattttttttcatagtagattgttctacaacacttgggctaaaagacattttaataatgtatgagctgtatgataaaaatcaccaaactgtaattgatttcagaagaacccaaacatgtatggctgtaaattcaaaatccagttagggttcaccttttaaatcatagaaaactactcctttttcaattagcaaggacaattatattctgaattttgaacttatatgccatgaaacaatcattgacttcatgaagcatccatcttgcacaattagtggaggtaaaataggaaacaaattaaaagaaatgaaaaataattttatatgattacataaacagggtgcactgaaagtccttttcaaagaaaggaaagatgttatctacttcttgaatataatggattctttctgtaatttactagcactggctcactgaactggaaattttagcaatggtctttgctgctgccattcatgattatgagcatacagggacaacaaacaactttcacattcagacaaggtaagtttgaaaaagtattaactttcattagttaaaatttgaaatttatttttctgcatatcacttaagaggatttttaaaaaataataaagattctaataagaacaggtttaattaatttttagcaaaatttcttaagctgctaacaattgaatcaattaactactattttttaagaatcttgtgtatagtattttgtggcatatctagcaatttaaagaacatgaaaatgtttaagacaatctgtctctgcccagaacttacactgtgaactaccacacaagtcagacatctattcactgaggcaaatcttgcaacataatgcttaaggtactggtttggtgtcattatgtatttgaaagtaatacgagtgtacttctgaaaacaaaatccaaaaattaaatctcattttcaggccaacatgaagtattaaatttaaaataactagaaaatgaaattatttgatgatggttacaatggaagttatttaaatcaaataccagagtagaagtatgttagtctgttagggctgccataacaaaataccacagaatgggtggcttaaacaacatgaatttattttttcacaattatggatgctaggagtacaggatcacagtgtcagctggtttggtttcctctgaggttgctcttcttgacttacagacaacaccctttttgctgtgtcttcacatggtcttttctctgagcacatgcaccccagtgtctcttcctcttcttatatggacaccagtcataacggacttgggccccactcttgttacttcattaactttaattacacccttaatagccctgtctccaaatacagacacactgagagttagggcttcaacacatgaattttagggcagacacaattcagtccataacagagagttaccctaacctctttttagttaggcacagaagtcagtatctgagaagcaggatttggtctaggccccatcaggatccaacttactttacatgtgtgggatcctgaaatttctcttttactagtcaggatgcttaataaggagatatatgttaagagctgatgtctctcttgaaccactgcataaatctccattcttgttgaggaaagattagatctgatttttttttctaattaatagactttatttcttagagcagttttagattcacagaaaaatcgaacaggaagtacagagttgcatgagttccatatgcttcctcctgctaccttaaagtttcgttgttattaacatcttacactggtgtgagatatttgttacaattgattaaccagtatcgatacattgttattaactaagttccattgtttatatgaaggttcactctttgcattatgggttctatgggttttgacaaatgtataatgtcatgtatctaccattgcagtatcacacacaatagtttcacggccctaaaagtctcctgtgcttcagctatcattcctctcttcctgcccctttacccctggcaaccactggtctctttaatgtctctttgttttgccttttccaaaatgtcatagagctgaaataatacagtatataattctttcagactgggttatttcatttagaagaatgtgtttaatgttcctccatgtcttttcatggttgacagcttatttcttatcactgaatactattccattacatggacataccatagtttgtttatctattcacctattaaagcaaatcttggttgtttccaaatttgggcacttatgaataatactgatataagcatacatgtgcaggctcttgtgtggtcagttcatttggttttttaatatatatatatttttaacaactgattttccagatgtgggagttattgtttgatgtggggaatatagaaacagtttattaaaatattagacactttagaacttaaaggaccctaagatgagtgagatccacactatagatcatctggtctgatatccgtcatctaaaaatagaaaatgaagacctcgagaggtagagtgacctgtctatatgcacttggtcaggtgatggcagtggcagaattgaggagtgagaaaagggacactcactgtcaatccagttcttatataagtctgctcccacggccagagatggacacatgataattccaagctgttaaagcctgaaatggggtgggcttacacattgtagccccttgatggagacagaggaagagttgcaattcaaacagtgaagtgttggggagggcattctgtctgtccctggaatggaggaaaccccagggtcccagagattgatacagtttggagggaaaaggaaaacgtcagagtctggttatgtagcaggaatgttgtttttctacccatatttgcagagtatagggagatttttgcttttatttgtatttaatgtcaaaggaaaacaagactatgcagatcattttgcttaacaaaggctctctacatccactggatccacgatgtggaggattttaattaaagatcgctcatcactgagctgggctctgtacaggaaaacagttctaggggtttgagaagaaagcaagtgatttgttatcagtgaatgccagttgccctttcgactttgaaaagtaaaggccagtgggctggcctcttccagcagcagtgttagatcatcactctagctttctccttttactattcatctgcaagtggatgaagagtcctgatttacttatgcatttggctgtggagagggaggaggaggtggtggaggaaaggagggggatgacaaggaagaggaggacaagaaggggtagatgggggcagagaaggaaaaagaagaatcatgtttttttcaatttatattttaaaactctgtataaaaatgggaaaaaattgtctaacagggtcaactatttaatgaattaattctacatgaacttgaaaattccatgaaccaaaatgttgtaatgaccaaaatgcaacaatataacatgatttttaactctcaatattgccttcatccaagatgaaataaggtcatatgtcatttatatcactaattctattttattttatattattcattgttacttggattgagagtgttttttccaatctggaaactaatttactacataatacaaaatggctaaaatgcgatttggaacatagggcaaggctagatttgagttcaatgcagatattataatgcatgaaatccttgaaagtgtaaataaatggaaataatttcctctttgtgaaaagaaaatgccaggctacatgttaccatggatactggatgttgctcagagtctgttcttttcttagcagtcaaagaccatctcaaacattagaccatgctgcattctcagcatccttgttagctttatgagacaaaatcatgcatactttgctacaattaaatctggttcaaaaacacattttagcttgtttctgaaagagtagatggtgatgcttggagccatatcatgtaataaccctgacaaatctgctatggctagatttggtgccatatagtgcaaatgttactggaaaatcacagctttccccatgatctcagcaaacttctagaaatgcacacagtgttttgcttgggaaacatctcttcaattatctcttcaatgagaattatacatgtgctttgctagttcatatttctgtatattgaggtatgattattcattaaatcctttttaggccttaactaagattattaaatggaaatctattttagaaatatgtgctattaaagacatatattatttcatctttatgatagtgctagaaaaaaaaagaaagtaatagtgcctggtaggtcatttatcatatgttggatgaataataaagcttggtttatctggcagactatcagacacagatcttaaacaggctgcttgtataaaatgccagatttctttagtttttgttttctctgttgttattaaatagtttttattgtgtacatttatggtatataacatgataagatacagatagtaaaatgattattatacagaagcaaattaatatatccatcatctcacatagctatccatgtgtggtggtggtggtgttgttttagtgggaacttttcattttttattttgtccttgtctactctatcataaatattcagtggcagggccagtgctaggttataactaggactttacccactgaaaagcctgaaacagtaagtctggagtgaggcagttttacacttgacagcattaagtatctaccaggagataggagagtgagagaagcctcggtgttgggtaagtggtagcaaacttgctacaagttttaacttgactttcttttttgctatatttgttgtcaatattcaacttgccaacttatatgaacgagttcaccattttaagagattgaacatagtgattttgcttccattccacacttgcataatgatctggcaacctaggaggatagaggaaggacaagcccaggttccattatacagatctgagaatgcttgaaatatttcaggcttaaagttagaataccaaattcatcaatgcaacttgaagtataccaatttatttcataataaaattatattaaaatacagacaggtgagaaataaaagccttcccttgatgtattcatcattttaaaaataaaatcttccttttaaatgggtgatgaagcatacattttaagttttctttaaaaacgacttttctatcttaattttaaagcaaaaggatctataacaataaaatttaatcacattataagagagtaaaaaactagaatcataaatagatcaaatgattttcatcatccccttcacctgctacccaaagtaattttagtttaaaggaacagggatggtatcaacactcttgaatgggtacaaaggggtttgttcattcactgactgaataagacgttaggtaattttattcactttgatatatctagagtattttgcaggtgtctggattacaaatcagaaggaaaagccataaacacatttaaactataataatgataattaaaacaacgctaagcaccacaactaagtggggtttatcccaggtatgcaagtctggctcaacattcataattcaactaatataatctaccacatcaacagggtatacaggaaaaaaatcacatgatcttatcaataaatgcagaaaaagcattttacaaaacattccaacccacgtttatgatataaactccaactaggaatagagaggaccttccttaacttgataaagaatatctatactagagtagaattgtggttatgagggactggggtggagataaaagttaggaagatgttggtcaaaggatacataatttcagttagatgggataaataagttcaagagatctattgtacaatgtgtcaactagagttaataacaatgcattgtattcttttttttcttgtttttttaattttttattatactttaagttttagggaacatgtgcacattgtgcaggttagttacatatgtatacatgtgccatgctggtgcactgcacccactaactcgtcatctagcattaggtatatctcccaatgctatccctcccccctcccccgaccccacaacagtccccagagtgtgatgttccccttcctgtgtccatgtgttctcattgttcaattcccacctatgagtgagaatatgcggtgtttggttttttgttcttgggatagtttactgagaatgatgttttccaatttcatccatgtccctacaaaggacatgaactcatcattttttatggctgcatagtattcccatggtgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcgaatggtatttccagttctagatccctgaggaatctccacactgaattccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagagtctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcattatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgaaatatgtcccatcaatacctaatttatggagagtttttagcatgaagggttgttgaattttgtcaaaggctttttctgcatctattgagataatcatgtggtttttgtctttggctctgtttatatgccggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctttggaatcggtggtgatatcccctttatcattttttattgcgtctattagattcttctctctttttttctttattagtcttgctagcggtctgtcaattttgttgatcctttcaaaaaaccagctcctggattcattaattttttgaagggttttttatgtctctatttccttcagttctgctctgatcttagttatttcttgccttctgctagcttttgaatgcgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttatcatttctgttcttttacatttgctgaggagagctttacttcccagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaaactggatgctcctgtattgggtgcatatatatttaggatagttagctcttcttgttgaattgatccctttaccattatgtaatggccttctttgtctcttttgatctttgttggtttaaagtctgttttatcagagagtaggattgcaacccctgcctttttttgttttccattggcttggtagatcttcctccatccttttattttgagcctatgtgtgtctctgcatgtgagatgggtttcctgaatacctcacactgatgggtcttgactctttatccaatttgccagtctgtgtcttttcattggagcatttagtccatttacatttaaagttaatattgttatgtgtgaatttgatcctgtcattatgatgttggctggttattttgctcgttagttgatgcagtttcttcctagtctcgatgggtctttacaatttggcatgattttgcagtggctggtactggttgttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttaagaatgttgaatattggcccccactctcttctggcttgtagggtttctgccgagagatccgctgttagtctgatgggcttccctttgagggtaacccgacctttctctctggctgcccttaacatttttttcttcatttcaactttggtgactctgacaattatgtgtcttggagttgctcttctcgaggagtatctttgtggcgttctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcgtttctttttattcttttttctctaaacttcccttctcgcttcatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagtcttccttctaacagacaggaccctcagctgcaggtctgttggaataccctgccgtgtgaggtgtcagtctgcccctgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggggcctacagaggcaggcaggcctccttgagctgtggtgggctccacccagttcgagcttcccggctgctttgtttacctaatcaaggctgggcaatggcaggcgcccctcccctggcctccctgccgccttgcagtttgatctcagactgctgtgctagcaatcagcgagactctgtgggcataggaccctccgagccaggtgcgggatataatctcgtggtgcgccattttttaagcccgtcagaaaagcgcagtattcgggtgggagtgacccaattttccaggtgccgtccatcacccctttctttgactcggaaagggaactccctgaccccttgcgcttcccaagtgaggcaatgcctcgccctgcttcggcttgcgcacggtgcgcgcacccactgacctgtgcccactgtctggcactccctactgagatgaacccggtacctcagatggaaatgcagaaatcaccgtcttctgcgtcgctcacgctgggagctgtagaccggagctgttcctattctgccatcttggctcctccccaatgtattgtattctaaaagattgccaagagtagattttaagtgttctcacctcaaaaaatggtaaattgtgaagtaacacatatgttaattagcctgagttagccattccactatgtgtgtgtgtgtatatatatataaatgtatacatatatatatatagaaagatatatatgtttcaagacattatctcgtacgtaatatatataattttaattgtcaattaaaaagtaaataattcaaagaaaattatctatttataaaaaacctacaactaacatcatacttaatggtgaaaaagttgaagctttcccactaagattgtgaacaagggaagatgtcccctctcacaactaatttttgtatcatactggaagtatgcaatactaatgcaatacaactagaaaaaggaatttctctcttcccatgaatcttgggaagagagaaataaaattatctttgtttgcagatgatatgattgtccatgtagaaaatctggaagaattgaccaaaaaactcctggaactaagtgattatagcagggttgcaaaatacaaggttaatacacaaaactcgattgcttttctatatgccagcaataaacaaatgtaatttgaaattggaaacacaaatatcatttgcattagcaccactcaaaattaaatatttaggtataaatggaacaaaacatatacaagacctttataagaaaaactgtaaaactttgatgaaataagtaatacagggacagatatttcatgttcatagatagactcaaaattgtcaggatgtcagttcttcgcaacttcatctatagatataatccaatcccaatgaaaataccagcaagttattttatgattctgacaaagtgattctaaagtttgtatggagaggcaaaagactcataatagctaacacagttttaaaggagaagcacaaagttggaggactgacactacctaactttaagacttgctacaaaaccacagtaatcaagacagtgtagtattgataaaaggacagacaaatagatcaatgaaaaagagtagagagcccagtaatgaacctacaaaaaatatagtcaactgatctttgacaaaggagtaaaagcaatacagtgaagcaaaaataatcttttcaataaatggtgctaacacgactgaacatccacatgcaaaagcaaaaagcaaagaagaatctagacacaaactgctatggtttgaatgtgtttcccagaattcatgtgttgcaaacataactcccaatgtgacagggttggaaggtattgaggtcaggagtgttctatcctgataaataaattaatgccattataaaatggggcttgccagagagggtttgctctcttgcactctctgcctttctactatgtgatgctttccaccatttgatgatacagcaagaaggccctcctgagatgatggtatgttgatctttgactttccagttaagaactgtgataaataaatttcttttttttttttgataaattacccagcctcaggtattctgtcacatcagcataaaacacactaagacacaggccttataccctttacaaaattaactcaaaatggatcacagacctaaatttaaaacaaaaatctataaaattcctagaagattacatagaagaaaaatctagatgaccttagatttggtgatgactttttaaatataatatcaaaggcacaatatatgaaataataaattgataagttggatttcattaaaattaaaaatttatgctctaccaaagacactatcaagagactaaaaagacaagccacagactggaagaaaatatttgcaaagaacatctgataaagcactgttatccaaaatatacaaagaatgcttaaaactcaacaataagaaaactaacaacctaatttaaaaatgaaccaaaaactttaccagtcactccagctaggaagatatacaaatggcaaataggcatatgaaaagatattccatatcatgtcatcagagaaatccaaattgaaacaatgagataccaaatagatcaataggcaatacacatctattaaaatggccaaaatccataacactaacaacaccaaaagctggtgagaatggagcagcaggaactctcatttattgctagtaggcatgaaaactggtatagccattttggaagacagtttaccaatttattacaaaattgaaactactcttaccatatgatccatgaattgcactccttggtatttactcaaaaaaattacaaacacattcacacaaaaacttatagcacagatacttatagcagctttattcataattgccaaaacttggaagccagcaagatgtccttcagtaggtgactgaataaataaactgtggtatatgcagacaagaaaacttgagtgctgcaaggaaattagctatcaatcggtgaaaagacatgaaggaaacatgaatgcatattactgagtgaaaggaaccaattgtattatcttcttctcacactgctataaaaagctggcagagaatggataacttataaagaaaagaggttcaattgactcatagttccagatgccatacagaaggcatggctggtgaggctgggaggcctcaggaaacttacagtcgtggcagaagggcgaaggggaagcaagcatattttcacatggtggcaagagagggagtgaagggggaagtgctgcacacttttcagcaaccaggatcttatgagaactcactcattatcatgagtaacagcaagcgggatactcacccccatgatctagtcacctcctaccaggtccctctaccagtactggagattacaattcaatatggaggatttgggctagcttcttaaggtgaaacagatataacttactttattacacattttttttctaatgtaagtatgtgaagctataaaatttcccctaagcactgcttcagttgcatccaacaattttcaaatattatgttttcaaaatcattcaacttaagatatttaaaaatttcttcttaacctgaaaaatctttgtatctctttatttttctgtttttgcatctctaatgtcacagggctatacagaaagatctctggttgattgattgagtatatcattataatttttaattgaccataataagcagttgacctttagaatttggtnnnnnnnnnnnnnnnnnnnntgtgagtgaggagtgtaatgagagatgagtatagaggagagagagaagtagatcggagcgagagagataggtaggagagagagaggtgtgagccaggtaatgtgcatgttgaattgtaatcaacatttggctcataatatggttgggctctgtgtctctcatccaaatctcatgttgaattgtaatcccataattcccatgtgttgtgggagagacgcagtgggagataattgaatcatgggggtggtttcccccatactgttctcgtgatagtgaataagtctcacgagatttgatggttggataaggggaaatctgtttcacttggttctcattctctctcttgcggccaccatgtgagacttgcctttcaccttccaccatgattgtgaggcctctccccagccatgtggaactgtaagtccaataaacctctttcttttgtaaattgcccagtcctgggtatgtctttatcagcagcttgaaaatggactaataatacattattccacttctggcccctcctgaatcacatgtccttctcatatttcaaaaaaccaatcatgccttcccaacagtccccaaaagtcttaactcactccagcattaactcaaaagtccaactccaaagcctcatgtgagacaaggcaagtcccttccacctatgagcttgtaaaatgaaaaacaagttagttacttccgagatataatggggttacaggcattgggtaaatgctcctattccgaaagggagaaattggcccaaacaaagggactgtaggccccatgcaagtctgaaccccagcagggcagttatttaatcttaaagaccccaaataatctttttgactccatgtctcatattcagggtatgctgatgcagggggtgtgctcctacggccttgggcactccacctctgttgctctgcagggtacagcccccatggctgctttcactggctggcgtccagtgcctgtggcttttccatgtgcacagtgcaagctgtcggtagatttaccattctggagtctgaaagacagtggctgatatggtttggctccgtgtccccaccaaatctcatctcagattgtaatccccatgttttgagggagggacctgttgggaggtaactggatcatagggacagcttctcccatgctgttctcataatagtgagggaattctcatgagatctgatggtttaaaagtggcagcatcccccctgcactctctctctcctgctgccatttaagatgtgccttgcttccccctttgccttccatcatgattgtaagtttcctgaggcccctgcccccaccagccatgcagaactgtaagtcaattaaacctctttcctttataaattacccagcctcaggtactatctttatgacattgtgaaaatggactaatacagtagccctcttctcacagccccactaggcagtgccccagtgaggactatggggactctaaccccacatttcccctccacactgccctactagaggttctccatgaggcctctgcccctgcagcagacttcttcctggatattcaggcatttccatacatcctccaaaatctaggcaaaggctcccaagcctcaattactactgtctgcatacctacaggcctaataccatgtagaagccaccaaggcttggggctttcaccctctgaagcaatggcctgagctgtaccttgtcctctttcagccacgactggagctagagcagctgggatgcagggcacaatgtccaggatgcgtgcacagagcagtggaggccataggcctggcccatgaatccatttttccctgctaggccttcaggcttgtgataggaggggctgccatgaaggtctctgaaatgccctggagacatcttccccattgtctgggctattaacattaggtttctctttacgtatgcaaatttttgcagccttgaattcctccccagaaaatgggtttttcttttctacctcatggtcaggctgcaactattttaaacttttatgctctgcttctcttttaaatataagttccagtttcaggtaatttctttctttatgcaaatgagcataggcttttacaaacagccaaaccacatcttgaacactttgctgcttagacattgctttcaccggataccctaaatcatctctctcaagttcaaaattccacagatttctagagcaggggcacaatgccatcagtctttttgctaaagcatagccagagtgacttttactcaaataagtactcaaatactcagagtcccaaataagttcctcgtctctacctaagacctccttatctctacctaagacgtcctcaacctagtcttcactgtctgtatcactatcagtattttggtcacagccattcaacaagtctgtatgaagttccagactttcccatatcttcctctttttctgagccctccaaactgtttcaacctctgcccattacccagttccaaagttgcttccacatttttaggtatctttatagcaataccccacgctcagtaccaattttctgtattagtccattctcatactgctataaagaactacctgagactcagtaacatatcaagaaaagaggtttgattaactcacagttccacaggccatccaggaggcatggctgggagtcctcaggaaacttacaatcatgatggtagggtgaagaggaagtaagcacatcttcacatggtggcaggagagagtgcgaagaagaaagtgctacaggcttttaaaccaccagatctcatgagaactaactcactatcacaagaacagcatgggggaagtctgcccccaagatccaatcacctcccaccaggtccctcccctaacactggagattacaattcaacataagatttgggtagggacacagagccaaaccatatcagcaacatactgtatgattccatctacataacattttgaagaaggcaaaactatggagacagtgaaaaaaatcagtggttgccagggttaggggagagaaagggatgaagaggtggagcacagagggatttggggcagagaaactactctgtatggtactataatagtagatacatgtcattattcacttgtctaaacgcatagaatgtacaacaccaagagtgaagcctaatgtaaactgtggacattggatgataatgatgtgtctatgtaggttcatcaattgtaacaaaaataccactcttgttggggatgttgacaatgggggaggttacgcatgtgtggtagaagaaagtacatgggaaattttgtaccaacttccattttgctgtgagcctaaaacttctctaatagagtttatataaaattttaaaatatcatacagtaaaaaataaaagaaactaagtacttccataattctcactgttcaattataggatgttttctggtcacatgacttgatacttgagtaagtcttattagacattcatgatgtctaaagaaatcctctgttgggcattttgtttttaattcttaggtcagatgttgccattttgtataatgatcgctctgtccttgagaatcaccacgtgagtgcagcttatcgacttatgcaagaagaagaaatgaatatcttgataaatttatccaaagatgactggaggtgagtttcagagaaaacctagaggaaatttaatttcaggaaaggaataaattatgcgatttaaagtcaagaaaaaagatgaaagtcgatgcattccccaaattacaaacttaattactgtcgactggatgactctgagaaggattagtacttagggactttgttcagagccagactgtgttaaagggacctgaagtatttccaggtcaactcaacatccatatgtctgaataagaccacacacaacacaacaaataattttatatacataattacacactctctggaatggagctctgctcaatttttatcaatatggggtgttacataaattcaaaattttggcattatattcattctttcatatattttttttaaaagatgtggagttaaggtttttttaaaaacaaaaagttaaacgtgggaaaaaaattccaatatactaaaatgacccaagtgcagaggaaatcttacatgtttctccaaagcatctgtttgcttgaaaaaaattacatggtatattgatacttgttgctatgtagggaaaaataacaagatgtacccccatccctcttataacctttcttctctttttcttgatcctttggtcattatcatctccttcaattgacaatagggttgctggacttcacaaataaaagtaaaggacaatcaattaaatatgaacttcattaatcatagaatcttcttagtatatgtccctaatattctatgggactctcttatagtaagaacagaaaaaggcctgtatttatctttaacaacaatcttattaaaagtcatttaattgactagaaaaggtttccaattgaatgtaaatatcaaaggtttttgctttcatttttgtttttttaaatcaaggtaaaaagaaatatccaaaaggaaagtgacaataaaaacattaaaaaacgtaaaagataaaaatcagagtttaaaataagcctaaatctcctgtgaacactttttcaaattttcaaagtttcctggttcttcaaggccatatctagagatatgggctcatttttgcaactctagaaaatgctgtcaggtagagggaaggtggaactttcttttggagacacagttcaggcctttcattttacagttgacccttgaacaatacaggggttggggcacccccattcaactgaaaacccatgtataccttttgacacttcaaaaacttaactactaatagcccactctggataggaagccttaccaataatataaaagttgataaatacataatttgtatgttatttgtattacatacaatattactacaataaagtaactagagagaagaaaatgttattaagaaaatcataaagaatagaaaatatatttactgtttattaagtggaagtgggtcatcaaaaaggccttcatcctctgtctttatgtggagtgggctgaggaggagaatggaagaggagggattggttttgcttctcaggtgtgacagaggggaaaaaatatgtgtacgagtggtcccacacagttcaaacttatgttgttcaagggttaactgtattctgcaggaaatagtagcccaagaggatttacagtctagaaatgccaggatctaactgtgaaataattttaaagagaccactgttgggctatgtagcgattagatgggcaaaggtaggaacaagcagacaagttctgagatatttcctaaagcctaagagagattatttacatctagggtattagtttattttcttaatcagtgattaccattcccatagataatttttataatattaatttgttgttattcaaagaaataaacattttttcctcaaagttcactttgttgctatttcagtgtgattttatttcctattatattttgttatttaccattttaaatattttattctaatagtttattgctgtaattgtctaagtttctgtttggtaacttcagagtcattttaattgaatgtttttaaagaattgttttaacaaatagtgtacatattatatacattttagaatttaatagattcaacactttccaaaaatctataaaatacctatttgatgctatacgtttgataacattttactaagaattaaaatatggatatcttcttaaagactgatgttttctgtttacatatctgtttatttcttaaagtacttttagtaaaaataaatgcattaatttaaaagttttcacaagaaaattttataaattaagtaatgttttcttattttgcctaattattgacatattattagttggttattgataacatctagcatttactgatcatttatatgcaaagcacaatatacttattagattctattgatttccttaaactctaatctcattttccttagcaaacataaatgttcttattcagttgcttttcaaatatgggtcttgtcatattttcagcgaaaaaaatgtaattgagaataattttattaatagcttcctttcccttactacttgaataaaagtaagtaagcagagtattgattctcatggcttctatctaaaaattcaatagaaatgttgagtgctcatgattttcagcaagaaccatcaatatgtagttttgttttgtttttttttcagacggagtcttgctctgtagcccaggctggagtgcagtggtgcaatctcggctcactgcaagctctgtctcctgagttcatgacattctcctgcctcagcctcccgagtagctgggactacaggtgcccgccaccagggctggctaatttttttttttgtatttttagtagagacggggtttcaccgtgttagccaggatggtctcgatctcctgacctcgtgatccacccgcctcggcctcccaaagtgctgggattacaggcgtgagccaccatgcccagccaatatatagtttttttaaaaaggcaattaaatagattatatcatctttaagtaaagtatctttgtgcaagatcgtaattcaagtttccttcacacttttggttcagcttatcctactggccacaccacacaatgaaaatgaaatatgttttccagtacaagtgacttttttaacttatctgtatagagcaaacaaggaattgtggaacatgcaaggctttgctggggtgccttattttctactaagtgtgaggctttgtgacatggttattgtatttacagtgccttggttaaaatagtcagtaataccaatggctctctttatgttagggagggtcagatcccaaaagcttaaacagaaaatcactactcactttagcatcttggtttctctggggttcttatgatggaagcttggcacagaggagtggtccatgtgtctgctttggaagtgggacctcttgcgttgaatcttatctgagccatgtaccagctgtgtgactgggtgactcagtctcctttggggggaaatattaatgctccctcaggattgttaggaggattaaatgtctttgtatacatacaaagcaactagttgctaaagtattttattatcggtattatatgaagacatttaatccttacagttcagtgccttgctgaataaatactgaatgaatagcactggttttattaatagtagtcgttttgattaaaaatgcaaaatgaagaagaatcagatagggtcttgaaatctcatgctcttcttatctctgtctcttctctgagacatcaaaccttttagtttggttgacatgtggatttagaatagtctcaggccccactggactactttttttcctcaaagcattgaaatactatataatactgtatttggaatagtttttctttaaaatggctaaagttcctttcagattaaaaataataatatttaggaattatgactgcagaagagttgtgggagtgagaagggaaagcactagctcttcagggaggtgtgaacatcgttgccattctcgctgctggcaacttcttagatccatgacagttaaaaggtaaaataatatcaaacttgtgtgtggactttcacatttaaaaagtagcatcttttgtgttcatatccattaagaactataaaacatggtgagtgattatttattgaagtgttccacttcagaacaataaatggctgaatgaacctttctccttttggtgactctgcagggatcttcggaacctagtgattgaaatggttttatctacagacatgtcaggtcacttccagcaaattaaaaatataagaaacagtttgcagcagcctgaagggtaggttttgtgttttttttgttgttttttttttttttgtcatgttaaagttccaggggcttggcctcagaaaagactgtaattgtttcctttgttttgaataatataagcatgtccttggtttgacaggattgacagagccaaaaccatgtccctgattctccacgcagcagacatcagccacccagccaaatcctggaagctgcattatcggtggaccatggccctaatggaggagtttttcctgcaggtgcctctttcacactctgtgcaaatgtttttggaaatagtgactgtgcatattagcgtacaccttttctgtatggaatccagggcttgtgacttactattatcaactggccacctacacattcttgggggtttcagcaaaatttattagtctatcagaaaggtgtattaagtctatgtagtgtgatacatgttttaaagagattcaaattttggatctgagatgctactgtcaggaaagaaaaataaaagcagctaagaattgttatctgctgttaagacgtaagtgccacagcagagacagcaaatagctttcataatagaaagagtagataaggatatataacagttctgcataaatcttgttggccagaattttaatggaggccaagaaatattgctttagctgggtggacacatgcctaactgaaataggcaacaacaacaacaacaaaaatctaatgttacgtcagaaacaagcccggataaggattgtgactggcgttctctgccacaagtacacatcttttctttatacatgtccctgttttgcaacccccacaatccaagctggagtgctacaatacaaatgtgatgctaaccactcagagttagcatcaaattgcacaaattaagggctcagtcttccacaagattggctctacttcagatgccagctgcaaatggggctgtgggacaccagcacttctgaccagccagttacaagttcagtggttcccacaaccctctctaggtttgataacttgctagaatgactcacaaaacttcaaaagtgctatccttacaattacaattttattataaagaatacaatccaggcagagccaaatgaaaaggcccataaggaaaggtctgggagggtcttggatgcagagcttccttgctatttccagtggagttagcgagtaccaccatcctgccttgtcaatgttttcaccatccaggaagctctactgagctttcctgtccagagtatttatcaaggtttcattacataggcatggttgattaaaccattggacatgcgattgaactcagtctccagcctcacttccttcccagatatcccctggctggcttaaagttccaactttctaatcatgtggttggtttctggtgaccaggccctatgctgaaactatctaggggataggcccagagttgcctcattagcctagagtctcctatcactcatgaaattccacaggtttttgaagctctgctaggaactgggaatgaatatcagataattttgttttattatatcacagtcccacttagagaagttcttttatttctgtattttcagattatttcatttctcagtattgttctttattttgaaagtttgttcattaattttatacctgttctgaagatataaacaccaaatatattactatgtttggatgactcacgtttctgtctcccattgttgatggacataatgtgtggtattttgaaagtttgttcattaattttatacctgttctgaagatataaacaccaaatatattactatgtttggatgactcacgtttctgtctcccattgttgatggacataatgtgtggtttcatttttatattgcaatttatattcctagagaaagttactgagtagcatcttactaaattcaaatattttggtcctaaaaatagtattgaaaaatattttaataatttgctttgtgctaaaaaaatacactaaatgtaaaaacctaccaaattctaaaggtcaactgcttattatggtcaattaaaaattataatgatatactcaatcaatcaaccagagatctttctgtatagccctgtgacattagagatgcaaaaacagaaaaataaagagatacaaagatttttcaggttaagaagaaatttttaaatatcttaagttgaatgattttgaaaacataatatttgaaaattgttggatgcaactgaagcagtgcttaggggaaattttatagcttcacatacttacattagaaaaaaaatgtgtaataaagtaagttatatctgtttcaccttaagaagctagaaattaagaaaattgaatcaaaataagttgatggaaggatataataaatataaaagccaaaaacagtgaaacagaacaaagacaaacaataacaaaagttaatgaagataacagttggctctccgaaaaagtaatgaaattacttgcaggatcaaaaagaggaaaaaactataaatgaaagagagaatatcattatagagcctgtattcatcaaaagggtgaggaatattatgcacaatttatgccaataaaattgaaaacttagatgaaattgtcaaaatttttgacagatataaattaccaaaacagacacaagaaaaaatcatgtagtctgaatattcatatatctgtttcaaaagttgaatttgtactttaactcttcttatgaagaaaactctaggcttagatgactttaattcttatttccgatttcaattctcaatattcaattcaattgagagatggagaattttctcaaacatttcaggaagaaataatgccagttttacacaaattcttttatgacatagaggaagaggaaaatttgacagcataattctcgacattacctgacaaagacttttcaagtaaagaaaattacacatccacatctgccataaaactgaaagagaaatttttttttaatttttaaaatttttagcaaatcaaatccagcaatttagtaagatagtgcatatcatatcataacttgagtcagtttaatattaaaaaattaaggtaattcaccatattaaaggaaataaaggaaaaaatatattaattatcaaccctatagatatgcaaaatgcatttgacaatattcgacagacattaattataaaaactgttagtaaactagaagtagaagacctttctcaacctgatcaaaggtctatagcgaatgtgatacttcacaatgaaatactgaacatttttattctaagatcattataggtactcttaccacttctattcaacattgcatttgaagttctagccagtgtaggaaggtaataaaaaacaaagtatagtttgaataaaaataaataaaactgttatttgcagaaacatgagcatctgcatagaaaacctcaagagatctacaaaaggctacttactagaattaataaatgagtttattagttgtagaatcaattgtgtttctgtatgcaagctgcaaacaatttgaaaataaaaattgaaaacagtatgctttataacagcataaaataataaaattttgggggaaacctttaattaaatgtatatgaaacctccacactgcaaaccacaaaacatttttgagagaaattttaagacctatataaatggagagatatgttaatgactgaaagactcaatatttctaagatgtcaattcttacaaatttttaataaatttagcataatctttatcagaaattgtaacaggcttatttgtagaagttgaaaggctgattctaaaatctgtatagaaatataagagtctaaggcagctaaaacaattttgaaaaagattaaagaagttggaggacttacacttcctccttatgtgagttagtataaagctacagtgatcaaggcactgtgttattggcatagggcatagggctaggcaaatagatcattaaaatagaggagtgatttcagaaacaggctcatatatataatgtcatgtgatctttacaaaggcaccaaaacaactacatggggaaaggaaagtctttccacaaaaggaaatggaacagcaattagtgaatgtatgggaagaaaaggaaacttgtcccctacctacaccttaacacaaaaactaattcaaaattaaggagtttaagacaaaacctaaaactataaagatcttagaggaaaacgcaagagaagatctctctaatctcgggggtaggtaaatatttcttagagaagacacataaagcattacccataaaagaaaaaaaaaatgaagtggaaaaaagcaaaactcaaaacttctgatcttccaaaggcactactaagaaaatgcaaaccatagactgagagaaaatatttgtactacaaatatctgtccaaggacttgtgtccaattgcatatagaactccaacaaatcaatagtaaaaagaaaatcaggccaatttgaatggatattttataaaaggaaatgtacaagtaggtaatacttacatacaagtatgttcattttctttacttatcaaagaattataaattaaaccataatgaaatatcatatagccccatgagaatgactaaaattaaaataattgaaaatataaggtgttaccaaaaatgaggaacaactggaggtatcatacatacatcacaggtgggaggataaattattacaatcactctggaaaactactggatatcatctactgaagttaatatgaagggatagttaatatcccttaggacccagcacttttacccctagataaatgagtatttatgcccaccaaatgtcttatataggagtagtcattatactactacttaaaaaaactcaatgctagaaacagtccaaatattcatcaaaaatagaaatggataaaaaataaatcatggtacagtcatacaatggaatatccagcaacaatgaaaaatagactaatgatacaaatgacaataaatctcaaaataatactataaaccaatttatatgaagttcaaaaattggcaaaattaatatatggtgatagaaatcagaacagtaggtgcctatatgggttaggattccttggacgaggttaaggcaactttctgggggtaatggaaatgctctatatcttaatcaagtattatacaagtgttcctgtttatacccttcagatttgcccataaatttccctttaattttttttaaaaagagtatatcataatgaaggtagctcatctctgacttaaagaagaccctaaaaaaattactgtgggaaaaaacaaaactaaaatcccagagactcctgaagattaccattagatctccaaataatatcacgatttgtattatccttttgttttactgatttcaaaacagacaaagaatacctgacaggatcatgagattagtaaattcaatgaaattgagttcagatctgttgaaagttcaccaatttctggatttttaaaagtaaacgattttcaaatccccttcagaaacatatgcagcaaaacagaaaaatgtggagctaaaggtcaaaataattaagtttatactgccaacaaatatgtctttcaagcaaaacaagtttttctttgtgaaacttaaactgaaatatgatattaattccaacaggtaaaatgttttcttgcattgaactaactaaataaatcccatattactctcacttattcttagtcatactgcataatgtacacctttggaggtaaataagcaatgaacctgaaactccttgctgtatgcatttctctgatttgacataagatattgaactgtgtctatgtatctatgcatatgtcctagaaattagcaggactgcagtggttcttgtatgttttatttttgttcatcctcacatagccatctgtaaaactgtcactttgtcagacccacagtactgataccattctgctctgcatttagccaaggtgactgggtttttcatctcggacagtgaaaacagcacttttacaaagcaatttgcaaatatatgtcttcattcctttggaaggtactaagaagctaaatactgtgtcttaaattccactggctgtgctagagattttgaggtaaatcaaaagaggtctgtccagagctcatcatggtgctcagctacagtttaaatgtaaacatcttgtgtttcttgttaaagactgtattttatgtacattggtcaaacataagaagcctaataatgcaaattagagagataattggacttgacttcagaaaactcaagggtaggccctagcttctcattcttccaggagtgggagacatgagtcttccccttcctgtctctatacaccttcttaccttttcccatcctgcctacttcccaggatgattgtgaggagcaaagtgatagaacaaaagtaagagggcttcaaatgtgaggaattggtggtatttgttatcctgctagtctattttaagctttatactttccgaggcaaagtatcagtatactacaccattgcttatgaagtattttgttgtttgatagttacttaacgctgaatttctaaagatctgggcacaatttaaaagcacatttccaacacaatcatcaagtttaaaaagtaaccaattaagagaagtattttcctttttgatctgcagaatgtaatgctagacttgcaattccttctattggttttgaacaaaattagagcctggatagaaattcaaaaaatcagaaaagtagcaaaggaaagagctgatttttagaatttttcaagagcaacctttcaagaaaggttcgtgcgtgtgtgtgtgtgtgtgtgtgtgtgtgtgtgtgaatatttcagaaaaatgcagagaaattttgtgatgtgttaacttctaaatcattttcttattagtttgtctaccgaactcattttatttaacaaatggactcagacactaagaattttttaaatgctgtatatttctggaagacaagctatttgtattattcttaaaaatcccatcaacgttatcccattctttagtgctactactttagtttcaccctctaaagccgtgagaaactagccagagatcagaattgtatccagaatttgcagtcttgagaaacgctgatttctgactcttgaataagctgctaatggtaaaaggcagtagagcgagttctcatttccaaggcattttcgcaacaagcctgtgatatttattaatacaattaatgtctcctcgagttttcatgcagatcaacacacctactgacagtaatgggtagatttggaggatgctgctttattttaactatgactgataggagagagagatcaatatcagccaaaaaagtaatcattggtaaaagaagacaggtttttgctttttattctcctcttgaacacacatgtcaggttggcaagataagaagtcaatgcagttaatttttttacaaaaatagttacttccatcaaaatgtgtttgtattttaaactaaataacaataactacgtggatttttcccttcttcaactagctgttttgtgacacatgaaaaaaatctatatttgaacaaaatctgcatttattaatcattattaccttgttagccaagaagaaaaaaataattagaaatgcaagttatttggaaggaaaggtcaaaatgtttactttaccttgaattgtatacagtcaggcctctctatttttaaatgttgctagaagtagtataaagtgtgttatttcaaaataaatttcattgtccatagtaatacaaatgtacttagtccattctcagccaaggatctggcttttcaaaaaaatcataaacataacccctaaaattgcagaaatgaaaagaactgtagctatgagccaagataactttaaatgtaaaaaagtaaagcttttagtttcaagagccataaaagtactataaacaccgattacaccaggggttctaatattccataaaatatttataacattcacagaaatatagttatatcagaccaatattttactgaaagtgaatgtattagttgctgtaattattaaatgcttaaatgtttttcgtggcgttcttcgaatttagaagggcccatttgtagaagtaaagaagggtcattagagggcctaaattccttaaattttccaaataaggctagattagtgcatgctcctctcctctcccaatcaaattctctatagaaccagtggtctctcagatttcaccctcagccttagaatgtctccaaaggctgtccttaggaggagtgtctcctaagcccctgtccctgtggtcaggggattcctgcatatttgttatcgacgttgcttctttctccaaaattgaagtttcaatgaagagttttctcaagatttctatactttaccctgtcttatcttcttcattaaaacaaaacaaaacaaaactggccaggcgcggtggctcacgcctgtaataccaacactttgggaggctggagcagacggatcacaaggtcaggagttcgagaccaacctggccaatatggtgaaaccctgtctctactaaaaatacaaaaattagctgggcatggtggcaggtgcctgtagtcccatctactcgggaggctgaggcaggagaatcgcttgaacccaggaggcggaggttgcagtgagccgataccatgctactgcactccagcctgggcgacagagtgagactcctctcaagaaaaaaagaaaaacaaaaacaaagcaaaactatagaaatttttttggtttcagagaaatgcaaaaaacaaacaacaacaacaaaaaggtgctgttaggtcaatggatttcataccttattaatggctgtcagagcactttacaatggtaggaaggcatttaaaaacaattactagttctcttacagactttcagagaagaaacctgaaggatctccagggaattgtaaagacaggtataagctgtggggcctgagaacctcaggctgccttgagtttccatttctatgggactagtttttctacttactcctcatttttaaaagtgtattttggccccctgaaggcagcatcctcaaatgacagcgaaacctctaagaaaaatataaattcttctttcacaatgcttattgcgatgacctctgcttttaccttgatggaaaataaatattccttatcctgggacagaatgaggaaattataaaggtggccaaatctatactcagagattctaacattctctttatacaaagttctagttccttcatagtttacctacagggccccctactaatcttgcactcatggcctttattcaccctaaagagtaaataatactttgaaatatttataaataaattaaataattaatgtactttagcattcaatgtgctttgacagtgaaaatttaatattctaaattaattgtgaggtacaggaagcaaatagaatataaaatctcttgctccatctgtaggaaggtcatccctgcatatatctgtcaaatgcctaagccctataggaaatatgttgccattcaacattctataaaatttagctcaagaaagtggctgggcacagtggctcacgccagtaatcctagcactctgggaggctgaggcagagggactacctgaggtcaggagttcgagaccaccttggccaacatggtgaaaccccatctctactaaaaatataaaaaattagctcagcatggtggcaggcgcctgaaatcccagctacttgggaggctaaggcaggagaattgcttgaacctgggaggcagaggttacagtgaaccaagattgcgccattgcactccagcctgggcaacaagagcgaaactgtctcaaaaaaaataaaaaaataaaaaaaaaaagaaagtaaatcatcataatgcctttctcaggccaaagttatcattttggggccaaagagcttgtaccacagagtataaaaatacatctattacatttgtgtccttaaataccagatagcagcatcttgacaaaaaaaaaaaaaaagttaaatatagcttagcagcatttaatagatacaatcttataatatttagggtggtgcaaaaataattgtggtttttgcaattttaattgcaaaagatacagctgactgtatcttctgattctaagactactgacaattttaattgcaaaaaccacaattacttttgcaccaacctaacaaatacacaaaagaataaaacgcagttgtatcagcatatgttaaataagcatctctaatatcaggttcccaaaagcctatcggtagctttatttctattttatttcatcaatagtaatattagtatttatattttaacataaatgattgatgacattattcttgcaccttatcctcaacatgttagaaaccaaatcaataatagtattcaaatctttcccccacccagatcatctggtttccattagtggcatcaacagactcctcctttccattcgcactggaagccaaggagtcatcctcaactcaccccaagtcatctctcatactgcagacaaactaatctttcaaaagtggaaatcctttcttgtcaattccttgctaggaaaaaagagggagaaaaagatgatccctctctattacatgctaaattaagcactacttcaatttcctgtgttttaaaactattcaatgtatgcattagacatcataaatacctttaatttgtacatattgcattcatgttgttgctattctaaattatggatttttttttcttttttttggggggatggagtcttgctctgtcacccaggctggagtgcagtggtgcaatctcggctcactgcaacctctacctcttgggttcaagtgattcccctgcctcagcctcctgagtagctgggactgcaggcacatgccaccacacctaggtaatttttgtatttatagtagagacggtgtttcaccatgttggccaggatggtctcaatctcctgacttcgtgatccatctgcctcagcttcccaaagtgctgggattacatgtgtgagccaccgtgcctgacctaaattatgtttcttattagctaaacttaatgactactaagtgtcaggcactgtctttatgcttcatataaataatcttagataacttcaggatagatactattacatctattatattttatccctaaaacaagtaaatcaagatcacaaaattaggtaacagataaggagaattcatttcagcaaaggctgtgctgtgtctgaagtaacagcaataacccctagacagcagcgattcagctgactgtatcttctgactctaagactagtggcattaataattcccttccatctgtcctttaagctgagtataaatcacaatttcaaatggaaatagtgttattattatccagaggaattaggggagttactggcagaggtcacagaaattcttattccttgttttctctgagttatgacatagtgaaatgttcctgtttgtaactattttcctacttctttgatggccatatctagattttcctcaacaattctgattctagactttctgtctataactctcataatcaaaggcatggtttaggggaactgctctagaagatattctcaaacagttgtaaagctacatgttgacatgatgttgtaaagattagcatagaaagatgttaatggaaacagagtgaaaggaaaccgtggagtccttacgtattttatcctaagttatggacttaatgatgcaaggctggtgttgctcatgaaggtatacagccaataaattaggagaaaatagaacctaaaatgttctttcaaatggccaggaaattgaaatgaacaagaacaaggaagtatcctctcctctttctttcataagcacatcccctttaatgcaaaggaaagaaccaaagtttaataaaccttgtgatattagaggtttgaccagaacagcaacctttgttttagaagatgaaaatttaattacttctcatgaagtaaaaccccaatataaatggaattctttaacatatgtgctcaattaatctattttagatgagatcaaataataaaaaaattgatatttcaattttctctgagaagaaaacattaaaataagtttatgcacactgaatgtaagaatgttgaagaaattcctcattatatgttgtggaagatttaataaaacttggttaatggatagaaaggtgtttcacatcatatacttttaattttgaaaaacagttccgtcacaaaattttgatagtaaaggtctgttgatatacttggcataaataaattaacttggattgttaattaaatgtcagataacacataagatggctagttattttatggtgactttggaaaattccaaaagcaaatgtttgtttcttaaaagtcaagggattgtaatgccaaagcaaagtctccaggtactgaaaacattcctcatttttctccctgcaaaatgtccccaaatggagaccatccaagaaaaattatataaacttggaccatagcttttggttttataaataagaaaaaagtattgctaattaagaaatgaaagatgtggcttttctaggctttatatcttaggttgctcattattttagcttctccaacccaagtctatattaatgtgcttttctttctccagggagataaagaagctgaattagggcttccattttccccactttgtgatcggaagtcaaccatggtggcccagtcacaaataggtaattctgatgatttgtggtggtggaaagtgagtgtgtgcttgtcagttttcaaatgggtaaacgatgttgttcaaaggggtaacttgcatgaaaacctcactccatattcatgatatatttgatttttaaatggatctatgtggtgctgaataagacttattgaagcattttcacaaaatgaattcaataaagcaacattagtaaatgtaattgttatcgtggttgtaatccttttacaaaatataaaattttcttgtgtgggagaccattttatgttgttttgttgctgattattgttttctgtaatttaattctttagatatataggtcaactcaatgaaaatgttagtgcacttgttctatcactaagtttccatggtatgcttaatatagtagtgcacatttcatttggaaaaatattctgtcatgatgtgaatagattaaccaacaacaggaaatttgcaaaatgataatgctcccaaccacattcattcttatcatctgtatttgtgttggggacttcaagtccagtccattattaaaacatgtgttgcatggctcaaatacttgtaataattattccctaagccagcatttttgttactgaacaatatgatcaataaacacaaggatcacttcttagctgtgtagttatgctccagcaccacccatcacaaagcgttggggaaagctgcctgctctgaccttttccccttcccatccaagtttcaacagctgtttttctagagaccataacacaggtgcctatccttgcttagtaagtgtaaacgtggcaggctaaggacctgatgtggcaagctaagaatggaagtttctgaggcttgttgctgtaatgcaaattgctgccatgttagtagaggtgatgccccagttgacagtctacacatctcaggcatttaagaacatagaactggctgggtgcagtggcttatgcctgtaatcccagcactttgggaggccgaggcaggtagatctcgggtcaggagatcaagaccatcttggctaacacggtgaaacccgtctctactaaaaaatacaaaaaattagccgggcgtggtggcatgcacctgtaatcccagctactcgggaggccgaggcatgagaatcacttgaacccaggaggcagaggttgcagtgagccgagattgcaccactgcactccagcctgggcaacagagtgagactccatctcaaaaaaaaaaaaaaaaaaaaaaaaagaacaaaaaaagaacatagaacttaaaatagtaccctaggtggtcaattaacactgatttaacttgaaggcatccattaaaactactgaagttttattaaattaaaaatgtgccttattatatactataagtaatccagttacttgaaatgtgaattacttttatccaagcatctgatggacaatctttaaatgtgcatatttacaggacattatcacttaaaaagcctacctccagctattctcctatattcaggtggtagtccattgctctcagaagtgtttccaacaacaattcttgacttgaggcacccacagcagtcctgggatctgggatattgccatgtacacagaccttagaataggttgttgtctcctcctctgcctaaacatgggatggaaaatgctcccagaggacaatgcccttttctctgtgtgtcattttctatcttgatgagtactttaaatgtaaaagtcttcattcagtactgacatctcaaagtggtgggattaatgctgtctcccagagatgttacttttctcttcactgatttgacagaacacacacacatgctgtgaactaacactttacatccagagaataataaacaacaatttgaaatattaacacactggcagaaagctctgactgatatagtaagaaacaaaaagtaattgtcttcctgttacctgagaaaaaccttcaattatttaatttctttggagcttagatatgatttcttgttagtaaagaataaaatccaaaatgcacatgatgtgctttcaaaaaagataatgatccctggtgttgagagaggaaactatagtcactctcattggatctaaatgtattgttagcaatcgtatattatataaggctgaatagtaaatagaaaagccaatatacttgagttagcaagcttaaattgtgtcacttccatggcttcaagtattattttatagagcagttaaaccatctctaaagactgttattagattaaaacaatacaaagggtaagcagaaccaatattttagttgattcttgctatcccaggattgtcagaagctcttcattatttctgatttcagaattcaggaaattgtaacacttgaatttatctctctctcttctcattttggcttttgtaggtttcatcgatttcatagtagagccaacattttctcttctgacagactcaacagagaaaattgttattcctcttatagaggaagcctcaaaagccgaaacttcttcctatgtggcaagcaggtatgatattttcttttttgcattatttttcatctttgtggtgtttagtaacactttccttaatgattatatttctcacatctaggcagagaattctcacaagaattattagggagtattgccacctagtggctttatattatattgcatctgcctttgacaactgaagtttaatacacaaaatatgaaatactaagtaaggtgtgtactaaggagaatccagtgtggggagggagagaaaggagatgagcagctgccacgtgctcagaactgggactgagcatctactatcctgcttttctagtcggttttgtaaagtttttcaggttttccttgttcaccccatatcctgatggtgttttttggtttctttggttgttactgttagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtagtgttgtttatgaggccttactgccatctctctctgtcttcacttctcctctaagagtttggattacttcttctagatttcttcttctatagaatatgtaagcccttgatggtattgggaatttggctactctttgatcattcatgagaaagttggctcatttattagataaaaagaggttctggtttgtttgtgccacatgggctgcagatctgtgtgtcagtgggtgctggcaaactggatactgaaagatgagataatgaaatggtgacaaaactttgtggtaccatataaactcctgtgctttcgtagaggtgctttccagcctggattttacttggtaagtggcttttgtgttgcattaagtgtgttatcacttcatgtcagagacttgggtgtgttttttttctgtttcactaagttgcttttttgactcagaatttagacaggaattggggaaatcattagtaatcaaccaccacagcaatcgcatgggaaggtagctacagttatttctgacatattagctgcttcaaattaattagtccatttagtaggtttgtgagttagtattcaaacagttattatctttcgtgcaggaattagctttcatatccagatctggcccctgcctcttctcacactcattcccacagctctgtctcccttatacactacactccctgcacaatggcctcttggaagtttcttaaaatactccagggtctttgtagttattttttcagccagaaattttttccttgtgttttttgcagctttaatatactcaggaataaacttacttttcttaaaatggataatataagatcaaaatagagtgttaaatcatatttatagtcagaaagacacaatattgaaacgttttcaattatcccaaatgtcaaccataaatataacatgtttccagtgaaaattccaatacatttttcatggaatttaagaaattgatcctaaaatctatatggtattgcaaatacctaagaatactcaagacactcctgaaggataataaagtgggagcacttgccatatatcaaaatttactcttatactgaagtaataaatttagtgtggctgtgatatagagataataagatgggccttgggaatagaccagagagccaaaaatagcacattaattcctgcagaacttgacagatggcagacacacacattcgtatatgcaatcttttgtatgttctcacatatttacccttatgatattcttcatttcttcttgtgtgtcagagctactatttggtatcatttctcttcacactggagtactttctcaagtattttcttataacacagttatactgacaaacaattagattttctttatctgggaatgtctgtatcttacttttatttatgaataattttacttgatttagaattgttgaatgatttttttttattttagcacttttaatgtgtaattctattgcctctggcttccatagtttctgatagtgttggccaaaaataaattgtattgttgcttccttgtatgtactgagtattatctttttctttctgttttctagactttattttgactttcagcaatttgatgatgatatatctaggtctttttttttttcagtattctacttagtgttcactagcttcttaaatccacaaattaataatttgcttcaaatttagaaagctttctgtcattttgttcaatatttttcttctgcctctttctctctgttctctccttctgaggattgtgttatgcataacttaggattctggaaattgtcctggatgctctggatctctgtcaatttctttaattgttctttctttctttctttctttctttctttctttctttctttctttcttctcttcctttccttccttcttttgttccttccttccttcttcattcatttttgattggctgctttctaatgatttatcttcaagtttactgtttctttctctgccacctcaatcctgctgttgatttcactgaattaactttttatctcagctacttttttcaattttattatttccatttggttcttttttataatgtctatttctctgttgatattttatattttcattcattgttagcatattttcctttaattcttcaagattattttctttaattttaaaaacatatttaaaaacttgtcttgaattttttgaaatcaattttaaaactgactataaatggcctttctatggctctctaatttctagggtttttctgttaaatcctgctggtttaccctttaccccaacttggaccccaaccctaggctgacaaagcttggggctctcctcatctagtctaagtggattcaccattttatattcaagtaaccagaattatttgctgccttcccattccaagttgattctaccacatccaacaggaaagttggcttttgcttccattcccaggtcagagttggagaggaagatggaggagtgggagtaacttcaggcaagaaggtcacaggttcctgctgtttttacctgaatgtccaacaattttttaagaataaatgtttctcaaattattatgtccctttggttgatttccagagtcattgaatagttgtttttattaatgctgtccagttttacacttgctttttcatgaagagaaaaaactcgacttctttacatcactatagcaggaagtattcctcttcaccataggttttaagagaattaaatgagtttattaatataatttgcttagaagtgtctagagtactaagcgctatatgagttagctgttattactatattatttatgtttctgccatgtgttctagaaataagggttatagggctactatatagaaactaggggtgtccctaatgctgaattctaaatccagcaaaactattcagaaataaagaaaaataaagacattaccagattaagaaaatctaattactatggaaattggggataatttctatatagtaaactggtaaggaaagccttcactgaggaagaaataatttaaataaatacacaatggaggttagaaagagaatgatggagaggtctgggagggtgggtgttaacaaatttttaaaacggattggctaccacattatctaggaggccaagcttgcctgacatgccagaaacaacaagaagggcagtgaagcaggaagaaattggacaagtgggaataatgtaggcaatgtgatgagtggggaatgtggtgcctgacctttggttttggcccgagaaagacaggaaaccaaatgtagagttttgagaaaaaatgttgattgatctgaactgaggtttcaaaaggattactctgctacagaatggaaaatgtgcttttgtttgggtagtaaaaatagaaacaaggagatcagaaggaaggctgttgttcataacccaggagacacatgggagcttagaccaagtagtaatggttgagagggtctataatttctggatatgtaaagattgtggcagtatgtgtgagtagaaggagggtaagcaaaaagagattggattctggatatacagatattttgaaagctgaactgataggatttgttaccagattagatgtaggaaacaaagtgaagagaagaatcaaaaatgatgccaggctttttggttttcttacacattatttgtatataggtaaaattatataatcatttcatggaacaatttggcattctgtaggaaatttaaagatgcatgtgccatacttctcgacaattttgcttctgtatttttaccccagagagacttttgtgcatatgcatcaaagacatgtctaaaatattcacagcagcattgttcatgactgcaaaataaagtgtaaaaaacagtaaaattgatttatatactgtagtatgtacatattatggaacagtataaaactgttaaaatttaactaatcaccacaggaatgaaggacacagtgttgcacaaaataagcaaactgctgggctttagtaggcggttttcccctgacagtgtgaaggagactgagaggtttggactaagcaaaattcaccacaacacagcaaagcggctgtgtccagactgcttctctagattcctcctcactgggcagggcatctctgcaggaaatccagcagctccagtcaggggcttacagacaggactctcaactccctgggacagagcacctgaagggagaggcagctgcagtcgcaggttcagcggatttaatctttcctgtctgctggctctgaagagagcagctgaccctaacaagggggactctcccagcagagtgcaccagttctgctaagggacagactgcctcctcaagcaggttcctgactttgcgcctcttgactgggagagacctcccaacagggatcaatagacacctcatacaggagagctgaagcttccagaggaaggagcagacagcaatctttgatgttctgcaaactccattggtgaaacctaggtgacagggtctggagtggacccccatcaaactgcagcagacctgcagaagatgggtctaactgttagaagaaaaagtaacaaacagaaagcaacaacaacaaaagcatcaacaaaaaagacctcctacaaaacctcatccaaaggtcatcagcttcaaagatcaaaggtagataaatccatgaagatgaggaagaaacagtgcaaaaacgctgaaaattccaaaagccagaatgcctcttctcctccaaatgattgtaacacttctccagcaaggacacaggactggacagagaatgagatagattaattgacagaagtaggcttcagaaggtgggtaataacaaactctgctgagctaaaggagcatgttctaacccaatgcaaagaagctaagaacattgataaaaggttacaggagctgctaactagaataaccagtttagagaggaacataaatgacctgatggagatgaaaaacacagcacaagaacttcatgaagcatacacaagtatcaatagctgaataaatcaagcagaagaaaggatatcagaatttgaagaccatcttgctgaaataaggcatgcagacaagattagagaaaaaataatgaaaaggaatgaacaaaacctccgagaaatgtgggactatgtgaagatactgaagctacgattgattggagtacctgaaagagactgggagaatggaatcaagttggaaaacacacttcaggatattatccaggagaacttccccaacctagcaagacaggccaacattcaaattcaggaaatacatagaacaccactaagatactccatgagaagatcaacgccaggacacgtaattttcagattctccaaggttgaaacaaaggaaaaaatgtttaagggcagccagagaaaaaggtcaggtcacctacaaagggaagctcatcagactaacagcagatctctcagcagaaaccctacaagctagaagagagtgagggcaatatacaatattcaatattcaacattcttaaagataagaatttttcaacctaaaatttcatattattagaaataagtagaattttacttcctagattgggcactagacacacaaaagttcattttatcattatgattatgattatgtctaacatgtgctttatatatgtatctataattcatttatatacatgaaatattgcataaaaatgaaacaatgataagctattaaaatgcatctactaacatagtgatcaattttaaagtcactgagtatcagatattgccattttaattttccagtacctaccacttctagtcttatacgctgaagatgaaagtttctttattacaattgcattgagattaaaataagcaggtcatatgatgtttagagctttggaatattaattaagcatcagggctttgaagagaattccagatgtttgctcatcatcatattaacccttaagctctatttcacagatatcgcaaaaacatctccctagtcctagagcagggagagactgttgacctattatgcttcatttttattatctacttcaccctcttaaaaataaggttcattaaaataaagatgtttgtttccattgctgatgtatcccaagctctttgaacagagactggcacaaagtagaaattcaaatgattatctgcagtaggcagggaagaaagagagagacagagcgcaagagggaggacgagagaggagggggtagagaaaggaggagaagggaagaaggaaggagagaggtagaaaacctaccatctaggccccaaaatatgaaatatatgatcttgccatgcccttggaattctctctatgccttctctaatcatttatttccttctctcccacccatgagctaattattgttttgaattttgtgataatcattctttttttaagctgttatccctctttgtataattttaaacaatgtataatttagttttgtctgttttaaaacaatataaatggaactgtgccatatacattcctttgtgaattgctttccactcaacaagatgctttttaaaatttatccatgacaacacaaatgttgttctgtttcagcaggagttttctggatcttgcagaaaacatgagacagaaaaaaaaatccaaatactgtgcagatactttttaaatattagtgttttgtttaagtctgtacatatcatatccttaggccacaaatcaggtgcataaataatatacccttcattatttctctgtgaccaaacatagtttctagctatgtcctcatgctacctgtttgaagaaaatataagcttatcatttaagtgttttgactgaatcagagtaagcctggtcaatccagggtttctgacctctctttcctccttctttagatggcattgcagtccctggggactaatgttgtggtattaatggatttcagatgagcatcaggttcttgcttgacctctggcctctctctcatctttccagacagacagcccccattggtttttggctggtatcaccttctgactctgaccccttgctttcccacggcaggcccccacatctttgcttgccacagcttgcttgctctcttttcttctccttctcattgtacttctcagggctgaaggacaggctggtcttcacatcagagtcactggggttgactgaatactgcaggcgctctctcaggctctcctgtcctgacattctacacagccacccctcctctattccttgcatgctgagaacacccaccttgttcagaatgctggataagggaacatgacaaagatcttctctaacccctggatccctgactttttctcagaattctttcttgtttttccctcggaaataactcaaaatgcacagggatggccaaattcagagagcaggtcccgtctcagactataactgtctaagtctcttgaatcttccaactcttttctcccttacaccttacttttggtttcatagggggtgaaaaatatgtcactggaagggtaaggagttaagcttttccctcctccaatttgaatggcaccttcatacccctttttgcttctcttagggaaaacctagatccatgtccagggagtgagaaacctggatctcctctggaagtatgggtgggaaggtagaacttgattaagtattttccaaaaaccttttagccatgcatggatgtggcttttgaatttgaagacaaaggatagatgcctttgtttttggggtagcttagtaacaacccctgtgtctccttgtctaaataggcatgagcctgttataacaaacaagtagaaacaaaaccagatcagctaatgattcactgtatcagctcatcgagacacacaaaataagcttttgtagttgtttcagaagagaaatgaaaaacaatatttgattactaaattaagtgtatttaaaatactattattcaaagaacatttatcaagtatgtttcctcactttacagaaaaagaaagattagaagcttatttttttctttgaatttaagtgatttaatgtgatggaactgaatcatgtgacacaaattaaatccataattttatatccattgaggtgtttcagtatggttagtaatgtcaaagacatatttcaggaggaaactgagcaacaaaaaagacatttttttattatggggaaatccaaatgaaagaacaaagctggaggcatcatgctacatgacttcaaactatactacaaggctacagtaaccaaaatagcatggtaccggtaccaaaacagatatatagaccaatggaacagaacagaggccccagaaataatgccacacatctacaaccatctgatctttgacaaccctcaccaaaacaagcaatagggaaaggattccctatttaataaatggtgttggagaatactacaaacacctctatgcaaataagctagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggagaaactggtgccattccttccgaaactattccaatcaatagaaaaagagggaatcctccataactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcgtatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaactcttcatgctaaaaactctcaataaattaggtattgatgggacgtatttcaaaataataagagctatctatgacaaacccacagccaatatcacactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatggtcacagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaagggaactacaaaccactgctcaaggaaataaaagaggatacaaacaaatggaagaacattccatgctcatgggtaggaaaaatcaatatcgtgaaaatggccatactgcccaaggtaatttacagattcaatgccatccccatcaagctaccaatgactttcttcacagaattggaaaaaactactttaaagttcctatggaaccaaaaaagagcccgcatcgccaagtcaatcctaagccaaaagaacaaagctggaggcatcacactacctgacttcaaactatactacaaggctacagtaaccaaaatagcatggtactggtaccaaaacagagatatagatcaatggaacagaacacagccctcagaaataacgccgcatatctacaactatctgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaataacagatactggagaggatgtggagaaataggaatgcttttacactgttggtgggagggtaaattagttcaaccattgtggaagacagtggtatgtacccaaaggattataaatcattctactataaagatacatacacacgtatgtttattgcagcactgttcacaatagcaaagacttggaaccaacccaaatgctcatcaatgatagactggataaagaaaatgtggcatgtatacaccatggaatactatgcagccattaaaaaggatgagttcatgtccttggcagggacatggatgaagctggaaaccatcattctcagcaaactaacacaggaacagaaaaccaaatacaacatgttcttacttataagtgggacttgaataatgagaacacatggacacagggaagggaacatcatacaccagggcctgtcagagggtggggagctaggggaggaatagcattaggagaaatatctaatgtagatgacgggttgatgggtgcagcaaacccccacgacacgtgtgtacctctgtaacaaacctacacattctgcacatgtatcccagaacttaaagtataataaaaataaaataaaataaaataaataaaaaacaaatgagataacctgttctgttttatgcaacgtgtaggacaatcttaaggtgttaattgaattatttacactatttcttcccagaaaatacttaaaggattatacaagccagcttaaaaacttgaggactgtaacagagtatgaatagtgaatttgcccttctttttgttcagtgtgtaatgcagagaactttacaaataaatgcaagaaacagttgttttaccctcccctgattgactctcagagtttctcttgctccttctgaaaagtatcacagtttgaatcaagccaagtcttcctttcggtttcagagcatgtgaaaaagttgttattggaacaataaataagtaatctatctgagtaccacctttatattcctcctttgcttctctgtgaaaaacctaggtctgcgtccatggacgtcatcaggaaataaggctgaatggcttcaggctccattcccaagctctgattctgtggacacttagagaggctttttcagtgaatattttcaaatcgcctttaggactgctagataacaagctgctcagggagaatgaatagcagtgttagccttggcaccccaccccaactagttacagagcagtgactctcaaagacctacattcccctgtggtatttatctgtagttttatctcacgggtctctgtaagctttctgagcacatgtttttatttgccagcaatgcctattagtactcaccagtgggcctcactcttccatatctgttgcttagagaaagtaaaaattgattttttgaaagtaacgaaaacatgtcaatgttactttgtattgaattactttaaaaagttgtatttataaggtatgtgttcttaaaatatttgctattcctttccactatctttttaattcaatcaaaacccttcatgtaaagcacagttcactttacattataacttctaagttcccaggactgaatcctaagcaattctgagagaatatacatgtacattttagatttcaaaagggacaaataatcagaggaaaacaaagtctttcagaaataaaaactagagcttgctatcattctctctctaattatggttcaaaatgtaattagaagtttaaatgagatcatgttagtaattttatatattttaaattattagtaaattaaattattatattatatatttcctttattgttcctatttccaatttaacctcttcagctttgtcttcagatcatgttctatatcatgttagcagtacaatagagcaggagtatgcatttgatagagtggaactttcagaaggtaagaatcatgaagttctaagaagtgatattcagagtcacttaaccctagaagagcttaaataattgtttgaatggtgtgtgcttgtgtgttatccattcattcactcattcctttattacaaaggtacaactcaaaagttttcaacctgggcagcctatcagcatcatctggactacttgatttttttaaagttcaacatgccctttctccagttcacagaggaaggtctaggtagaacacttttgtgcatttaaatcagtgcaacaggacatgtaggggaagagcaggaaataccagctcatggtcaggacaagccaagtacagatctaaatctgagccagcttcaccttggcaggctgaagtcaggaaatggcaatgggaaccttcgtagttatattcacctagggatgggatagttccattgtgtctatcccacatgatatctagatcttggttcatactgttgtaccctggaatgtttgctctctactcctgggaagatcagtggacaaggtcatgactggtcctggaacttaaggttactcttcacacaactcgaagtctagctacgcctatgttttcctatctctctacctttggttttgttcttccctcctcatagaatgctcttcctgggccttctcctccattctgcttattaaaatcctgtcttccaagattcaattaaaatgccatcttctccaagaagcctatcatttagttttataaacatagctgtctctttcatactgtagtgtagttagactgcttatcatattctaccttgcgttctcaaaataagaagtgagaaatgcatttgcaggaggcctacccaaattagagttctagtaagagtggaggtggagaggacatttaactacacatgccttatcgaggttctggcattctgctttgggtgtgtgcatcatttctctatgcaatgagaaccactgtgtattatgagatatgattggagtatgttacaaatgtaaaaactatggattttgataaaaggttgagaaccactaattaagtcattacaaaaatatttacagagaccccctgtgtaccagtgcaaacaaatgcctatcatctttttttcttgagagcagaactcatgggctgttcagcatcagatttctggtgtctcctactcagggctaggtaagagctctgtcagtgttgattagaagaaagtttgctccactttgtggaagtctgatattaatggtgagtccacataaatgaaatagtattacccactattttgtagtatgtttttgtttgttagctaaatgaccttaaaaatctgataaatcacaaaagggcaaactaaatgtaagggttgttccccaaaagtttctcctcatgttttatgtctgcatttgctatgctttctgatacctcaaacctagtcacttgctctaattgtactttgcaatatgagtaatgcatgcaagagttcatgggagttttgtggcttctgaaaactctgggacaggaagtgtggaaatttgggaagtagaggtaataatggggaagggagtattgggttggatgttgcactgtcgaacagagatgatggggcagagtaagctaagtctttggatacaaggtatggaacagctctcagagacagttctctcattctggtgccgctctcatctagtagcagtttgatgtgtgaccagaatttgactgggttcatgtgtaatgctcacaccaaggacagactcaagactttgttatatacccccaataattagccccgctccaagtgctgaaaatacttccaaattattggaagctctgttgtcttaaccttacaccttgaagaacagaaatcccttcttttgttaccactcatctcctctctctccaaaacctataggcttccgttcctcttgattccaggtctctatctatctctcttctcattctgcttctaaaatactcccaatttttcagaacaatttagttctgatcaaaagattaatcaattcaacaaagcaaaagcctgatggtttccctaaaatgacgtctatagttcttcaaacaaaaatcacgtaccatacataatatgcaatactgcatattgtctgggttgatcatggtttgtctgttattttcaatttcattagaattcctataaaaacttaatttcctcattaccctcaggacatttttcaaaatgttaatcactgtacctatgacctacatttgtaattagaaaatatcacgagttactgagttagatggttgcttatatttttaacattttacggtttatttaaattatgtttttgctagaaaagctcatacattttctcagtaggaaacaaaaaaatgggaataggttttatatcactggttaaaaaatttaaaaacaaaactagaagtgtttttcactagaagtaagagaaacatttaaaattggtgggaaagtattaacattattaaaagatcaaatttgccttatgattaacatagtattttaatatattatcatagttcactaattaaactttatatattgtttatatttgaaacatcttaagatgcaatattttgtattatgtatggtaaataatctttgtaattatgttggtattaatgccaaatcaaatgtagattcatattctactaactacatctttatgttccaggaaatacactgagttttattacaatcactatcctgtttagtcagacaaataaccctacaatttagatattatcatatctaaatccaaggtgagaacttaggtctaaggcagcgaagtaagtctccagcatcacaggtgtatacatgtattacaaatgaatctaactttctcatttcttttcacggtttcatatagcacacagaaaattatatggtatagctatgcggtaggagtacagacagaaagaggaaagaatttcctgtgaaaccttaccccaaagactagcataattgcttcatcaaatctacttctgtttaatcttagcacaatttatccaatgagcttacaaatgtgctcataagattagttatatctcacagatatttttatttttaaatgttgaaagttatgaatttgggagtgaaattttttatcatttattcacccattgaccatctatacaaaaaaaattacagctaactctacaaggaaagaattttagtctgacaaaagtgaagctcactcagagaaactaaattatttgtctaacgtcacaaaactaatttttgaaaaggcggggcttttcatctattttgcccaaattcaaaaccagtaacctgtatcatgttctagaagttaattatgatgggttggtttagttaaattctctaaacttccctccagagcaaaaagtgtgctcaaaatctactgatggaaggattctgacagcagcataacttaaggatattttaagtaatattgtgtgtgtgagtgtgtgtgtgtgtgtgtgtgtatgaaagagaaagagagagagggagagtgtgtgtgtgtgtgtgcgtgtgtgtgtgtgtgtgtgtgtgtgtgtgtctcctgtccactgtatttgcatggacaacaaaagtaagaaggaaggtagagggagcatgcctgcattcccatagagattattagctggcttggtgatgataaaatgttttcccaagaggggcaggactaggacaagaaaggatctgggttggtaggaagatgagttatcagatgatgtactctttactaaatttgaaagtaggggtggtctgtgaagctcatctgtcttggagtaactcttagatgtttactcatagttagatacagtcaggatattagaagttatttccagaagactccaccaatcctcttcatccaaggtatgcattttgtccctcccatttgtttaacaggaaccctagcagatggtccttattgagtattatagattttttttctttctgtgtgtcatatctcattgttgtgatcaataattttagccaatactgcctttactattattttagttgtatcactcagagcttatgacatttattgtgttgatatacaaaatccatgccacatttgtgtgcaaataaataaatatagctaattcttatggtataactttcagcatttatgtttcagtatgtttttttcaatgtacaatattctttccttaaaactgtatttccataactctactaaactggagatggaatcaatgtaaagtctggtaaatagtaaagagaagaaacctaatttcaatgagtttagaattgttctaaaacccatatgtagccaaaattgtccttctatagttcatcttaatgcttatgagtttaccaaatgcttatgagttaaagaaattatttatgatatttatattaaattataaaaaatagcattatattgcgcatgattataacttgtcagatatacacacacatacacttacacacacatgcacacaagacttaataatttccttgatgccatttcaggagattaaggaatgatagagcacaattccacctgaaaatcgtgttataacctatgtgacagcattagcccttccggtctgtaattcaatcagaaattttgttgttgttgttagcatatttcaacattttttaataagagaaagatattttctgtggataaaggaaaaggaaacatgattttattcttttttattttgaaaataaatcacagatagaatatcatttctttacataataaaattctacatccaaatatttgcattgcatactatttgttagcagacaatattaataggtttcaagataatctctcattagattctgagagtgtctgctctagttgataacaactagagttggactccataggaatccaggcaacaattcaagtagagtaaaaaataagttgagttataaagaaaaatgaatcatcttaagatcaccactgatgaatacaagaatcacaaaagtttcaatagcaaaagcaaagtatattaaaaattaaggaaaatatgccaattatgtttctcttcataattttacgacagtaattttttacaatcatggctgattataaatgagaattactttttttcataacttctttacagcattttctctaaattattaaaataagtacgcttttttttttttcagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaattgctaattttgtcatttctacaataaagcttggtccacctgttttcaccttagattgtcccttttctaaacgtcaaaaatgtagtgcaaattaaaaaaaaaaattatcttttacattaattctaccatttgtcctaagggatagatatctttgaaaacatgtttatattatagtgagagtgaatggcagggatgaaatgtatcatccaaaaacccaccaggttgtccaaatagtagaaaggtgagttttactggcaatatcagtttgcaaattgggaagagacagtctccagtgtgtaccaaagatgctctctcttcgaagagggaaagggtagttgggtttttatgcctcacagagtctattacacaatagaggcatacatatttagcaggtttggggaaaaagctatacatatttatgagcagagtcaagcacatgcctaatgggtaaacatatatgtaatgtacatcccatgttcattttgcggtggggatttagcattaaaatgaggaggaatttggctctttcttttaaagaaacataggatacaaagtttgtggacagtctctgtaagctggccaaaactggcttgagatctttagttacttctcagtaaagaatgtttgtaagattggccctcagtcttcttaaagttgtagtggtgtgggctataaatcagttaggaagggtctgcaatttttctgatatctcctattgttagggagtttaccaagaatgtggtttttcttatagccgtaggaatttaggaagtttccatgacagtcaagctctcaacactcaacctggaagtaacttttgtttcattaaccttagggttcatcttagttaataagtgggtatttattttggtctctcagaacatgaacggtttactgtactgtttttgttggatttgaaattgacttgttttctacataattcagtttaaggttagctaagttatttctttttggaaaaagtctggtttttaagagctgctttcctacatcatcttttactgttatcagtttacttaatagttaactctgctagactagtagaagcactccaataattaattagctaagaatggctgatgtccagtattgaataatgtattttcacaaataagtatatttatttcatctatctcaccttgccttcacacaggaggtggaaaacttggctataaaatatcatcagattagtcaaggttctccagagggacagaaacaataagaaatacatgtgaagtgaaatttattagggagaattgcctcatgcagtcataaaggcaaagtcccatgatgggccatctgcaagctggagagccagaaaagctggtggcttggctcagtccaaatgcaaaagccgagaaaccaggaaagttaacagtggagccccagcctgaggccaaaggccttagaccacccccttcccgggaggctgttggtacaagtctcagggtccaaaggttgagaacctggagctgaatgtccaagggaaggaggataaacagccccttctgtgatggaagtttcctactcagaaagggaaagagagaaagccagagcaagctgagtgtctccctttttctacctgctttgtcccagctgctcccccagctgattggatggtgcccgcccatattcagggtaggtctttttctctctcagcccactgactcatgggttaatcttctctggaaacagtcacctaggcacaccccaaaacaatgcttcaccagccatctaggcatccctcaatccagtcaagttggtacctaaaattacccatcacaagtctaccccttgccagcttggcacccattatgcacctctttaaaccacacctaatctccagatgaagactataaaaaggtcataattctgtccaacatggtgaaactatcctgtttacaagccaacatgtactaatcccatcctcagaagaaaggataaagttcatgagtgtggtttactcttctgatctcctgcaac

SEQ ID NO: 13277 - DNA, 7970 bp, Human
cctgtgccatctagctagctgcgctgcctccaggctgggtggcctgctcctctgttggataaaaatagcctgactcctcactgaaacaaccaccatgttatttgcgtccttgggaagctgaaagtaatagaactctaagtctggcgttgccagctgtcagcagaatgaaatgcaaagtgtgacgtgtctacactgtacccactggccttcaagtcccaactcccgttcccccatcttgatttttttccattctcaaattaattatttcccctataggtgatttgtggaatggaaacagatttagatttcctacctatttagatttttccaaagactaaaattacaaatcagaaaaactgctattgacacatttttggttaggaaaatctggatgtggttcctatgcctagcctagtcatataaattctctccccatgtatctttttgtgtgtgtgaaacagggtcttgtcacccaagctggagtgcagtggtacaatcacagctcaccatggccttgacttcctgggctcaagcaatcctctcacttcagtctccctaatagttgggactacaggctcatatcaccacgtgcaactaatttgttttgattttgggtagaaacaggtgtcactatggtgcccaggctagtaactcctgtgctccagcaatcctcctgccttggcctcccaaactcctgggattacaggcctgagtcaccaagctcagcctctcctcatcaaaaccattccctctttgtaagattcttcctatgtcttaaaacttaatacctttaatccttccctggagccatagttttatttatttatttatttatttatgagacagggtctcactttgttgcccgggctggagtgcagtgacacgatcatagctcactgctgccatgacctcctggactgaagtgatcctcctacctcagcctcctgagtagctgggaccacaggtgtgcgccaccacaccagttgttgttgttgttgtttgtttttgttttggtagaaacagggtctctccatgttgcccaggctggtcgcgaactcctgggctcaagcaatccacctgcctcagcctcccaaagtgctgggcttgtaggcgtgagccaccgcacctgtccctgtctgcttttattttatttttttttgagatggagtcttgctctgttgcccaggctggagtgcagtggtgcgatctcagctgactgcaacctctgcctcccaggttcaagccgattctcctgcctcagcctcctgagtagctgggattacaggcacgtaccaccacacccggctgatttttgtatttttagtagagacgtggtttcaccatgttggccaggctgatctcgaactccagacctcaggtgatccacccacgttggcctcccaaagtgctgggattacaggcatataggtaagccacagagataagagtagcaagcagtgatggggagaagataatctagtgtaggaaagatggaaagaatggtgatatttcacaactgctagattgacactttaacttgagagttatccctctataaactggatatttgctgagcaaagtttaaagaaaactccatgtattcagtaatgttttccagaccccacttctcttatataagccagtggcttagagtgcttgctctaatttctatattccattaaacaagggtgggatttcttctcattcaaaccatttgtgactttgccctttagtgacctctaccatcaccctatcattaatgatccaagtgattagaatggatggctatgtgtttgtaggttgtttgttgtctttaatgaatagattcattgaatggaattaactgtgctcttctagaacattggatctgtgttctcatttagattgtatttgtaatctccccacttcccaccatcaacagtggcataatgtgaattaatttatgtggtatctgtcatttaaaaaacatgagctctctccttcctttttttgtcttaaacataggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggtacagagtactcagttcttgggaaagttatggcaggtttaaggaaacactgagcaaggaattaaaatatctggatttgagttccagctttgcctttcttttacttaaccttgtcaaatctactttccaacctcagcctcctgatgagttcagtacctaacctgagttcagtacccaacctattgatcttaacagtgttattgtgaggattgggaagacttaagttacaccaaagagttttgtaaagtatagaaacatcctgtaaggatcaagtagcagcaacagaagtagtagcaggagaaccaagtagcagggattactggcgttactgtgtgtggcaagcactgttttaagaacatatactgactgatttaattaacacaactatattaattagttaccattatccctgttttatctacgatgagcaactgaagctcacaaaggttaaataatttgcccagatcactcagaaaattggaggagctaagatctgaacccatgtggtctagttcaaattgtgcatcaaagtgatctctgaaataagataaatatttacttaacttgattataaatattttatgaacatcaattattgaatatttagcttggcaatggaatatttaaccatttttgttttcctttgtgtcattcccttttatcaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtaagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacaggtaactaaaatagaatgtaatactggagattttttttatattcagtgcctttagtcattctgattatttatataccacctatttataggaaggattggagggtgctattaacttagtcatgagtactgcccatgctagttaaattggttggacatcttgaggatagaatgttataaacctgacgtctgatctgggaactctgaaaataatacataacgcttaggcgtaaatatgtattggaaatgagaattatctctgaattatagataataaattatagagataagcctgaagataatgtgggtagggagtttatctaaatttatcacgtattatcatggattaactttgatttatatagtataaacttccttctcatgcagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaattatttgtttgggattcctttgagtttattcacacagtattttccataagataatcatccatttaatttagatgttttgcattttcagaatgttttatttgaaaatataaaaataattttatactacatttctagtaccagggttacagagaaataaagtatatcaagaggatactttgcctcttcaatagcaggtacatctaaacccaagaaaatgttacacactgacatgaaagcactgattcatttatttccatcagtagacatacgcccactataccctaggcagagtttgaagtagaaaggacaaaaccaatatccctgcctggcctggaacttgcattctagcgaaggggaggtaacaagcatactccactatgttagaaggaactggacggggaaaaccagtaaaaagcgtcacaacttaaggctgtaaatgggaagagccttactgaagtggcaacatttgaaggtgtgggagaagctgttctcatagccaagaacactgcagacaagacacagcaggtccaaaggctgaaccacatttgagaaaaaacaaggacaatgtggctgaagaaagggatgggggtggaatatgacagagcctcgtaagtctacgtaagtgaggtggggcgctaatggtgctgttcaggagtaacactcaactgtttttttaaagttccctctggggtttgtgactgctggcagtggctgcctagctttctggtaaaggagtgtagttagtggcaggtggctgtaccaatccagatggaggtgaaagaagctgagctgcagccacggtcagtacagtggtggcagctggactggccatttctgctgcaggttttgcaagtcaggaagcacatatagcctgaagtaaaacaggattttcaaagtctaccaaaatctgccttcagcggtggctattagagaggtgggcttgaactaaaaaggacaaaatgggaagcagcaatactacctctaagccttactgccattaaaggaaaaataagagatgctcagtaacaaatatgatcttaaatcgcccaaagaaggatctccttatatagcaacccaaatcaatgaagctaaggatttactacgtcaagctcaaaaatgaaatcaatgtatgatgaattttaggttcctactactttttatgtgtatgagtatcaactttctataaaatgcctcagagctacaacttttaacatttcctctggcttgtgtgttgagaacagtatagagggtaaggatgggagtagaaaaccaattgagaggttcatgcattatgatggcagcttggtctagagtgatagaagaggggtagtcagggacattggattctgccatgtctcagagaactaaaaggattttctggtagaatggatgtgagtcaagaagtttaacatctttaagaattgagttgtctgaggatggagaagactggatagagggagacccacgtgggaaaatcagttcctttttggacataccgagagatctattagacgttaactagagtgtacaaaaacaagtcccctcaaaaccctttgaaaatctgcatgctttccaacgagccattcagttatcgattatttcttcacctaagcaggtttcacttgttcatattgttttgcctttttaaagtgaggaaatggagattcattaagtatgtttaaaataagcactgcatgtgtaactattcagtgaagactcctagcaacactgcatgggcttgctgctaattcctagaatggcgtttagcaactcactttagcactttttttttttttttttttgagacagagtctcgctctgtcacccaggctggagtgcattggcgctgtctcggctcactgcaagctccacctcccgggttcacgccattctcctgcctcctcttaagcatattttctcatctataaagcagagtggtactcagtgggtcaccccacaaaaagcactgcgcctagctcatagtaaacattgcataaatgat

SEQ ID NO: 13278 - DNA, 16139 bp, Human
ttgtgataaaatatccctaacataacatttaccatcttaaccatttttaggggcacaattcagtggcattaagtccaattatgttgctgtgcagccatcatcactatccatttccagaactttttcatctgcccaaactctgtacccatgaaacactaactctctgtttcctcctccccctcagcccctggaaaccagcatcctatttcccatttctgttgttgttgttgttgtttgtttgtttgtttgagacagagtttcactcttgttgcccaggctggagtgcagtggcatgatcttggctcactgcactctgcctccacctcttgggttcaagcgattcccctgcctcagccttccaagtagctgggattacaggcatgcgccaccatgcccagctaattttgtatttttagtagagatggggtttcaccatgttggtcaggctggtctcgaactcctgacctcaggtgatctgcccgcctcagcctcccaaactgctgggattacaggtgtaaaccactgcgcccagctgacccaccctatttaagtataaccccaccctgtctcagcacagccgtccccttccgtgctgacaaactgtggatgttacttcttattcattgtctgtcttcaccatctagaatgtagggcttctgtctgttctgtttaatgctgtaccctcaactgtgtactgttctaggatgttctaagcacatagtaggtgcttagcaaagcaaatatgtaaattcatgaatgtggccatttcagtctcctttgagctcccaccaggttctcatttagggacaggcgtgagcacaggtgtgggaaaggaagtattagtagaaaacagcagccgcagatggagaggggtgggcaggaaggaggggctctggacgatgccagccaatgacaaaccgtcacccagatcccaggttccctgtgacagtggggtcaggtggcaaagagcttccaacatggcccccagagctggagcccaaagatctggagcatcaggggccccagaaataagggaagccaaccaggaaactgaccttttacacaaaatatccaggttttgagaatgctcaggaagaggtgagagctgttctcaaattcagatgggctgccagtggcaagaaggtgatgctaaggggttgcactagggctaatgggtaggtgttgcaaggactcctattttggcggatgtaataagaactggcccccactcctccctctacctaacaagaggtgtccaacagtggcttaagcttcctggtgaaagtgagcccctggttcccgtgtgtatgcagagcccaggattcactcacccatggcttgaacctttaatggatacattcatcagttacctgtcaagtgcgtttcctctgtgccagattgtgtggcgctcagcactgtgaaagtaatgatgactaaacattattcaaataaatacacattcaacaacaaagtgtgaaggcacaaaactagcttgccagagagagagaagcctcactcagacaggggatcaaaggcccctctagagcctcctagatattggagagagccatgagtgatgggcatgcctccagcctgtgagaccgggggagcataccccaggcagagggcacttaggaaaaatagcacggggtgctagcgctgccagggacctcagtacacatggaagaaggcaaggtccagagatccgagtgacttgcccagggacacaaggcaaatcggtggaatcgtcgaggggtggaggatcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacgaacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgtccgccgctgtcctggctcttctgctctgcgccgggcaaggtgagcgagcgcggggagctcgcgggagagggttccgggcgcccctgcccaccttgaggtccgggcaccgcgcggcgccccgcacccctccacactctcattcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttctgcccttgacttctacttctcccatatcatccctcacaatccccttcctccatctcttcccccgccccccccacctctggggtctctctccccttcgtctgtctcccacccgtcccactgtgcagctcttggccttgtttgatggcgctccccgctccaaagcacacccgctccagagcaagagtttccaaagggggagggggaggacctctcagtgcagcctctggggaccaccccactgtgggcagcaaccagggaagggaaacaaaatcagccctagcctctctttttggtgggggcagttttgaggggtggcattgggtgaacgggccccagtgagcccggtcagaaaggactggcctccacttggagcagaggagtgaccccagcactctcttcttcttcccagtcactgcgctccctgtgaacagccctatgaataaaggggataccgaggtaagaaggggtgctggggatgaggggtaggaggctccagtggacacttcacagccagttcttgggcagctgcaggagtaagttcggcataaagccaagagccagcactgcggctgctgagcctggggacagcttgcaaaagaagatatcaaagattgcttgctttccctgctgtcctgctgtggggacttccccagcttcctctgagctgcacgtgcagcggaagaggcctgcatcttacctgctgggccgaggtgcctggcttcaggctgtcttgaacactctgaatccagtaggctccccaggggctggtgggggtggcttctctgtagttgtagttgtccacagacctgtaaaaatggcctttgcctgcctggctctggcctccccgctttgctctttctccctgaaaggctctgccagtaacaacccacacccagcaggctctccagccctggctgtcccaaaggaacacaagcaaaacatcttgatcatggctcctgcacccacggtcccaccaataggggctagttgtggaggtcacccaggaaagggccttaggagacactagtaggggtttctctggcagcaagagacacaccacgctgggtgtgtacttggaattcattcatggctgagctggggctgttttttccaggctctagtgctcatccaaatctctgacttgagggtcagagaaatttctactccccaccttcccagaaactattctcttccactagacaccacagttaaaatccaaaccatccaagagattccaacctctgtttgctcaattatatttcctatgttttagttgcagataggacagaatttaaacctctaccactcattctagctgtgtgaccttgggaaaattccttaatttctctgagctccgcctttttctccttttccttgaggggaggtgtaaagagtaggaatcatggatgtgaattgcctagcacataataggtcctcagtaaatgggcacttttattcctagagctgccttcttgatctccccatccctctccagaccctctacccaattcctgcctcccagaaaatgccctctcgaacaggtggttatctgatattcccaatgcaaggtccggggttgcagggagatacagggtacaggctgctgtgctctccttgctagatcccttatgggagacaccctggtcaccatattatacccagcagcctgtggtcaggggcaccagagcagctggctaagacctgaagattctatacgaggttgttgtgactacatgcattatacagcacttgccagtttgccatcttggatccttggaccggttgccttggcatcccgtagacacagcctcccaccccctcactccctgccggtgttgcctgatgcctgtctgacacctcctgctctctactcagctctaggctgtggaagcagggctggagttgtgaacccctccctgggcgtgctgacactccatgcttgaaagagtgtttttccatctgtacctcattaccctgggagagcagttgggaaggtattctcactcccgttttacaaatgaggacactgaggctcagagaggttaagtcacttctccaagatcacacagctaggataccacattacggtgggcaccatcatcaaagatcactcatttatcagatgcctaattatccacagcacctttgcaggcacaggataagactttcagaggcgtggctgtggttgacctgggatatgctcccaggtgtagtcaatgtgtgctcacatgccgcccagggattcacccatcccatgatgaacatggagtgagaatatgaagctgtgactccttgcatgcgacaacaccatgggtgtttggagacagtaacctacatcctatttccaaacagggtagagccagggaaggtctttgtctcctctgggcagtccagaaggacttcctggaggacctgacctttgggcatcttcacgatcagagcacttttgtaagacatcattttagtgccctgaggcagttttctcatgtttagagaaatagcacttggggatgagaaggtaccaggtaccattccctacaccccattctcactatgatccaccttggaggggaacctgctggccatgtggttggagtggctgacacatggtaagcactgtgttaagggttttctattatcattgctatcactgtctggctaagaaagcagagctgtgtccctgagccagggatcatggaatcccaaagacaaaagcaaataccctctgtcctcactagaaattcaccctagagcctccagggactgagccccatgctcaaaccagccccaacctgcccctgcactgtgttcccaggtgatgaaatgcatcgttgaggtcatctccgacacactttccaagcccagccccatgcctgtcagccaggaatgttttgagacactccgaggaggtatgagctggaggctaggggtgagggctgctgcctgctgggctgggaggctaggacatgggtgtgtggcttttggtggaattaatgatttaactcaacagtcactgactgagtgcccgtcatgtccaggcactgcaccagggtccaaggtgtacagacagttgaaggggttgtagcccaggtgcttacagactggcagaggggatgcatatgaacacagttaactagaactctgggcaaaataaaaccagggctggaacagcaagcccccagactgtgagctccctatggacaaagattttgtgtgctgtatcccagtgcctagaacagcctctggcctctgcagacaccctctagatgtgtgatgaataaaggaatgttatgggtggacaggagaaggacgaaatctttccaggcaaccagtcaagtttttactaactgctggatagagccagcagcatttcggttgggctttaaaagaaacattggaaaccgatgagtggaaaaatgaagacagggttgtccaggtgtggtagacagtgtgaacacaggcatggagatgggaacctgttgtatttaaagagaccccactcatcctcaggggttgccaccctttggctaaggtctggctgctggggcagtggctgacttctctgatgtagtaggaaactgacacataccttggaaaggaggtaatttcaaaagtgttatctgaagacccaatcttgctgccaccaccctggttttgagtttccagagtaaattccttgtgctcagctgaaaatattgatggtaatctctttctcggctgttctctggaaaccacccatgatgactcttcttcattgcagatgaacggatcctttccattctgagacatcagaatttactgaaggagctccaagacctcgctctccaaggtattttccagccactgcacttgactctgggtaaattccagtaactgagagtcagaaaatctggtggaagattcagcaagttcctctctgggactgtcatttccttttaattataaagcggaaaagcaggatccgccgtgccacctggctcaatctgttattgatattgttaaagaaatcaaggcccagagaggttgagtgacttgtccaaggtcacacagtgaatagagacatgccaggtgcagcttccctaaaacccacggcctctgcagttcagtcattttaggaaatacctttatgaagtagtgagccactcatcactgatgatattcaagccaagcctggacaggatactggagtggagggttaagctgccatcttcccacagttagcctctatgcccagccccccagctccttccaggcttgatgcaaagcacggccctagccttgcaagtcaggaaacctgagtttggccctgcacctgccccggctgacttcctgtgggaagcggccgtttccaccagggcaggaccactggtggtggtgtgtctctccatgagaacagggcattacagcatgaatccagcatctgcttcccaacgaagcgagagtgtttttcagggctgggcttgtgtctggggtggggtgggggtacgaaggctgctctggcttcaggatgggccccactctgaggcctttgggacagaccaggccatgtgtgagaacagagagggctttggggaggaggcacgtaaacacagccacgtcagtaggattcctgtggccctttccaagctaacacactgttcttcctcccactcatgagccagcctgggcagcaagcacccacctcctactgttgttggagggggcagggagtgctgggcacagctgggactattattacctggatagttatgtcatcatcagtgaccttggactagtgttttgttttgtttttaactaagcattaaatattttattacaattgataactttaaaattaaatattgaatgactaactgattacatttaaataattaaatagactgtcaacagagactattataggagaatgtgtcctgaaacatctctattcacatgcacgtgtgtatcccgtataagcagtatccaatatatgtatatatgactattttccattaacagattcctggatgtatttctgtccatccgtctatccgtccactccctcttgggctcccataacatcttctgtgtgcctctgtcttagcatttaccacacagcaaccctattttctagacaagcacccaactcttggagagcccaagttgcccatggagctaggaaatagccagaaggggactggaacccacgttgcctgagaccagggctgggcatgctccctggcccacagctgcccaggaaagcccattgttggggaagaaatgagctgggctagctgaggggccaacatcaggaataaggcacaggtgtggggacagtcagaggaggcagcggcggcggggggagaggggtctctgggtcatggctgcaggcgccaaccctgggctcagatgtaggcacagggcttggccttctccccgggcctggactcagcgtccaaggttagcagagcttgcctgaatcaagagctgtcaccattactgcctgctgcagggttcctggagctaccagccaggtcctgaggggttccccacccccaactcctgcccagccaggtcctgaggggttccccacccccaactcctgcccagccaggtcctgaggggttccccacccccaactcctgcccctgggatccttgctccatttgagcctttcttgctgtgtggccacagcacgcttgctctggcctcccagggagaagctgagtctggcgaggcagggtggctgcctgagggcccagctgagagaggtgagggacgccaacccttcaccgctccccaagctcacgccccatcagtgtctcattgggcaggccctgaacatgatgtgcccagcttacagatggggaaatggaggtcttcactcttatagacaaatatgccacagctgcacccaatgggacttttccctccttttctcataccaggcgccaaggagagggcacatcagcagaagaaacacagcggttttgaagatgaactctcagaggttcttgagaaccagagcagccaggccgagctgaaaggtctgtcccagccggtctggccggaggtggggaagggagggtggcagtgggaacagtggctatgatggacccagggttccagtgagtcgggagccccacccataatcccttatttccctctctctacaaatggggaaactgctgctcagagagactaggtcccttgcccaaggtgagtggcatgaccaggggtttcgatctggtcctgcctcacaccaaagccctcgctcggtcccgtctgcccagaagaggggctggcactctagggcaggagatctctggcatggcaggtggacagcttcaactctgggtctacccagtggccactgtagcagagcccccacccccagtgcctgtcctcctgggaagtggtggggcctcagaatagccaggatgcaggaggaccacagacagagtaggtgtgaaacgtgaaatgaacccagatcatctttcttgaaaccaaagagcttctaggagtctaagaggtcatgccttaggtcagtgcgacactctgagccatcctcccttcccggggagagccacaaactggccccgtggcgcttctgctctccatgtagaagatgggccggtaaggccggtgtccaggagctggatcctggtgtctcccatctggggctgaaagggaaagcccgcaagtgaagcccaggtgcccccactttggttgaagctttaatgaggcaggcagccatgtgtcagtgcaaagagatcccgagcttgtcatttggaggcttgggttccaggctcagctctgctgcccgcaaactgtgagatggacaggtcatcttacctttctgcagatcattttgggtttctgtgaaataggcataggagcacctttcaccagagtcctggtgaagctcagatggtggaatgtacttgggagcactttgttcagtggttatcattctaatgacgggaggaattttcacttgttcaaaggctgtctttaaggcagccacaataaaataccttttaatgaaaccctaaaatattgcagaattgagccctttcacaggatgctgaagacagagaagccccacatggaggggagaatgaagttgcagtcatggtgcctcttacacagagaggttaagcaacttgcccaagatcacacagctgacattaattttcagttcaggctttatctcctggattaatcttaaggtctggttttttgtttttgttctttgaataataacctgttttaaaagtcaggattaaaaagaaagaaacaaatccagctgtgctcagatcaagcctggacatggacagaggggtaaccctaatcgttgtcctgggctgggctcgctggaagccaagaaacataatgagtaacatctgaaattagcctgtggggaggccccacacgtggcccagtcctcagggcctgacttggctgtgctgtgtctgcagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtacgtatgatggcgaagacctcaacgaacgtgtctgggagagggggatgggtgggaggagagccttctccataacctcattccaccttcataacaaccctgaaaggtaggtattagctccatttcccaggtggacaaatgaggctcagagaggttaagtaatttgcccaaggtcacacagctaatttgtagcaaaagctgaggttctaccccagatttatctgactccaaaaccatgcatttcccactattccacatagcctccccccaccaaccccagaagctaggggtgggtgatgggtgggctggctttgggaacagagaccatggcaggagcgcacaggctgatctgggaacagtgtcagcttcaactacggtttaggagaggccctggctcccgctgcgggcctgtcagggtctttcctcactctccagctgccgggcttctggggtgaggatgaggggaagaggcaggctccagctaacccacccctctgagccgagagggtcttgcaaagcctggcatcaagaaggtttttcccgctaagcgtcatcactgtggagaggctgggctgtggccgcagcagaggcccccagggagtggcagagactgggaaaatggtggtcccccacccattctcctgctcttgcccaccacctgctccaggtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggttggtatggggcgggagccagctctgtgccaggccacggagcagcagggggcagccgcacccagacacactgcccctgccccactgaggggacagggcccccccgccgaagtctggggatggagagatgctcagaccgggggctctcagggtgggagaacaccccagctcacagggggcacccagcaaagctggctgggagatgggaggagctcaggtcagcctgtggcagcgggggaggcgctgagtggggacgttgtccagaaggcagtagggtgccctggaaaaaccatgcggtgggtctgaccgtgtcccctcctggcccccaggcagcccaggcacagcctcctcccaggctcaggccctgcctctggcccatgagggtaacggggcagggcaggggcagggccaagggatctcttgcctgtggggagtgggtgggagccacaccggatgtgagctggaagacctgggctctgcctcctcttggctgcgtggacttgggagggtcactcccctccccgagcctcatcagttccatttatgaagtaggggtaaggagtctcctctgcccacgtcattaccatgattggaacacacaaaggctttgaaaaccagggcccctggggaagacaaatggggcgtggggacacagcccacaggagcaggggggagttggggtccctggcagctaggcggctgggatacctggttcaagcctagtgtccaggtaggaacccaggctctgtgggaaggctgacacctgtccgcagccctgaccccaaggctcttctctgcccacctagaagagggtgtggccccttcactgggcccccgaccccctctctgggcctggcagtctgagaggaagaaggctccatgttggcagctgtagcgggagagggcatctgcccacgtgcctgggagcccagggcgaggggctgaggacaaagctggagagaatgggggcccagaggtgccaccagcttcctttctccacaagcagagggagctctggaccgcagggcagagaaactggacccctgaggcatatggagaggatggggtgggggcctcctcaacacagcccaagggtcttcttagaaacccgagcctcgcagagcacctgccccagggcctcctccaagactaaggggctgtagagtctatttccacggcctgcaatgtcggggtccctgggccaggatgccctcggcagcctcaaatctggcagtgaccccgggaaaatgacccctcccaggtcaaaggaggcagccttccctgcgctcctgctctaagtcttgaggttgtgctcttgtgggtgtccaagttctgaggcctgaaagcttctgcagacaggcatagaacagggctcagaggaggggtccctgcttccctaaacttgggtagccagagttcaggatcctctcacaatcaggaccagggatcaaagcccagccctaggcaggctgatgtggggcagctcccccagcatgtagccctgtctcaggccccacattcccctcaggtgggaaggctgcagaagacagacccggaagtcccaggctggcctcaccctgggtcctggcaaccatgggctaggccgagggaagggggctcttcagggcactgtaagctttgttttccatgtgccctaaaagaacggactcccacctgtgcgggaccatttgagaggaagtggggcctggataagaggccaccaagagcagtgtggggacagggcccccggcatcagccaccttcttgtgcataatgatcccgagagcagtacagtaagctcattatcactgtctccatgatggatgagggtacagagagacaaagccacctgtccgaggccacacagctaacccagcgcctttctggcttactgtgccttccatgccactggccaggctggcccgagtgaaccccaatgtctctcctaggaccaggagctggagagcctgtcggccattgaggcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctgaattttttcgcctctcaacttaagagtggagtgagatgcactggatttgggcgaagggacaaagggaggttcagtcctcctggggacctcctttctgggccacttcctggctgtgggatcttgagcaagtgactttgttagctctgagcctcagtttcctcatctgtaaaacgggaatgctgacctgcctcaaagagtgtgtgcagggattaaagcacacttgctgagggcctccaggttccttcctctccccgtccccagccacacctgagctgggccatgcagaggcagcgccaggtggggacacgggctctgtttcctgagatcaggtcgcccctccctgatggtccccgccatccagtcacctgtggtgccgggtggaggccctgacagccccagtctagtgcctgtcgcaggacacaggcatcagacttgagcctctgagctgcagggaccgcttggcataaccacttattaggccctgctatgacttctggcctaggaagaaggcataggaatgtggggcgtctgaagatctcgtgtatgtaacgcttcactagagcacgggctgctcttagtcccagttttgtgaatgaggaaactgaggcagagaaggtgaaatgactcacccaagtcacaggcggggatgatgctcagaacactgaagcgtggggactgtgaggattacacagtcaggacccatgtgtactggctgaatatcagggcccatcattcagtcactcgtcaaacatttgtgcatggctgctctgggcctggtaggcctgagcatggctgagacaagccctggctttaagaagctcactgtccagcggggacagctgcacccttcaacagccaaagcaacccatggggacaaaagtacgctcagcaggaggagcacacgcccacgctggagggcgctccttgcaggccaggaggaggttgggttcgagccaggttctgctggactggctggttagccttggccagtcacttcacctgtccaggtggcagttctggggctaacgtccttggcctttgcagctcaaacacgagcaagccagggagggtgatgatcccaggcagtggtggagagggtgcagggaggggcctcggccttcgcaggctgcccacgtggtgtcttccaggtaggaatgggaaagacatgggcattgtgggtgggtgaggctcagaggcatcgctgccaccctccagggtcccaggcagagccaagtccagaggccagttgggatttgggaaccaagtccctgaggctctgcctggtgagtctgagcaggcaaggttccatggtgggaactcagatttggacctaagactggagttgaactccccagcccagccattaatgagcaggagtctttgggcaggcgctcctggccctctcagtgcctcagtttcctcatctataaaatggagacaatacttactatctccttaccagattatggtgatgatcaggagcccacacagaaaaccactgcaatggtgttgagtcgtttgaggggtctcggcaagtctgggtttctctgatgaggatgggctgctcatggcggctaatgcgcaccccctgccccctgcaaagcacagaaggacaccctccgaacggctggcgctattgtttatttcttcatgtttccaaaagttaggtttatactccacccctacagttacagaaataaacacaacattaactgtactccactagaccgttagaaatcaaaacaagactagttagcaaatacagagatcctagcgacaccttgtccctgaaaccacccatcccaaagccacccgcagtgtcctaacctcatggagtgaacatgcgaccaggcgaatgagccaatggacagaagccatggtgtctgtatctcatacatggtcatgtatattatgcatatgtatgtacacaaattaagtacgaaccagcttgggattctggtgaagttgcttgtgaacagcttgaagcaaacagcatttgtca

SEQ ID NO: 13279 - DNA, 30868 bp, Human
ctgaagcctgacatccacttcgcccttgctccttgtacccagcaagtgttctttctataccagggcttcttgaacctcagtgtgcatgagtcatggagaatacttactcaaagtacagattctggccctcacccttgattctgtgtagaccatgctttgagaaaactctgctccacagaatcattctctctctctttgctcccaaagctagttaagaagttcaggtactaaagaaagacaagttatttcccctgtttcccgtggtccagctatgggagacaaatggtatttaaagtaaccagaaaaaaaaaatctggaaatggaagttaaagtggaccaaattagctttcatatctagcagggattacaaccccacatttgttctcaactgcacactggatgcctgaagcagacccagcggtccctggagctgaggaagttgaggggagtggggggcctggcagtgttggaactaactccttttccctgttaattgggagtcccaaggaccaatgactgattttaaaatgcatgtttgccactccttctgtccccaggcccttgccatcactatgtgatcagttctgaatcatcatttgtactttgaaacagattcataccattccgttgtattcaatcaaattagcatatcaggcctttgctcttattgtgtgatgaaagactttgttccctgtttaaaggaatgctaggcaacaagaccagaataaggagattttgggtttgtttttagacctggatccttctcctgtgcaaccccaacgcatagtaggtttgagatggactataaaggtaaagctacttttataatgctagagtgtctgcggagaaatcagaaaggaccacagagtgctggtctggcttctcttttttccctttaggctatgtggtacagacatcatggaagagcctgaactgagtatttataatttcatgattctgctctggatatcagagcagcctctcccaggttataccttatctgatcctcccctggtgccatcatctgcccaggctggcttctcctttctcccgtctctacgtccccaagactaggctgcctacccggctcagagtttcttctattcagtacaaccaacacccagaggaactggtgaggaacaggaagctcaaggatctatcaagtggtggaggatggagtcacagaaagtcctttttctgatgggagagcaaggtgaaatccctagtggcttagacccagggctggagaggggataactggggagaaggcatccagggaagtcctttttctttaggatgatggtgatggggaactaaatggggaaatatggaaggtcacaggaaaagttaacacaagttagcaaaaagttaacataacacaaaaaggtcttgcaggaaaaaaaaaagaaaagaaaagaaagaaaaagtctccaagaatggtttggacagccaaaatgaatacttatagtcacgtatacctgctcactcctgacgcttcactcacacacagcacaggatctggtgaggctatcactaaatgtgccacattgtggttaagttttacctgattaacgaaatgctcacacttctaaactgaggtccttacagtagattccttttgcaagattgttactggcttacaacttaaaaataaaggaaaatcacaaggaaagaaaagtggggaaaaaatcggaggaaacttgcccctgccctggccaccggcaaggctgccacaaaggggttaaaagttaagtggaagtggagcttgaagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgcgtgagtaccgcccgcgcgccgcggccgcttggcttcgccgcggggagggtggaggctttctgggaggctgaacagcagagcagagtctcacggagggaagggacccctgcccaacccacgcactgccgcccacagctgcttccccccggggccagcgcctcacctgggagctgacgggggtgggaggggaagggaaggccatcacccccgcgagtgtgcgttagccgaggtgtgaatcggtcagcacgactggttccaatggactgagataaagcgctttggagatgccagggtctcttctggttgccagaggcgcggagtgcgaagttgcagccagaaccgggagactggggaggagagaagcaggaaaagttttgtggctcttggttgattcagaaagtatagacacggagcggattgctgggaaggggccggtgtgcccaccttgcacagggactgggagagccagaagtggacattaaggaattcgagggaagcgaatcagggatgaggctccaggtcccaggccaggggtgttcggaatgaacagtccgtgaaaaggaaaaacaaaaccaaacaaccaaccaaacaaaaaccttgcatttaagattgggaagctgagtttgaattcccacttcagcaaccccaccgcggaggaggtagaagtagacagaatttgctctgcgcccagcctcgctcgccttaccaaaaaccgtcacccctgcacaaatttcaaaacttgtcaccttttggagttttcttcctctgcccctgctccaagttctaaagctagtggatgggttagaacactgcccccactcacctacacatatccttactcttaaggtcttgctctcacttcggttaaaaaaaaaataggcacccggtaaatatttatactcgattactttccttggggaatgacattctccacctcatctctttgcacttggaaggtttgaaacttttgaaactttgtacattgctctcccttttgcttacagcactctagggctcccaattctgtactctcactacatcctaagggccacccactgtggccctgcagagtgacctggactagacctctttgttcccagtctcctctgttgtccatctttgggtccgcccagctggggacagctgcccctgggctggaggaagctctgagagaagttttgggttgccctgtttggcagtcctggatgtgtgctttggggcaaggaaaagctatcaatgaggtttcaaaattctagagtgggtgctagactaggccctcataacaggagtgagtcggccgggcgcagtggctcacgcttgcaatcccagcactttgggaggccgaggcaggcagatcatgaggtcaagagatcgagaccatcctggccaacatggtgaaaccccatctctactaaaattacaaaaattagctgggcatggtggcacacccctatagtcccagctactcgggaggctgaggcaggagaatcccttgaacccaggaggcggaggttgcagcgagccaagatcctggcactgcactccagcctgggagacagagcgagactccttctcaaaacaaacaaacaaacaaaaaacaaaaaacaaaaaaacaggggtgagttggccagtggtgcagattccaatcagatgctccattctcctttggctacacagcttgtgatgacctggtcctcagccgaatgaggtccacccttttcttatttcctcagctggtaagtgccagtctcgccttggcctgccgaggttggggttgggggagcaacacaaccttggcaaaactttggactgatatgctgagaatatcccagcttttggtggggagggatgaggcacaaggccccattcccagccttgccagactacttgagccaattgtagttttatgcccttcccaagagctttctagggtttttgcttggatttgttttgttttgttaatactaggagtcattttcagtcctgggatacattgtgggataaatgagataactgagtgtaccttgaaatgctaccatagggccattgcagaaatgctattattattgtaaaatttagggtagaggggatttctgtggtttgttttctcatcatttaccccaacaaagagcttgttttgggaagttctttttttctgtccctttgagaaggtggcatgtgcataggcactgcaactaaccagaagtgggctgtctttgttggaagtgggggagatcacagagcagagtcagggtaaggggctcaagggccaccaggcagcactgccagagtgctggctggagcaggaagcctttcaggtaattagggaacccctttgtcaggctcagggtatctatttcctccaagctttccaaggcctgtccctatcctcactctaacaacacccccaggccctccccgtcacattcctcttcttcctttgggtccttcgtgcctgctgaccccacacccatatcctgtccagggctacatgtaagaggggaaaaataaaagggaaaagaattttatcagctattttccagaggggagaggactccaccctttgaatctctgccatatggcgacagaggaggagcaggcttggggacctctgactaattcagtggtccccagtgctccgcacttgtagacccaacccagttggcaccacctttgcagatgcatgtcttcagcagcatttctgttcggctgataaaacacacaggggcctggggcctctttttcttatccctttggctccacctcctgggcctcctcattcccttgtcctcatctccttccttcgcaatctttgtctcaaaaagcttagggcaagaagtgccaaactgcagcagataaactcagctgcagagtcctacgaaaacaaatgaaaatgaggaacaaattccacttcttaccgttggtctcattgcctgatttcctttagaccctgagctggagggcctgggtttactttcagggctggatggttacccaactccactctcaggtacttgggcctccctctctcattgactttggttgatctaactaaatggcttgcagtgtggagaattaaaaataagaaggtatggaaaaagaacacaacaccaccctccagaagaaaattctcacagtcgccagggctgtgagaattccatatttttgtgggcttggacttctctaatgagaacattctcttccctccttagctaataaatgaaaacatattatctatgacttttagtcccagagctggacgttgtgctaaggagaaagatgcgtgcatgttggaaagatggagagacaaacaaatagggatgcatataaaggtgtacttcttagtacctgtgctcttggagtccgtcggaatgagttacttcccttcagatgcaacggaaaaggcctttgggcttaattgggaagtaggcttcttctttatttggaaaaatgaaatcaaactgatacttcttagagaggagtggcatccctaggcagctgatttaagaaaatgtcttaagaggtctttgagtgacaaagcctagaaccccagacaatcctggatgagcaaaggtaggcaggaggctgaattgctgagcatgataaaatgaagtgaagccttgtgtttaggtgggcacaagagacacaaggctgataggactccagagcccaggaagagcatataaagggtggagaggtgcctggagtcatagcaggacagtggtgggtggaggatggaaaagacctgggaggaaatttttttttaatacatggcttcattagcacagtaatgtctaatatttcagggttatgccattgtctcccctgggctgccctgtaatctcgttccatgccctcaacctttcagtaaatactggctacacacactagccttgtgttagtggctctctggggagggtaaagtaacttactttaccttggctaacttacggtgaagtggtatactagtgcggacagggagccattgagccatggagccacaacccaggagtctgtggtgctggtaaaatggaggaagaggtgacagggagaaatgtaggtgcccagagaatcttcaaaataattagggttccacagtaagtggatggggtccaagacatgctattttatttatttatttatttatttatttatttgagaagaagtttctctcttgttgctcaggctggagtacaatggtgtgatctcggatcaccgcaacctctgcctcccaggttcaagcagttctccttcctcagcctcctaagtagctgggattacaggcatgcgccaccatgcccagctaattttgtatttttagtagagacgggttttctctatattggtcaggctggtctcgaactcctgacttcagatgatccacccacatcggcctcccaaaatgttgggattacaggcgtgagccatggtgtctggccaagacatgctatttgaatataaaacagaaatctcggtacactgggaaccctcaggccacagacccttggtttatatatactcacaccttagcttagcctttgaagcttaagaaggcatctgctcagtcccttgttctagtctaggatgactgaaattcatggtaggcctcagagttggacagccccctaacacggatgcctcctgagtgtttgcaggaagcatggatggatcacttatctcccaaagtggctcatttcattcttataaatagctacatcattttacactttttccttggattgcagtgaaattggccttcccataacttctaatcattagttctaattctattctttgggctggtacagatttaatctggtccttcatgacaatacctgaagatgtttctagtgggccccactagattacaaactccttgagggattgatttaaatgacaatgacactaacacctaatggaggaaagagatccagctctcattttgtactctccacagcactgagcgagatcctttgcacatcactggcactgcagaaaaatgagaatgaatacacagaatgaatgtatcccttatccaaaatgcttaggaccagaagtgtttcaaatttcagattttttcagattttggaatatctgtgtaaacataatgagatgtctcagcaataggacccaagtctaagcatgaatttgtgtttcctgtataccttatatacatagcctgaagataattttagacaatatttttaataaacttgtggatgaaacaaagtgttgactgtgttttgactgtgacctgtcacatgaggtcaggtgtggaatcttccacttgcggcatcatgttggcactcaaaaagtttcgtattttggagtattttagaatttctgattttcagattaggggtgctcaaccagtgtaaataacatgcatcttaaagaaagttatttatttttcctccccaaattcttcttttccatatcaggggtcagcaaactttttctataaagggccagagagtaaatattgtaggctttaggggccatatatggtttctgatggatggtctactttgtcttatcttacgacacttttagaaatgtaaaagccggccacgcacggtggctcatgcctgcaatcccagcacttcgggaggccgaggcaggcagatcacctgaggtcaggagtttgagaccagcttggccaatatggctaaaccccgtctctactaaaaatacaaaaattagccgggcatggtggcacatgcctgtagtctcagctacttgggaggctgaggcaggagaatgtcttgaacctgggaggcagtggttgcagccagccaagatcgtgccactgcactccagcctgggcaacagagtgagactgtctcaagaaaaaaagaaagaaaggaatgtaaaagccattctttactgactgaccatacaaacacaacccctgagtcaggttaggttcactggccatagtttgccaaccccccatctagatgaaataacactagaccctcaacaatatgacttggtttctagaactctcctaatcctggttatcttcacatgaacactccccaatttaattaattcccccttaaaatataacatgagaacaagactgccatgactagaggtagctggcaggaacacacctgccacagttgtcctccaatcctattgcttttcctaaactccaaggattgtgctaagcaccaggagtaaaacacataagaataagaatggctccagcactttagaagtttatattcttactgaggtgacagttagacctatcctgaggaagcagcatatatgattttgtggcagatgagtcacagaaataagtatctcatgcccactgagaagcagaaggaaggggcctaaaacaaaagatatccactatttcttgaacttttaccagacaggataactgcttctacttcttagctcctttgttcctcaaaacagctaagacatagggactacttttatctctgttttacaggtgaggtttacagagttgaagtaacttcccaaaccacagctaaaacatggtaaagaagcctttgaatgtggcctgtctggctgcagagcctgagctctttgtctctgggctataccgccttcctggtgatacagtctgtggctcccaacggcctacttcctggcagaggctggcatgtcccttcatcctagttctgtaactctatggactaagattcccaggaactccttcgagatactcctcttgatccaggtgctagaatatgaaagcatgggcaaaataagactggcaggctaggagatcaggaaacagcaccaggaaaaaactaaggagggctgtgaaaagcaagaccaagtataggaaaactcagtctcttaaaatatggggatttagttattttggtagcagagctttctggatcgctgaggatttgcaaactcactttaaagaacaaaagagtcttcaatttactagtggcaggtagaaatattttcaaaatgtattgcacatgtctttgctttcttagaatacccccccgaaaaggactttatgactcagatgtatcatgaacatgtcgtggctatgttgcaactcagtgacatcattaatgcttattaaggtatagatatctaacctattcactcctaccataaatgattcaagaaaactggtgtgagttttcatacttatgtctgcttttcatttatttctgtttcttagttttcagctgttgcttctccttattatttgcttctaataggctcttcctacgtttcaactttagctaggatatcagataaccagggttattagaattatgtgtaaaacaagaataattgactctgaagaagtacctgaaagttcagtgcatgacttttactacatgaattttgtgacatctcttagaatcctcattttactaatttcttgagaccttgtctcctcccttgctcccagttcataagttgagatcaactagagtaactaagggtcaaatggagtccctagggaaacacagttaataaggatggactgagaagtaaacaacagaagagagctttttattcaactttaaattgtactataattcttgtagccttgtgggtagggaccgttcctcccatctagaatgaaaaagagtggaggtttcatcaattgtctcttaggatgtgacaagctctcactgactggtaggctcctgctactcccctacagagttgggagtcagaaggtcagataaagaaaggtcagtgtttgatggtttaatgccatggatgtgtgtgggaagacaggataaaaagagatctgtggtcagtcttgactctcataaatgtcattcctccagggctctagagactgtgaacctaaaagatgcactctccctgctgtgccgcagtgtttatgccaggattggctccaggcccctggctaaggtgtccccttgctctgcaccagctcaggcatttccagtcactcagtttggtctttctgccctcccacttgtcctgtccccctggtgtctcagagggtgctctgctcaccctggggtcagagccctgactctgaagttggggtccctttctcatttgcaggtggatcctgctactcattccacagcgctcggcctggtggtgggtggaggggctgctgcagctgcgagcctggccccagtgggtcagtagctggcttgggtccagagttgctttgctcttctggaacaggcacctctgtcctcagaactagcagcaggtctcactccacatctggaaaagttcaaaagtgtttgtctaggtgaaggaggcccttcgggggaggggattcaaaagcatgacatcatctcagtcaggcccagcttcctctggagagagaaaagggctgggccagggtggaccagatggggtccccagtaatcagtatgctgggggcgaagaggaagagagcaggcaagaagaggagtcttggaatggtgtcttgagaaggtgatcctttaattcagtgtctgaatactgcccccttggatgaattcagatgaatctgaccttaaagtcagagtggtgagagggtcccatctaaacaggaaagaagcctggattggcttctgcatcaatttattttgatcaacccacctcctgtttaagccagatgggagcccatccttttctctacagagatgtggggaataaattccgattttttggcagtttagacccagcctaacctccttgttgcatctactcaagagtcagctaaacgtcagtgttccattgctgcttcccttcatgaactatggccttccttttgggcagcaccttggtgattcaggctcttcatctctaagacagagatagtgatattccttctccccactgcttacctgacacataacagtaagacacgattgctgcagtcaccattaatagcaatctgcttgcagcaggttgtggaaggaagcagatatgagagagtgaaacccttgtcatcacctttagggaaaccgttcttggccccaggttgatggccgtgaagccaaaagtctaacttccctcttgatcctgagggaaacaagagatgtcattctaccttgctgtttacctggaaatcgctgaaaagtacagatctagatcccaatcaggaaaatttagagacaagctttagggtggcctgggaccctcagaggctcttccttgaagatgcaactgcctttatgaactctggataccaagttcacccttaacatttacaaggcccaaggcaagagtacaacagaggcctacatactatatttctaaacatttcaaggttgtaagtcaggccaactaactaataaaatatcttctatcctcttaccttgacaaacatatcttcgtgatcacctggaaggccaagtttcaatttgggatgctcagattcttggaattcactgccacagtgcagcttagcaggaagagatggctcctggccccagcccacttcccttcatctactttctacccatgactctggctcacattgcaaggcaattgcatgtgtgcctgggacaccccacccacaggcttaagcactaagcactaactcttctccctgcaagcagtcatcatttggccaccactgggccttgggggtgtacacccttgtgctgcagttccccttagcaggatggactgggagaagcggcccatcgtggatgtgagcaaagtgccatttgatcaagaagtgctaggacttctggtccccacagtatgacctagaagagagggtacatcctgattggtcctcacaggaagcaggacagggtgtgggctctttgaggcatagggttcagtcaagaagcttctccttcctgtgtctaatgaggatactgactgggaatggtgagtaacatctgtaatcccagagctttgggaggccaagacaggaggatcacttgaggccaggagcttaaggttacagtgagctatgatctcaccactgcattctagcctgggtgctgtgatgacagagcaagaccctgtcttaaaaaaaaaaaaaaaaaaagtatgtatcccaggatatacagaagagatgtgcaaagacactcatgaagatcttcagagaaaaatgagatccaaaacattatactataatactataataacttagcatttgttatctcattgtttatcccagcaatccatgtaaggtagccagaaaagacccttacttaagaggtaagagagctgagatacatacatgcattaaattacatggttagttattggaagagccagaacaaagcttgtctaccttcccactacattgatgagaaaccagaccttgtgttccctggttcattagctgaattcctaggtcagagcatgctaaaagaagaaaaggaaaggcgaatgggtttgaaggccatgagcaaaaggatgaggggagtatgggaatgggaagtctgagaagtatagatttttaaggggatcgcatagagacagtgagtctagtgattattccaagagttagtatactggatggagagtgaccaaaaaagaggatacagtgaaaagaaaaaagaagcatgaccttttgcacacattagatctttgcaatatttatgcaggtgtaattttatattttagtatgtaactaaacatactatgaacatcacctcatagttccacgttgctacagtttttataatttttttctttctaatgtttgtttatatgattatataatgattatggtatattaagtgcatatatcacttatcctatcataattcatttagttgttcacgtttccctcctataaataatactgtatgagacatttgtatgcatataaatctttccttccctatgtcctcagggcaaatttggtagtgggaaattaatccactgtccaggagtatgttcttgttgctgccaacaaggggcagcagggaatgttctagacgaattctacctgaagtcaggaaattgcatcaggtgatatcaccaggctgatatctttaggttctgattcttcctcctcgtttccctatagcttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacaggtaaaaacagcatttgtgtcagatcccggagagatgctggtgatgcttgggtaaagcatttaggatgttttcagaccgctcccctctccacagaggaaattatacaagtccctagtattaatgacttgagtatcatgcttagggtgccctgaagtaagttctagataattcttccttcagtgacagttttctcaggcccatgtcttgggagctgatcctgatcagtaatgcctccataccccttctctcatgctgagtctagcttagtgataaaataaggatcagaagactcaatagagatctccgatctcttctaaaggaaagaaggtgggtacaggtccaaactgggggtctttggcttctctaaggtagaccagcatctatttcagtttcaggacacctctaatacattctagattctagctctggttccaacagcttgaaatgagtttggtcagggatgggacacgaagtaactgttaactccccaaactcccttttctgtgttgaagtgcatgcccatatcatgacctgagattttgtgtatctatgagcacatgcacacatgcacacccatgttttggtctcttccagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggtgggtgaattgggccaaaaatggcagattgcccctcacttcatatgtatgcaggcaagctgtttctttccctccacccctctcctcatccctgccagtgggatttgggtcatgtgggaatcagcacggaaatacacagtttaaatattgctgggagaagtagaaagaggaggaaaggggtagagttaggtggtaaggcccatccaggctttgggtattgcattttagggaatagagagtaaacgggattctcagagatccatccaatcctctggttctttctagtacctatcagtggggctttgaccaggacaccatttccctttgggaatatttggcaactattgcttatttgctggggctgcttctcccacaatggttaggacaaataacatttcctctacatgagagggtttggtggttgtgccaggcacagagaggcagtaaaggggggcattggcaatggcaggaactgggcagaccagggatggtgagctcagcctggccttctcagccttagggcctatgactgtcaacagctttcagcatgcaggacagaaaatatgagggcctcagtcatgagatatgcccgagggatctttctgctttctgtttttaaaggagccagggccaggcgtggtggctcatgcctgtaatcccaacactttgggagcctgaagtgggcagatcacttgaggtcaggagttcaagaccagcccgggcaacatggtgaaaccccgtctctaccaaaacatacaaaaattagctgggtgtggtcatgcacctgtagtcccagctacccaggaggctgaggcaagagaatcacttgaaccagggaggtggaggttgcagtgagccgagatcatgccactgaactctaacctgggcaagactcgatctcaaaataaataaataaataaataaataaataaataaataaaagagccaaaatgggaatttggagagtcctggaggccaggagaaaaaacaggtaccccagcatctgctggtccaccccattatccctgtttgcctatatggccttcctgcaagtttgtgattgactggagagaaaacaacccaaatgggaaaagatcctcccctctcccagtcctgcaccatccaagccagtgtttaccaaggttgcaaatagctgcttgccagtaagcccaggctagtaacaaaagttttgtcatctgatgaggatagatatgaaatagacgagagtatgactattagaaatctctagtcccctgacaaattttaaatgtccttttccttaaaacctcctaagagagcacctcacagaaagcaaactggaaaaagttgggaaagaaatgaggagcaaagatactggcttatttactttgtttttgttattgtttttgttttaatacaggcagaaatcaaatgttcaggcatcagagaagtgaaattgactcagggcatctgcctggagcaaaataagacctccagctgtgtaagtcaaccccccacccaacctcttcctcccgcccctgtccctttcctccatcccttctgaacacccttaaaccttcttggattgcactggatttgagtaggggtccggggagtttagcttggtcagcctgcctttaatactgagctttctgtttagggagtaagaggccccatctggtgggcaaaaaagacaataacaattttaattattaataaattttgttatttttccatcctctatagtactttttccccctcctctatagtactttttaaattttcccctcctctgtagtacttttaaatctgagagagtcagatttaagttgctttttggttaagaaagtccttctcactcaccagatataaactagtcacctaaaatgtcagttcatttattatttcatttattattattaaatatttacacgtaactctttaatccatatagaatttattttgctgtaatgttatattttccatgtaaccgtttttcctaacattatttgttgaatgactccctcttctgttgcatgggatgtatcctttagcttatattaagtttttatatgtcttagggcatactcttcagacatattttatttgttcagtttgtctgtacttttgcctattttaaattttcaaaattattgtatgtttttactacagtatttgtaatatccagtcaggcagatctttttttattacactgtaaaaaatgtaaattatttttttctttttgaaaaaaatgcaaaaaaaatgctttaaaatttgaattgtaattgctctaaaatttcttcattttttctggttttcttttgcatctctcagcatcttgtttctttagcttttttctctagatttgatggatgtcataggcctatttgtcacatagatctcccactatatattcaaattgattgtcactgatagattaaaaagttaatagagttttgaacaattattttgggtttggccagtttcttgaatttgcctattgattctaggagctttttagttgattcctttcaattttaaggtaagctatcttgttatctactacaatatattgcttttctcctcctgtttagtagctatgcctcttgtttcagtttcatgtcttactgcattggaaagaatgtacagggaattgtgttattttaaatgattctggcagaccttgctttgtttcagtaaatctaatttcctaacagtaacatggctctggaggaaggatgaggtgaaggaaagagtggtatttacttacagaagaaaacattttcttacaagttggggatccatctaagggaatcacatatgtgatgtgctggcatgcatagactggaaagatcgcagcctgtagagggcttaaattacttattttttccattctaactcggtagttttactacgatcatcagttgggtctctctgacttacaaatttgtaaaaattatacctgaaagaatttaacttaggacatctaaaaacaacagaaatagtgaagacatgagtttgcatagtagaataactaaatgcagtctgcaaaatagttaacttaaacatgaacatacaatgtacaagtaacatgcagcatgtttctgatgctgattttcaactcaactcattagaaaaaaaattgtcaagttctttgctagttgtagccaaggaaaatgacgatctttccccctgcaaccccatcgacttggtggagcatacattttgctgtgtatcacacaggtatgtgccagaatgctaattctttgtgcctggaatttagagttaactgcagagcctttgcctttctgttgctcttcaaagctcacatgtaacttgggtcactgtatgagaaaagtgccagaaacttactgctcttttagaaataattcctcctaactctgctgtggtctttgctgtctggcctacttcgtgccacagctgagaaggtctctgcatgttcctctaagattgaggtagtatctgtgagtggggatgtgaaaagagagcagctcccctccagttcctatgccaaagaagacttccatccacactgccccttcataaagcaactctgtggcagctcatatgagtgcttttgttcccctggtctctccaccagtgttgatcccctttcttcctgagggctcctcatcctcagcccccatgcggcaaagcctcctgctactccccaaggtaatttatcctcagcttgctatcctgttccaaaatgtttagccacagctcccgattatgtccaagatgacctttccttggtccctactccctgcttgtctgataaacaatctgttccaaaagctgcgaatgctgcagagcctcctaattttccttaggttggatttgtactttcggtgtcagagggccttaaggtattggttctaatgttgggagcctcaggccctacctaataccctggtgaagagcaggaaggatttggtttccccgagcatcacatccttgatgtatgttggtatgctcctcatctaatatatgcccataacaggaatatatgtgcatgagtctagctatccagacactcattctgcactgacacatagtgagtaccaatatgttagctcaccctatgtggattctgtaggcgtgtcttctgtatgtgcattctgtagacatgtctatcccaatcactcttttttttttgctccccagccatcatctctaggcagccaggggaagggaaggtgataccactctcatctcaaacaccttttaccatatctcagcaccctcattagtaggatgtgtcttcctgagtctaactgtcattcttttggcagcagtgtcagcttaatttagtttttgtggttgtggttccccaaatagtttccaaaatgtaagattactttatactattatgctacacccatttgtccagagaaacccaccaaaatatttttaattgtggtaaaatatacataacataagtcatcaccttaaccacttttaagggtaccattgagtagtagtaagtacgttcacattattgtacaaccaatctctagaactgtctgcatcttccatcactgaaactgtgtacccatgaaacaactccctgctctccccagaccctggcaactttctgttcctatgttcctatgactttgcctactctaggtacctcatatgagtagagtcatagtgtttgtcttgttatgtgactggttgatttcactcagtataatgtctttaaagtccaaccatgttgtagcacgtgtcagaatttccttcctttttaaggatgaatgatattccattgtaagtgtaaaccttgttttgcttctccattcatctgttgatggacacttgggctttttcccctttaggctaatgtgaataatactgcttttaacataagtgtacaaatatctccttggcaacctgatttgagtccttttggggatatatccaaaagtgaaatggctggaccacatgggaattctatttttgaatttttgaggaaccaccagaccgttttacattcccaccagtagggtacaagggttccaatttcttctcatcctcatcaacacgtgttattttctgggtttttaaaatagcagccatcctaatgggtatgcggtggtatttcatggtggttttgatttgcatttccctgatgattagtgatgttgagcctctttcatgtgtttgttggccatttgtatatcttctttggggaaaagtctagtcaagtcctttgtccgccaatttgtatacctatctttagtaccacatctgtttatatgcagagtttgtaattactcagctagctcactttactcttattcacattgacttcatctgaggcaggctgcctccagcttgcactaaaggtcagtttccatgcggaaaacataagttacagatgaaggatttatgaagatggtgtgtctactggaaaaagcctgcaatctggaaacgatctcacttctcatccttcgttagctgcccccacttgttaggtgacttgaaacaggtcccttcattattccattttctatgtgaaaatagcgttttcacctgcattgtcaaactcacaccaaaatagataaaattatattaaaaggggttgggggagatgattgatcctagaatctcagcgttctaggatcttaatatcttaaatatcttaaaggtcattagaaaaatacctgtccctccctcacccccatctccgtccccattgcaatgcttgatgttaagagtctttgcaaagtttgagaatgctactctagagaggttagatgggtttattgtgtttgcagagaaacatgtgtgagctgatgtagttaggagcttgtaaatctgattctcatgaacaaaatggtgaggctgtgtcttcctcctgcccactctcccgtgatgtttgcccacagcctctcttgggggaggatgtttattccaagtgtccggagaagcattgtgctttgttcaggatccacctgctcctcttggggcccaaacacaattcactgatgcggttggattccagagtgggaggctggccgctattattcccttgaatctagtccaagaaactgtgcaaggggtggagggaccctgtgtggaggccaactggttgggatgttaagttgaacaacaattccctgagttcttttgtttggtgccacggttcatgcagtctgggttgtaaatgctataatgtgcactccccccaacacacacttaggagtcttacaatctagtcacagaaaaatgacaataacaatgcatagaatatgatcaatatgtagactctagatgatatggtatataaggtattactattattaataatgatagtagcagctgctatttatctagtgcccactagattctcaacaccacattggacacttttttttttttgagacagagtcttgctctgttgcccaggccggagtgcagagtgtagtgttgtgatctcagttcactgcaacctctgtctcctgggttcaagcgattctcgtgcctcagcctgccgagtagctgggattacagatgcccaccaccatgcccagctaatttttgcattttttagaagagacaaagtttcaccattttggccaggctggtctcgaacccttggcctcatctgatttgtccatctcggcctcccaaagtgctgggattacaggcatgagccactgcacccaactggacactttcatacaatatctatttagtcaccacaacaacctagtgtacagctgaggaacatgacactcagactagttgcatgacttgcaaagaatccagtaaagagcagagtaaggattgatgcccagtctggttgaaggtaggaccagcttcattgaggaggtagaaactgagttgagtcttgaaggatagtgaataccagggagaaggtagtgttcttcattctctttgaaatgagggttgtggaataatgcatgctgtccccatcttgggcttcctggaggtggggcctcagttccaaatgctcttccccactggcttcctctgctcaccctccagccattcttcaaggcctatagtgacatgtgtctgctaaccttaaccagacgtgtcctcacgctccttagtatgtccatagcactttggttgtacctttcttatggtgcttaccatggcagtagctctggcctctggagtctcttcacgcctccatttcttcatctacaaaattagtagaataactctaccaatctcgtaggtcgtgtgaggcctaaatgagttaatatatggaaagcactcagaactgtgcctggatatcataggcatctgttactttattttttatttctttatttttgagccagggtctctgtcacccagggtggagtacagtggactcaacctctcagggtggagagaccctcccacctcagccccccaagtagctggtactataagtgcatgccaccacacccggttgaatttctaaattttttatagagatagggtttccctgtgttgcccaggctggtctcgaattcctgggctgaagtaatcctcccacctcagcctcccaaagtgctaggatgacaggcatgagtcaccgcgcctggttggcatccatcattttaattgccgtacatgcaaactgaaagctttgacaaggtggaattcatagatacctcccaatccccacccccctacacatgacacatgaatacaacacacatacacatgacacttgcacagaggctttcacgcagtgtcctatattcagggcttgatacattgtcaaggtgtggcttcttgcactcagcaggtggaggaaggtgccatttggtttggctagtttacaacctgcaggagccctgtccctctgcctctcttgggaagcagacctatttcaactggagatacttcagaagcccagagtcatccaggcaagaaaccccctcctcctcatccagactctcggtgctggggagcgggggtgctcaaggggaagccatgtaaggctcccctgagacaactgggtttagagaggtggagactgttgattggttcagtgtggcattcagactacttagttcaaatgctgttcagaaaaacggatttttccagagttagaacgtctatccaaggacttactgggagacctgcagaattgctccttttcctgaggaatgaagcagcagtggcctgagaactcatttctctgtagccttgtttcctgggggttttttgaggctccagtttgggctcgtgtctctgtgacctggagtttggctaaccacactctcctggccttatccaagcccagttgttttccctcagctgcttcaaattccagctgggtcctgaggccaatcttgaccttgctttgtgtaggagcaaaggagcctgggttttcctgccttgggtcacagcagtgggaaaatacccaggctccattccaactgggaggaccctgtggccttgttgcaagcagcggccctgcccgcaaacaggaagctttctcctccacagagacccagttctgatgatggtcacataccccagcagttttcccctaacaggaaagttgtcagggctgttcaggcatttccttctctgccatctgccatccggactgaagagaaagtcttagtttcaattcctttcctgttcaggggaggaggacactctgattggaggctgctggaataaattctgactcactattgaagaattatctgagtttttcttctgagtccaaattcctgggtctgatggcccagtcagcaacctgaagaaaaatctatgaacttcattaaaactgggttccatgcttttaatggaaaacagagatggaagacgagacaaaaatgccatttcagtttgagcaatgcactttttgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagttttttttttttctgttggaattttagaaacaaggatccttcttgcggacggggtaagagtatgactgtaatcagagactctgggtgcagtttagggcagagcagtaatttcatctcttgctctccatgtttctctgtcttcccaggcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacaggtaaggtgcacctctgcctgggggaacagggaaggagtagggctgaggttagagaatcctgggtggagatggggcatcttagatccagagagaccacaggtgctggggagaaggacttggctggctttgggagcggtccccccgagatggaccaccctggccatcagagcatcttctagaacagcatgggagggtggagcaggataagctggtttctctttagatttagcaacccttgtttctaattctagaaatttccagcaaactccaacttatgaaaaagcaccaatctgacctgaaaaaggtaagtcctctgagatgatgggcctgagagggaatgccggggcaggggggctccctggagtaaggggggaagtcattatcttccccagttctacctaccatccttctctgagtcttctcctttctagtcttgaaccaaaaatggtggggtatgactgaattaagagacgtcagtctcaaatcccatttcaaaaattcctgaggtcaatgccctcaagcatctgttcactgttgagtcacacacagggggctggagcgggctgggctccacttttggcaagtgacaggctgtatcttctttgtcttcttttcaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggtcagttctgggggccagggtaaaggaaatgaggaagatagtgggtttctggggagttcagtggatgtcatggagcaggaggagaaatactagaaaaagcccttctgtgagcttacataaagatatgcatgtgtgcacacacagtaatcggtggaagattcaaaatattatgtagcaaactggggaggggacagtaatggtgccagcccacctactcggtgtggtagcagatgattcgtgtcatctattcattatgttttctgggatagttcagcttggggccaccagaacaggctgtttaatcagccacactgtatttgcaaccgtgttaaatgcccagtgggtgcccccttgctcaaaaggaggtatacggaaggagaatccccatttgccattctggatgagggaggacaaggctgaggtctgaatcttggcctctggcctgtcccctaccctggggaggtcatcccacccttcttggaactgcccgttttcctgcgggagctggctgccgagctgcggtggcatggtgtggtgcctctcctatgtcctttctcctctaggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatctgttatgtgactctgtcttagctgggtgtgtctgcatgcaagagtgacaccctccattagacctagctagactgtgcagtgatgtggtggggaggaccagccagggaagagggagcacctcagcagacacaggcaccagccaggatgctaaggacctttagccaagtctgccaactattctcctccatgaggagaggaaacatccatttccagtggtagaaaggcagacccgaatgtaccagggagcttccaaatggagggtggtatgttgggttcttaggagctgtacccttcatgaacacccttctgagaagaggagcatgctgatcactgctgcaaaatatgcaaaacaaagggaaggggcaatgtcctgtgcaccctttattatcaggccacccccctccccagccccccaggtcagagtagacacagtgaaggactatgtggggactgttgttctagagacctggcagccaactcagggagggggctggtttccaccctcaagattaagacagcagcctaattaaaaaaaaaatctgtaagcatgtacctccccccagcttccaaaacaacccccaccccacccctaccaggccataggaagttggggagggagtgctgaggagctccaggaaacactcccaagtgtgtcgacagtggcagaggcagttggggccaaacaaaggttgattcttccattcttatctccataaagccagacctttcccttcagcactcctccacccccatctccttcttgcttttctccaactcctctaatcataggttcttccctaggacagaggggaggcgaaatgatgaggttcagagtcttccctcaaaggcgatggctgccttgagggttggagcaaaggatgatgagcaaaagacgatggtaatcagtagggaagtccagcccacttgcatctagttgcacatcttgccttgagagtgatccagtgagggtctgtcccagctaggacatcaagtaggaggggtgggttcagggttcagattcctaggaaatatgggaggagaggaaaaggcaacttggatgcacctccagcttcaggcctagcaacctgcaatgcatctcaccctgagtttgctggaatgtgtatgtatgctttgggaggaagggctgtgtgtgtattgcggggtggggtggggcagctggttccctctgacagctggacagcttgccctgaagaatttgcctgctttctggaaaaatccaactttcccaccgtgggcctgagcgtcctggtacagcaatggcgccacctgctggccttattgaggtcctactgctcagcctcagctcaatcgcctccatgttgggcttctctccctggctgccccaccctctagtccaatttctcttgtacacaaagctcatataactatagaacgtcactgttgaagagaactttaaagatacatttaattaaactcccttatggtatagttaaagacaaactaaggctcagagaagggaggtggcttgcccaatcacccagaattccaaagtcctgaatctgtagttttcccttccatcatatcatcctactcttctgccgagtcctccgtgttactccagttggatgtcatgaagccagtgtggcagtgtgaagataggtttgggacttcacttctggagcatttcatcaacataagctatcctaggcctggccagccaagcaggtcctggaggagccccaggacaaagatcacaggaggccatgaggttcggcttcttcggcgcccacagtgagcccaggaaaattagctgtagggtattacactgttgactatggagagcatatctggaattatcttcagccagattttcatctgaatggataaatgggaataccatctaagtccagataaatagatcacttccatctcatcccttctaggtagattaatcccacacttcctcttcacacaaaaccagtaataggtcatcgattttgtgcaacaggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggtattttacatatggtggttacttttagaaaaataacagtggagagcacagcttcacttgaatgaagtggagaagcaggttgtatgccaagctgggagagattatcccacacaggggaaaggacaagtgcaaagccctatgatgaaaagctgccaagtgcagaaagcctcagatggcagggggcaagatggccatgaggttgtgtcagtgagtgggggtggggagaggcaggaggtcagactacatggggcctttttagttgtagattgggaagccactggagggttttgagcagagaagtcatatcatctgctttatgttttaaaaggatcatgctggctgctgagtagagaatagaggttgagggataagaaagtagaaggagaccgtagcaagaagaacgatcatggctgggagcaggtgatcatattggcagtgatgagatcaagcagaattcaaaaagtggtttcaaagtagaggtaacaggacttgctcagtctatttatttcttcaaataataatcatatttacaatgatagtagctaacagtttttgagtgcttactgtatgaaaattgagatatggtgccaatatttaaatagcatattttacttaacattcacagaaaccctgtgaagtaggttctattatctcagaaaaagaaactgaaactcagagaataacaagggactgtgttacgtgcacagtggcagaggcaaagatgaataggatgtgagtttatttgaaccccaaatgtttaaatcttggggataatacaacacacatttaaacaaagaagcaagaaaaaaaatgcacaacagaaagtgagaaataacacgaggaaagactaaatgaagtgctttgtatctagatgtgggcaggaccctttccagctgagaagatctgagactgggtcatgaacaggtggtttctgagtgggtcctgtaaaaatgaatacgattttgatgatagtaatgagtaaggacatttgagactgatagaagagtacatacaatatgtagtgatggggaaagataaggtactgtcaaaggacaatgtgttttctggtatgacagagaagtagaatgtgttaagggaagccgagtaccagaaagatccgggtgtcacagtttgtgtagggtgtttaaagctaaaccacagagtttaattttatccaatagaagaggagccacagaagagtttccatttattcattaatttattcatttattcaaaaaatatttgagtgcttattataagccaggtactatgccaggcacctgggataagacatagtcccttctgtcaagtctttacattgggtggatgtgggagggacagatgacagaacaatatgcattgagtgtaagtgctatggtataggaagctctgagtgggaggggcatggaagccgtggaagaccatggaaggcttcccaggagaagtgacgtctggactgatcctttggtcaagcaggagttaaagaggagaaaaggagagatatgggtgttcccgagagaggaagaagccttgtcccaggagcaaagtgagggtgattgttccagaaatgtgagtgattcttttaaggctcaagcaaagcatgtgattcttctttataccttctatttctttgctgagtgtttctgttcttttgtttcaagcatgctgcaattgctcattaaagcatgtttatgatggctgtctgttttaaaattcttgtcagatggtttcaacatctttatcatctcaatgttggcatctgttaatggttttttctcaatcaaattgagattttcctggttcttggtattaccagtgattttaattgcatctggaaatttgggatttatgttgaaagactggatcttattgaaagattctgtttagcacccctcctttgataccacactggtgggtccaggttccccattcagctgttgacaccttcagggcagagaggtggg

SEQ ID NO: 13280 - DNA, 139952 bp, Human
  misc_feature (1)...(139952): n = A,T,C or G
acttctttttcatattagtaagcactcagagctggcagctggcttaattttgacatattttatgtcaaaagaaatggtgggaggcaggtgcaatgaatgagctggggggtatgttttccttccttgaaggcgcatggaaagctcattctgctcaccctttgttattatgtattttttaaagcgccacttactagggagttgagtttcttaagctgaaggcggacctactgcttaactaggggtgttagaagttctcaggggcccctaggccaggcagtggggtgtgaatccttacctctgttcttcttcctggaaactggcaagagggtggagagagctcctcttggaccttgcctggaggtcagggacccctgcaaattgcccatgtgttgtgggaaggggtagaagggatgaggccccccctcttccattagctctcgttttccttatctgggaccgggaggtgggaggggctgtctggaggggccacattcctcctggcagctttggtctctggctgtgcctgcaggtttgagtgtaaaaccctctagcagccctgtgaggtggccccattagctctctcctgacagatgaggacagcagggatggtactgggcttccaggtaactgtgccatgtgcccttcactaccctgcttatggctggctcccttgctcctatttaaggggcctattctcctccctgcttcatggggacaaacagaagctgcttctccagtcatagcccctggctcccaccagcctggccatggtgacccacatccttgtttcgataaagaaacaagaagcatcccccaacccacaacctttgatcagaagccacttccagctgtgggacagctgcagggtggggtcaggagccccacacgcctatcctgggccacccatccacctgtccacacacatctgtacaccacacacatctgtacacccttggcgccagggacgccctcccccaacagtgtggggcccccttccttcacaggggcagtgaggtcactcctcagggtatggcttcatgagctcagcctctgtgtgagcactctctggcctcagtttcctcatctgtataatagacttaaagatagtctcgacctcatagggctgtggtgaggtttctatgagctcacatgtgcaacgcatttgggccgtgcttgtaatgccctgactctgttggcagtagggagggcagcgtctgctgcagggtccctacaccttctctgcaggactctgcacccagtaccagtgcccagtggggcagaggagtaagccttctggcagactctccctcctaaacccttctcggctgtgcccacttctcgcctgccctcctccctggcttcccttcctccagcttctccattctgcagcccaggaaacctagaaaagatcctaccagacttaactcataggccccacagtggaggccccgcagggtctggcccttgcttcccttaggctgcccctctctcgcgcacattctcctggacgctgcacatttagagtcctccagttgccccacggcctttgctcaagccctttcccttcttaaacaaaaatcgccacctctgccccgaccctagcctgggtcagtctccctcctctcctcccacgtggtttctttattcctatgtgttcttctcccgggtgggctggtacgccagatcggggactgaaccagaatcaagatgtcctctgcttcaggacctccctcccaccacgaaaaggctgcagatgctgcccgctaacccgacctactgtctgcagccggcagcccgctcatttatcctggccgagctcttgggcccccaatctccaggagccccgccccatcggggctccgcccttccccaggtaccgccccttcccgtcccgtggaatttggctctggaggaggtgggtcaaggactccatgccccgccccctgccccgcccttaccccgccccatgcattggcacccggaggggctcagctgacgccgcacttcacgtgacgccggtgccgggcgaacatggcggcggccaccgggtgagtgctgcgcctccctcgctctttcccgctggcgtggagaggggcatgggtgtcccggccggaccgcgggtgagagcgtcagccggggtcgctgaatgccgcgggtaggcgcctcttcccgttggcccggagtcccagcgccggtcggcgagctgcacgctccgagtcagggtcagcgcgggggccgcagctcctctccaccctcctggctggctccggccccacctgcccgcgtctggcggccccaccgtgtgcggctgcggtgggggctggggtcgacacgcatgttcgctgccaagacccccgggtaggagggcggcgttgcgaggaccccagggacccgggcgcttcccggaggaggcggtattcgagacggacttggaattcccttttcccagcagggcacttccccatttctttcaggggccaaatgtcaccccctcagggaatccttctctaaccatctatcccactttttgtgccctcatcatcacctgataaactatatagagcattgtttgtacttgttctttatcttctctgcatttagagtgcaagggcaggtatgttacctgcttctcagtagcccggtgccttgcacacagtaggtgctccatactgggctaaatgaaagaaagctgagtggtcgtagtgggaggaagggtggacagatgggttcaccagagcgttgggcggaatctcccagatagggagcatctgagcccagggtaagggacaaaggttgagagttcagagtgttctggggacaggggtgcatgcctggggctggttggaaggtgtggtgttccaggtggcggcttcagactttgccctgatgggctggaagggttttgttacaagctgcttgatctgttttttaaagattaggctcccctgagctatgtgtgagttcaatgggagaaggtgtgggtctggtggtacagtggggtagggggggcatggtgtaggagggagcagtattccagatgccaggttggaaactgaggtcagaatgggggatctagtggactgaatgcatctctctttttaagatacagggaaaatggcaacagaaagtgggttctaagttggcccccaaggttgagggagcttagagcatacaaatcaaatattttgtgggcacctgctatattccaggaatagcagtgggtcttcccttaaggtactcacaggccactggaacagatggacacatgggactctgtcatccatctgcttgccgtgtggtcttgccatttgcaaaggaggggcatggactctgagctcagataaagtgtgggaaggcttcactccctgggtgacttttgtgctagtccttcagcaatgagactcccttcaggtagagaacagtgcagacaaagtctcagatgggtgtcacggaactcagggtcagatccttgaatccagcctgtgacccttttaaagggtagactgagcaggctggtgcccagctgtgggtgtgctgtctctctggttaggctggctcggtgctcacagggagtgccaggggttgcatttgggttcaggattccaagctggcctgagacctgctgctctcctgaaggaaccaagctgatgtctggacgggagcaagtctggaactgactggatcctggaatgagagcttttctttttctctttctttttttttttttgagacgtagttttgctcttgttgcccagtctggagtgcaatggcatgatggctcactgcaacctccacctcccaggttcaagcgagtcttctgcctcagcctcctgagtagctggaattacaggcgtgtgccaccacactcagctaattttttgtatttttagtggagatggggtttcaccatgttggccagactggtctcgaactcctgacctcaggtgatccacccgcctccgcctcccaaagtgctaggattacaggtgtgagccaccacgcctggccccagaatgagagcttttctagcagaaccgattctctgggccaccacacagggtgggtgagggaggcaaaacagagtggcaggtcttagagaggtctgctattgagagggtgtgggagcttccagagcctggcagtctccttgggaagagccatcccagtctggtatggggctttcccatgtactttgagcctgaggttgaccccagtggcttcctttagagcagaatgattaagtgtgtttcccgcaaagctcagctcctagccacactcacagaacagatcatagagtcaggcataacgaggcatgatgccagcaagtcacggccattgccgtgggctcactgggagttgggtttggttgtctgtagaatcctaccagagcctgggacagagggggtccatgagagttccaggtgactggggtgtgccccatatgatttggggagtaggggaagccctaaactagcatctcagatttaatttgaaactcaagaatctactctgaatgcatctctctttttaagatgtggggtgtttcagggttgatcctactttctcttgctagcctgggtgtaggcttcaggttgagacagagtgcgctgaggtcacctcccatcccctcatggagaggggtccctatcccatggcacttggtggcactgctgctgtctccttaagcaatgctttgagctttccacagacaggattgataatttgaaatctgtcagctccagccagacctgtctgcatctgctctcccacatggctttttccattcccttcttcccttgcacactcacccaactagccctggaatgttcttgtcctctatatgattcttcacgtatttgcaggcccagctcagatggttccctttcccagaagcctttcccagccctcgggtaaaggtttagtgctcagaactccagaacactcagttttctccccagcagtacatttttacacgtctgcccattgtgggttaggagttgcttcccttcatgcctctcctagcatccttagaacccctggggttcttttgtatccgcagggccagtctgtggctgccctgtgattggtgcttggtgaaatgaatgaaaaggggatttactctaaattagtccagcatcccatcctgctttcctgggagactcccagtgattgagggaaggagtcatggtggggaatggggacagaattccgaggggtaggatgaagaaatagccttaattctttaactgagtggctcccaggagctgttgcagagccaaaaagaggcaaaggtgaactgccctgggcgtgtacccctgttgagccgtaggttacactggagtcagcattcttctggagagtcttctgcagaattcacattctgggtcaagagcccaaccccacaatgtgaaccttgtgctccaggagcagaagactcaggccgactgggggctagggacgggtgggcctatgggaggcaggctggccactgagtatccctgtgccttccctggctcttccccaggtcctgactccacacagctgtctcttggtttctgtgtatgcttggcacccctatccgccccaggagacagaggtgcaaggtggaggttgctggccagttgcctcgaggtcctgttccgccgtggcaaccctctccagcctggcgcttacggtctggtgcccagtgggctgcctgagcatctgtctggtgcctggccccacgctggaggctgaggggaggaggtggctggtccttggctggcctctcctactgggaacttagcggtgtgaccctgtctagaagtggctccacatttcattttttttttttttttgagagggagtctcacactggagtgcaatggcgcgatctcggctcactgcaacctccgcctcccgggttcaagtggttctcctgcctcagcctcccgagtagctgggattacaggtgcccactaccatgcctggctaatttttttgtatttttaatagggatggggtttcattatgttggccaggctggtctcaaactcctgacctcgtgacccacccacttcagcctccccaagtgctggtattacaggcgtgagccaccgcacctggccagtggctccacattctagtgcagagatctttccttgtctgtgcggtagaccccacgggcatcagtgaaacctacgtaccattctcggcatcaggtttttttttgttttttgttttttgttttttttgaaacggagtcttgctctttcacccaggctggagtgcggtggcttgatcttggctcactgcaacctccgcctcccagattcaagtgattttcctgcctcagcctcccgagtggctgggattataggtgtgtgccactatgcccagctaatttttgtatttttagtagacacaggggctcaccatgttggccaggtggtatcgaactcctgacctcaggtgatctgcccatgtcggcctcctaaaatgttgggattataggcatgagccaccacacctggctggcataatgtttttaaatgtatgaaataagtacataatattacaaaagtaaaacccaattatatggaaatacaggtatcaaaatgttacataaatttgagacagggtctcgccctgtcccccaggctggagtgtagtgttgcgatctcagctcactgtagtctccgcctccagtgctcaagcgttcctcctgccttagcctcccgggtagctgggaccacatgcacaagccaccattcctgactaatttttgtgttttcggtagagatggggttttgccatgttgcccattctggtctcgaattcctgcctcccgcagtgctgggatgataggcatgagccactgcgcctggcccaactactttaactttgaagttgtggggagcaaaagtgatattttgagatactggaagagcaataacatggtattaaaatacctttgatttttgttggtgacagattaacatgcattgctgacactgagtagtttgttgcttatgttaataactgaagaaaatgtaaattcgaattggaggttagagaaaataaaggtatagctttttcccatctagtagatggagcccctgaatttgaggatgaatccttgggggtccctaggccttaggtaagagccctgcacgtggctgttgaggagagggtgtcccagtactgatacgggggtgtgggttgtgtggagacagagacggcttgtgggggcagtggcatcataccctccttgaggactggcctcagtcttggtcactccgttcttggtcctgggctgcttactgggtcttggttgtttccagggcagcgggggtcctggcctctggggctcagagacttgttctgtgggtctctgaggccctggagctcttgtgccttgtctgtctgcagcaaagcatggcttatttaccctgggacctggggatgataatggcttttgccttttaaattctgggtgccagttaacaaaagctgcagcagaaacctgttagagatgttttgttggtgctacatttgccgaatttgcaggaagaattcgtctgtgttgactctgagcctgacagtctctctgggggcttggtttatgccatgggaaatcaaagggcatgtctctataaaactttattacttggtgtcctgtaattaatgactgtagcatattgccttgcctcgtggctcaggctagcccttcttatgctcagagccctgcacagggtgggttctgttctggcggagccccatggagaaataagcatggttgtagattttctttgcagtggcagctgagtgttcaaggagaaggtggcttatcaagttttctgctcagcccttgggatcccagtctgggtgccctgagaaatttgtctctcagaaggttctgaacaaggggaaggccagcccttctgtgagcattacaggtgggggcatggtgtcaggccatggggagccagcacctgttatgattaaggagtgtggccaggcagggagaggggagtgtgggagaggtgggctgggctgggctatgcaggctggtggctgaggatgggcattttcggccggtcatgctattcgacgactgtggctgaggctgtccatagcagggtctcggtgtcattgcccctaagctgttggggattctgcagagacgagttttgcctctgtgcccatcccaccatgggctttcctgagtgaagggaaagggcgtgggaggccatgggggatatccgagcacaaggtgctggtgactgcacttttagctcctgacagcatggccatctgggatgtggtcatgtttacgaactctcaccgacttccctctgccctttcatcccaatggctgagcgtggcagaaaagcagccccagcccagaggaagctctggccgctggtgtccacccagccacctgctcaccctcctgggagggtaggaagggcacgtgggggagcgggcggggctctagtcatgtcagcatgtgcggctgcttctgaccctccacccttcctgggcaggctgggactccagggctgcttcctgccctgctgcggctgatgtggcatcttctcatcccacagctgtgtgtgtggccccgtgtgtcattcagcagatatgtgttgagcgtttgctgtgtgtcaggcaaggcaccaggcgagggcacggcagtgaccgaggcaacctggagctccatctcccagtgtttccacccgaggcggcgggccggagaacaccaggaagcaccaggcagcacccgctgcgtttaggttggaaggtgctgtgtgctaagtgttgtgttagccagggacctggccccacgttaggagtttactccagggggccactaaggagagttgagagaggggacgatacacagagctgtgcgaacgttaagggaaggcaggcacatgaggctaggggcaggaggagagggaggaagacagtggaaagaagagtggggaacctggtcagaaacccagcaggggctgtgctgtggggcagggcgctgtcatcagagcagcggccctggatggaggggtgcccccagccatttagttccagggtccccagggagggagccaggggagtggatccactgtcttcctccctctcctcctgaccccagcctcatgtgcctgtcgttggctcagtgcgcctggagacaggaggcagcgtgcatgctgaggaggtcgggtaggttggcctctgggcacagtgcaggggggtgtatctggagggcaagtggggaaacctcaggccagggactagtaggggattgggcaaggagaagagctgcaggttcaaagagggaggccggggaagaccatccggaaaaggtcgtattggagccaagatgtgcaggaggtgtgacctgctcatgtgaccctggcaggagggtcagggcctctgagggtcccatgtgaggtgagtgtgaggtgccccagaccacttcaccgtgctgtgctgtgagggcaggtttcatccacagcttcactgcagtccccaggcagagctctctgctcgcaccagctctgggatgtccctgcctccttgacctccgtgcccacccactgccccctggctggagagccgcaggggctccctcctgcacaccctgcccctgcttactcctcctccacctcatccccattatctctccacacccggcctccagcctgcttgctgggaccaccatccgtttattcattcattccatagataccgacacctgctctgtccctgccctcagggagcttacatgttacctggagggccagcaaacaaataaatgaagagtgatgggggctctagagagacacgaagagagctgggggatggggtgggtaggaaaggggcatttctgcagaggctggggtgggtaggaaaggggcatttctgcagaggctggggtgggtaggaaaggggcatttctgcagaggctgggtaaaagggcatgggatgcccttgggaagagcattccccacagggcgccgcagcggcaaaggctggagtgttctgggggtttagggaagagcgaggatgcccgtgccacagtagaggaagccaagggtgaactgggggtctggatcccttgtggctggggagtgaagtctgcactcagagaagccagctggcacggggttgggcagggagtgtgtgctgggattggcattttgaaagggcccttctggcagaaggtgcagaccaggccacggggaagttgcggccaagagcaccgttgagagttgcctgcagttgtccagacgggacatggggaggtggccctggggatggggatgtgcaatgagggtagaccttgctggtggccaggaggtgggatgagataggaggccaggatggcctttgggactgtccaggtgcaggtgctttgtgtcgggggaggctggggaggagcgactttggttcaggtgcatcttctgcctgctgagggtggctgatgggtctgtgagtctggagctggacatcatcagtctgcagatgcagatggtcctttgagctgaaggactgggtaagctcagctgagctgagggagggagccagttagggaagaggccccagggttgggccaagctggcctctagcagggaggttgagccgggagccaggggcctgcctggtagggagcctggaccggctgctgttggagaaggtttccgcagagagagtggcccccagggtcatgggcaccaagtggccagtgaggactggggacctgctgcagattcgggagcgtggggtcactgtggcctgctgggcagttggttggggggcagaggagcaggggggtggagtcaggacagcatgggtggtggaggggagacaagcccctgtggtcctcagggggatcagtgaggggctgtttctgggtcataagtaggtggagcttgggcagcttgccccgtgctgatgggggtcccacggcaggctcgggcctccggtcaccccgacctcaggtgtgggcatgcttggagatgctaacagaggcctgtgtggcggtgtgtgctcttgcctctgcagaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggtgagcctccccgcttggccacaagtgagcaggtgtgtgatggtgctgctgtcctgagcaggagttggaggccccagcttggccagtgctgccccttgtggccctccctgagcctctgtttcctcgcctgggaagtggtccaggggctccttgaagatgtagaacttgaagatgtggggcagcgggtggcccagctgcaggaaaccagcctggccatggtggccatggctgagagtcactggcggcactcagtccccaggcacaggaacatgaggacacccacccaggaagactgtgaggctctgagctgggcccactttcacacatcttagcattatacccattttgcagatgagaaaactgaggctcagaggggaaatgacttgccaagaggtggagctgggattagaactttgtcttccaactctaaatctagtgctgttttctccccgctgccatgcccagagctggagcctgaccacagcaggaacttcagaacctctctggggcaggcagagcctagggaatgtgtccatgcagcatcctggcaagaggagagatgggaatgcgaaggggagctgagtgtggagaggatatgggaaggcgtggcttccctagctggaccctgtcgccccagcaggccacagatgggctgagacccattgctgagcgaccgcagactgtgttttttctttactaaaagcacctcctgcctgaagggtcccgtctctccactccattgttcgcgcagctgcaagcctgcaatcccatggctgtgagaaacatggaggtctaaataagttttctctggctagtcttgatgcttctccaggtttaaatactctgcggcttaaaaaccgatttcctaaattcagctgttggctccctttctgatggtatgcaaggctaattttggaagagatcctcctccaccatacctttatgacgtccttttagcgcagcattcatccctaaacactgaagtcatcagccgtcccgggggtgggagagggaagtaagaagtcttaaatggaggaatccatttctgtgcagatatccggcctgggcgtcagaatccggggggcgtcttgcctgcctgcacgtggcagagaggcagggttgagctggacgtgtggtgctgctggacgccctgttgtgggcccgggggtggggatacaggtggactcaggcacatgcctgacacagcatcagggagggctcccagcagggtagaggagctgccaggctgccccctgccaaactacgggaggatgagctggggagtcgagtgctgaggggaagggatgtctggggctggggtcagttacaggaggctgtcggtctgagctggctctctagggtgctgtgatgcagccaccggtccctccttgcacctcatgttccactggctaacaatagttcttgttcccgccacaggagtccttctttcactgggcgttcggtgtcactgagccaggctgctatggtgtcatcgatgttgacactgggaagtcgaccctgtttgtgcccaggcttcctgccagccatgccacctggatgggaaagtaaggagcagcctggccagggcaccatggctaccaaccatgggctgggggtgggtaggggaggtgggatgagagagctgggttgggcctggggacggggaggagggaagagctgcaggaggaagggcatgcggtcagggctgtcacagcctgcctctcgccagagccctgcacccttggctgggaagggatgttagagctggagtatgactgtgtggtaggagttattgagaaattgttttaggtagatagagaggaaaaggggtccttgggaagttttctggtaaagccccagctcctagagccaggccggcaacctttgatatgcaaatgcaggccattagaaactgggtccacccaacatggcaattcccaaggccttcttacccttgcctcacatgttcctggcaacatggccgccccacatgtgtagaacatccccaaatatccccacatgtgtagaacatccatggctccctgcatttgcatattaaaagactagggtgggagagccagctttttagtgggctatgtgaataacatgcgtggtcaaaccaatcccctgagccctatgtaaatcagacatcgccccttccagcctctgcatatatacttggctggtgtccactgcacttggggacctcctcttttggctttggagcccccctccctctgtctccatatggaggagcttcttccttctgtcttctcccttccttcttgcctattaaactctccgctccttaaaaccactccacgtgtgtccatgtcgttttctctaattcaactcgagaccaagaaccctggtgttcctccactcatcagagccctgtcaactgggggccttgtttgtttagaagtgcagtttgttaatcctgaaattctagcttctccgtctgtgaaaatgcctgagggtttggccctgcgaggccgtcactcctgcatggcatcgacaggtgtggcatggccctgtgcgtgcctgagggtggtgggttgggtttggatcggggaaccgcctctctgaggcccatcgctgatatgctgggtgtgttatttgctgccttcctctggacgcagcgcaggtcctgccctcccggctcacctgtgagatagagcagaggctcgggctgctgggcaccctcctccaccctccatggtgcctgctgttccaggtactccccaccgccgaggagctgttctgcctgctcggtggtgccagggcggacactgtacttaaccagggaggtttgaggtgatcagaggatcccgctaaatgctggctgcctcactgcgtgtcatctccgcctggagagtgattattctgggctaatgtataaattgcagcctttgctgcctggtgccccagaatgctcattaccaggtgggctgcagaggctgtggctggtttgagtgacaaggcccctggctgccacagggactgggctctctgctgaggactggggccacagtggagcttcccctgcttccagtgctaccctcccttcagtgcagactccgtttctgccttcgttggccatggtgtgtgctgctcctgctgtctcagggagaggggttcaggcttacaagttggtaatcattctgctcttaggccacttggcaggatcccagcctggcaagactgggatctttgctgggcaggactcagcctggagcacaattggcagcagaagaaaaggggactgtttctcctgggggtggtctcctggctcggcccctgggaagaagggcacggagtggacacacccgggccaactgcctttggggcttctgccgggctgcccctcggaggccctggcctgacaatgccttcccatcctgtcgtgatctttattgtcgacctttatcccattcccggtggaatccttatgactgccctgttacaaaagaggagatggctcagcgtgctggtgtgacctgtgcaggtcctgcagccaggtcttgctggagctgcaattggaggctgagcttgcctgctggctaagtgtggcttctgagaggccgtggggcttgcaagtgggtctggtcatgtttggggctccagttccttctctgtgatgctgctctggaggccccccaggactggagttacagtgctggccactgtatctctgacactgacatgaggcagggatggttccaggaggcagattgtcttgtccaaaaatggccacagcagtgtttctggacactcgctgtctgcaggtgacatctatttcccttctgcctgtcccaggtctgggcctcatgacggatgtggcagtgttgctgtgtgacgtctgaggctagactgtaaactgcactgtggcttccacctggttctctcccatggggtacttgccctgggaacccagccgccacatcatgaggaagcgcagactccccatagggggaccccagccgccagcagcaccagccgccagcgtgcatgaggcccagccttccatctgctgaggtcctagatgtggagcagagctttgctgtcctctcggggctcggtccaaattcccgaccttcagagtccatgaacatgattggtggttttgcactccactaagtgttggagtcgtttattccccagccgttgtaactgggacagcagtgacgaagagtttaggtctgctttctgcaggaggattctcccagcatcccctctctacccagagcagagttgtggcctcagcctttcttgcaaggggcacgactcaggacgagcgagggcccctgtgccagggtacccttggctccgggtgacacctgcagttttgacctggctgccctctcgcctcctcatggccctcactgctggctcagagcctgttgacatgtcccactgctcagagaagtagctcagcagtcaggtcggatgcctcctctgtgagatgtggggatggacagagaaggagaaacagcttcagggagggtctgatcaggggctaaacagggccccacctggggtttccaggggtttccaacaggggtctcccctgttggaaaaggctgtgtacatgctgggcaggtcagatcaggcagccttggtcccgagggggcatctggccccatagctgagaggtagagccttgtgtcctgctgtcctggctccctaccacagccaccccgagcaggcctctccgttccactgtcctggagtgaccctgtctgagtctccacatcctgagccctcaggagagaaggctcagttgtaacagagcagtggtggcggggttgactatgtgggactggagctggggagtggccagatctgattgcgtatggctgcttccagccgctcctggaatcaatagggcaccaggagcgaggctgacgggagtacctggcctttgcaagcaaaacccaccagacttcacatttgaccttcagctcctcagcttccttttgagtccctatctgatggtttttgaaaatccatctggcagatactgcaatccaaagtcgcccagggaaacgacacccccgtctgcaggatctgccgcttcctgtggaaacggtcttgctgttgtcagggttgcagacgccaggggccgtgggcagcctgaagccggcccactcctcaccccaggcctgttctgggatggggagggtggtagctctgaatgcatttttattcagagtctctgctaacaatagtgtgtggtgtctttttgatgtgagagcatttcccatcatttttcatcggagttgggcttagtggagggtggctttggctgtgggcctctgtgagtcagcgccccaggcagcttcggagcccagagttggggagccagtttgaccaggtcgggggaccctcctggaacctttgtaacgcattccgtccccggctctgggtatgcagggaggggcgctcagccttcccagggccatacccacatcttgtgtgagagatggatgcgggtatggtgggagggtttgcacatgcatggtgtatgtgtggggggctgtgtgtgcatatggagtgcacacctgtgtgtggtgtggtgcatgtggaggggtgggtacgtatggatgtgatgtggagaggacatatgttgggggtgtgtgatgcatgtagagtatgttgtgtggggggggcatgtgctgtgtttgtggtgtgtagggtgtttgtgatgggggtgtgtggtgtgtagggtgtttatgaggaggggtgaatgtgggtgtgcgtgtgctgtgttttgtgtgtgtggtgtgtagggtgtttgtgatggggtgtgtgtgtggtgtgtaggttttttgtgatgggtgtgtgtgtggtgtgtggtatgtaggttgtgatgggagtgtgtgtgtgctgtgttgtgtgtgggtgtgtgaggtgtgtagggtgcatgtgagggagtgtgtgtgggcatgtgtgtgctgtgttgtgagtgggcatgtgtggtgtgtagggtgtttgtgatgggagtgtgtgtggtgtgtaggttgtgatggaagtgtgtgtgtgctgtgtgtgtggtgtgtagggtgcatgtgagggtgtgtatgggtgtgtgtgggtgtgtgttgtgtagggtgtttgtgatggggtgtggtgggtgtgcagtgtgttgtgtgtgggtgtgtgtagtgtgtagggtgtgatgagggtgtgtgtgtgagtggtgtgtaaggtgtttgtgatggggtgtggtgggtgtgagtgtgctgtgttgtgtgtgggtgtgtgtgtagtgtgtagggtgtgatgagagtgggtgtgtgagtagtgtgtagggtttttgtgatggggtgtagtgggtgtgagtgtgctgtcttgtgtgtgggtgtgtgtgtagtgtgtagggtgtttgtgatgagagtgtgtgggtgtgtgagtgttgtgtagggtgtggtgggtgtgaatgtgctgtgttgtgtgtggatgtgtgtgtagggtgtaatgagggtgtgtgtgggtgtctgaggggtgtgtaaggtgtttgcgatgggggtgtggtgggtgggagtgtgcctgtgttgtgtgtgtagtgtgtagggtatgatgagggtgtgtgagtgatgtgtaaggtgtttgtgatggggtgtgggtgtgagtgtggtgtattgggtgtgtgtgtagtgtgtagggtgtttgtgatgagggtatgtgtgggtgtgtaagtagtgtgtagggtgtttgtgatggggtgtggtgggtgtgagtatgctgtgttgtgtgtgggtgtgtgtagtgtgtagggtgtttgtgatgagggtgtatgtgggtgtgtgggtgtgtgagtaaataatgtgtagggtgtttgtgatggggtgtggtgggtgtgagtgtgccgtgttgtgtgcaggtgtgtgtgttgtgtagggtgtttgtgatgagggtgtgttgtgtgttgtgtgttgtgtgtttttcccagctctgccccactaagtgtccccaggatcgaggcttccccagcctctctggtgcctccctcccacgctccttgtgattggcagggtgtcgggggccctctttgccgtgcaggcctctgagaaggggctgaggagctccttcggctgctgcccgggtggtttgaggcactgaccctgggcaggcctggtcactggacctggtctccagcctcccgggcagcgctgttccctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgtggagagcagagtgagagtcggcgaggcagcattgtttgtagctgaaggcaggccgggccgcgggaaatggatggtgatggctgtaatttggccctgttacttattcattaatcgcatgcaggtggtcagccagccagcaagacctgctttttgaaatttcattttctagagggctcctcgtgtctgcactgtgtggcattaatttaatgtctccttcccacccgtggcccccacagttgctggcagtcactgcagagtgtgcagtcatgggctttgactccggggactgggaaaggcctctctcatccatgccagggcccaactggggtccctggatgctgacccctgtggaggacgagagcccctttgggtaggaggacttctcctctctcctcccaaagctatccttggcatttgaggggagtgtgtgtggggtgacagcagcttctctgctgacccatcctccccagtccagtaatttctttttcttttttttttttgagacagagttttgatctcatcacccaggctggagtacaatggcacgatctcggctcactgcaacctccacctccctagctcaagcgattctcttgcctcagcctcctgagtagctgggattacagccaccacacccagctaatttttttgtatttttagtagagatagggttttaccatgttggccaggctggtcttgaactcctgacctcaggtgatctgcccaccttggccttccaaagtgctgggattacaggcgtgagccacggtgcccggcctccagtctggttgtttccatccagacttcccatgcgatggggcctgacatgaagtaccgttgctggaccccagactccccacagggcagggtgcaggccctccctctgagtggctgcctcctgccctggccagcctggcctcagggagtccagagcccctcaggggcctctccagccagctttgcagggcttgtgtggccacacctcttcttttctcatcaaccccaccaaatcatggctgccaagccttcggtggctggtttgacgtgggagtctggcacgcatatcccttaggatgacgtttaaatggtttttactataattagcccccaaacatgaaaaataagtactatctaaacttaattatctctgccctttaaaagagaatgcaatgcacagttgccagaaaagctgcttgcagcttttcaggttgtatctgtcgaatggctcttctgttgagaaccagacctctggcttgggaggcgctttttggcaggaggggcgggaatgcatttcctggtggcttccctccgcacagttggggtgagttgggaggtttcaggcccataacgggagtggaagtgacaaggtcaggtgccacactgatggctgagatgcccctctgtagggcgctggcctcaaaatcagatcctttgtacttccccactctgccgtgaggttgccttccactcctgtcacagctggaggcaatgaagggagggggctagaggcagagctgggaacaactgagggacgcagggtgtttgttatggagccagaaagtccgagttgatgtgttgatcccagccacgcatttcgctgatggccctgccttttgtatttctgacacctgcttttgtgccgggctgtggggtcaactcggtgctgagagtgtggttgctcagtagcaaagggtctgtaggcttcccttgagccagctgcacaataagccctgcgtctggggcctccgaagtccaggcgaggcgctcgtcatcaattcgtgccccataactgctcgaggccgtgctaatggaggtgtcagaccttggccatttaacttttgagtcctgtctcaaatgcacaagtgaatgtgactgaatcatgcaaatttaattaacagcaggagcttgataccccgtgatcatttcagagaagccaaaagggagagaaagcaaagggcattgtgggctgcactgagcagtccattgattacggtgagaccagcgtctcccgggccctcagtgctccttgttgttgctccctgcagccgtccctgggccctgtggccagtacttcctggtttgggtggggagggaagtggtggaggactcagagagaggagcagattctgtttcctgcaggtgatgctggtccttagtgtcacaaaggctgagaatggcacataggacaccagttcaggagctcactcgtgaagttcatcacctccaagtcccaaggttctctccctccaccgtgttccgtggggttctccaggcacattatccttggcacccacaacacccccccccgccccccagttatccgtagagggtcttgactgcaagttgtccaggttgttgccattttgaacaaagaattggacaaaacacacaaaggaaagaatgaagcaacgaaagaatgaaagcagagatttattgaaaatgaaagtgcactccacagtgtgggagccggctgagcagagtctcaaggcctagtgacagaatcttctcaggtccagatacccccaggaggtttcccattggccacttggtgctcgcctggtgtaaatgaagtggtggcctgccatcagtctgattggttgtggaaagcaacctttgtaacttcacttctgcaaccaatcagaggctaaagtgaagttacaaagttgcgtttctttgcaaaccaagactctacttgcaatcagaggtactttcaatttcccatctgcctcaaaaaaaagggggggtttgcaaagggagcagcctctggtcctttgttacttaggtgtggaaagttagggttttcctttcaatttagttctaggaagtcagcatgaaaaagccctaacgcctcccgaccctattctcctgcctcaccaccaccccttgacagcccaggaaacaccatccagaaaccatctgctgtttttttgtctgaggcctatttgggacccagcacctggtgactgtaacactgtgaggtcacagacagctggagggctggagcacggctggggatagagcccgtgtgatgaggtggggcccaggtgtgggatgacataggaccgagtatgtgtgcgtcattggacttggctctcagtgtctcccctgtgcagtttgtgttcctttccccttgcgtaagctctgtcactaacagagacattgacttatctcctgaccaagagcctgggggtggtggcttgctggacccaggctggaggtctgcctagcacagctgtgaccaaagggcccatcaggaggtggacgagggctgcccaacctcatccattctgtgtcttctcactggcagatttttcaggggtaatgaataagcttgagtttttctcatcacattgagtaatactgatactgactttctaaaaatgctaatttttggctgggcacagtgcctaatgcctataatcccagcacttcgggaggctgaggcaggaagattgcttgagaccaggagtttgaggctgcagtgagctatgattgtgccacagcactccagcctgggtgacagaacgagatgctgtctctagaacataaaataaaatagtaataataataattattattatttgagatggagtctcgctctgtcactcaggctggagtgcagtggcaccatcttgactccctgcaacctccgcctcctgggttcaagtgactctcctgcctcagcctcccgagtaggtgggagtacaggcacccgccaccgcgccctaattttttgtatttttagtagagatggggtttcaccgtgttagccaggatggtctggatctcctgaccttgtgatctgtctgccttggcctcccaaagtgctgggattctgcggctgaccttaaaataaactttcctttaaagatgctccatgaagacctggcaggcagattgttttatgccacagagggacgggtgcactggctggctgccctggtggactgtctctggcagtggaggggatgataggggttttgtctgcaggggctggctgcaggtggctagggtcacggaggagcggggcttgctgaggaaagcagctgtggttcagccgtcactccatggcctaatggcctttgccctccaagtgtgtgttgggccgacctgttcggtgccgggtgctgggtgctgggtgctgaccgtgatagggatgggactggggctccatggcctgggcttggcaggcaggaaggtggccatgctgagccattaccaagccctgaccctgatattccttgtgcttttctttgaggatccattccaaggagcacttcaaggagaagtatgccgtggacgacgtccagtacgtagatgaggtgggtagccggctcctcctctgagcagcccagggcttccagcatgccttccactcctggagttcctctccttccactgccacaaccttgctggatgtcagggacactaccacctggccaccagtccctgcgccgcaggtgctcccatttggaaggagtaggcagcaacccatgcctcaggcttctctacggagccattgctttgcctgggaaggcccctgactctgtgggtagaagtgtctggtgacctgggttgtggccgctgagattacatgaggtgtctctgagaggcgggcctgcctgcagcggtggcacacggtctaagtcaccacaaggctgggccggggtcttcgtgtgtctcgagccctggttgactgcagatgccactgtcagaaaagcccgaggctgtgaaaggcttgtagagtagcattggaggtcccctgacttcaatccacttctcagtggggttgtccagcaggtgtcgtgtggcctgggtaggcatgtggctgtcctcttggggttttgaatctgtgccaaccaagttcaggcaggtcaaaggggctgccctgactcctcgactccagctctccttcctgccagtggggcagggctgggacagaggcgagagcacagctgggagcccctgtggtctacttgaccaaaggccctgacactaaaccactgcctggcacacaggaggcctctgtgctctggccctgggcgctgtcacaaccccacgtcctgtgcaggtcagtgccgtgtagaatgtgaagcacccagaagtcaatgcctgccactgggagtccaacctggacctggcagcatcagctttggacagggccatcctgtagccacatttccccagacagagattatgtgtcggccatgctaagagccggggctgcagtgtggaagtggccaggggagccagttctggcggccaagcagcttcccccttcccctgggcaggacacagcctggttgaagatgacggcactgggtgagaagcaggttcccagggatcatggccagacacagtgctgtgagagaccagttgtctctgcccagcatgtgggggcccagcccggcccatccagctcgggggtggccagccctctttgactgcaggtgggccagtaccatgtgcccagccctgcccccggtactgctgtcctggaatatgttttccatttctctgtctttctcctatccatcttttgaggccttgcaccagccttgtagcagccactgtatctgctgtagactctggcccacactggtgccccttccctgagccctcaggaccaagttgtggacaccatggacgctgactgtgttctgatgtgcaccctgcccttgactgtcttgtatttgtcttgaacgtccagttctttttccccagacattcctcttgcactctttccctgcccagtcccagggacatgtagggcatcagaggtggccgagacccagggctgacctcaacagcccagggcacagtccagtgcaggaggtgaccacatgagtgaacagtcaccgcagggtggtggtgcctgggcagagatccctggaagagcctctgtgaagggcactgcccacctctacagggccacgggggcctgtctctacagcatcttctgcctggttggactgtggagagaggaggcttttgatggatctttatgttatgttatttcaatcccaagcttttgggggtgactcttaacatctgaagattctgtcaatacacatgtgacctatcatattgatcccgttgagtacaggatctaaaatagacggaacgtttatttgcatgctcccaatgagaccatctgccacttgccttgtatgtctcagaagtggagcaggaggcacctactccttcattctcgttttccttccgaccctctccttggcagatgtgttccctgccccagaaactgtttcttaacactgttgtcctttgaaaccttgacccttcaggtctcttcgatgtgaaacctggaggggcagcctggggtgggccctgtctcaaggaccctggcgggatgggcacctgcctccaggaccctgtctcagggatcctggtggaacgggcacctgactccaggatcctgtctcaaggactctggcggcatgggcacctgcctccaggaccctgtctcgaggaccctggtgggatgggcacctgcctccaggaccctgtctcaaggactgtggcgggatgggcacctgtctccaggaccctgtctcaaggatcctggtggaatgggcacctgcctccaggactctgtctcaaggaccctggcaggatgggcacctgcctccaggaccctgtctcaaggaccgtggtgggaccggcacctgcctctgccctggactcagctgctgagtccgagccacctctggaccacagcctccccagccactgtctgacatttttgtctttataactgggggaaaattcagctccgtgtctactgtgatttctgggggtgaggaaggagaactggtctctaagcaaagtaagagacaggccaccttgagtgttagggcagggaagttgttaatggttgcacagaatgacagcacagagaccggctcattcttcgtcttcgtatacaaagcagattgtcgaggcttcagtagagttcaaaggctagaatctctttagggttcgggagcaccccaccgcaccccgtcaacgccactgccattgcagattggtgttgatgttactgttactgctgctgtttttactgggaacaaggctcacgttgacagcagagcaagcgcttcatgctggggcggcccacgtgggctccagtaacactagagctctcttggagccccttggccctcccgctgcgggagggacacagcggggcagggactgtgctgggccgtagcccccaccccgttcatagatatgaggctgaggctcagagagaaaggcctcgtccacagtcccacagctggaggggagtggtactgggatgtgacgccaggggcctcccctccaggcctccctttcccctcagaaaggagggctgctgtaggacactcctgtggaggcgacatggactccctgtgcctttgattttctgtggctctgaagggagcctgccaaaaagtgtgacttgctggactgaaccccctgagctgggaggtatcccaggttgcttgaggtacccagggcctgttgcatcatgggaggttacaggaagccctttatgcagggaaggggtccccaggctggttctgcagtgctcagccccatctcacttggggtggccttagctgtcagtgacaaatcacagccaacgcttgtctcctctgaaaaaaggcaggaaggcctccagtgccatggctggtcacgtgatagcatgtatgccatgcaggtgtctgatggggcacagctggctccgaggttccctcctccccacagaggatcctgagtttattgagaaggcagttcccctgagaaggaggcattcagcagaaccttgagtggggccccgaggctctgccgtgaaggccctgtgcaaaggctggcgggatcaccggctgagagctggcaggtgaagcgtgcgttccatgcacttgcttccctttatggcgccaggcatatgtgagaaggtccgagggtcaccaagtctgctacaggcaggacagatgtaagaggacaaccgcagcagcacagggacaggcatcggaagcgatggggtcagcaggggccactgtgctgtgggaccacgagcccatggctccaggaacctgattgttcaggagtagccacacatccagactgttggtgatgtttcctgatgtttacatttgagaaacaaatttgaaattgtaaaagcagtgcaggccaccagcgtgcaatactgttggaggagaatgccacgaaagaaggtttattttcaaaagcttcagtgattgcagggcagagccagctctctggagccttgcaggctttcccagcgctggcaaaggcatatccagcttttttgtccagcttatcaccctgcgaaaagcggccctcgggcctggtctgggccctggttaggaaagtgcaggaggtgtccgtgggaagcctctgattgtccccaggggaggatgtacacccacagggctctgatgaattctgcccgtgaccatccagctccatctgccagagaggccgggggctgccggagaaatcgatgctggctctggcatgaagcaaggcagggtcatttaacagcgcagggtgagagaggtccccagtggccaccactccgtggaaacgaggccctgagttgacagagccgtgctgtcttgtgtgctggggatacatcgggagccagcaacgcacagcgcgtcgtgttcccttaatatttgaggcacggagtcagggtgtgctgatgagagcgtagcactaatgggtctccatggggaagggcgggtggagctgccaggtcgggagaggtttttgcagccgcagaagtaaccagggcccactcaagcagttgtgatcaataaaagatgttgccctgccaggactaggagatgcacagcctgctctcagagtcaggcctggattgtctgagcaccgggctgcaaggagacggctgctctcccctcctccattattcctaaccagcatgtcctgagagtcgtcgcccggagaaaaaccatcagcccacacatttgttatcctgctcctccctcccaagacgatagcagatacaatccccaagtgcctcctggctttctgattcagctgctgtaattgacgggctccttctgtgcagctgaatgcagaacattcacatcaacgtaacaacacacctagggccggcatgtgtacccctgttccttttaataagtctccccttccttcaggaggggctgagggtgtgtagggacacagctgaaccttttgggtgtttttttttgttttttgtttttgatactgagttgcattcttgccccccaggctggggtgcagtggcgcagtcacgactcactgaaacctctgcctcccaggttcaagcggttctcctacctcagcctcccgagtagctgggattacagtcaccaagcccggctaatttttttgtatttttaatagagacggggtttcatcatgttggccaggctggtcttgaactcctgacctcaagtgatccacccgcctcagccttcccaaagtgctgggattacaggcatgagccaccacacccagctgagccttttgtttttttgcaacactgaggccaaaggacacagccattctccaagcagtcactcagtaacatgagggaggatcccgggagattgttgatacatgtctggaggatcattgggccaggagcatggtaaaccttgacaaagtctgtggcttttgacccaacagttttaaaggcatttaatttttttttttttttttgagacagagtctcgctctgtcacccaacaggctggagtgcaatggcatgatctcggctcactgcagctgccgcctcctgggttcaagcgattcttctgcctcagcctcctgagtagctgggactacaggcacgtgccaccacacccggctaatttttagtagagatgggggtttcaccatttggccaggctggtctcgaactcctgacctcgcgatccacctgcctcagcttccaaaagtgctgcgattacaagcatgatccactgtggctggctggcatttaattttaaggaaatacttgtatgcgaggatgttcatcacagcgttatttataattgctaattattagatgtaattttttttttgagacggagtcttgctctgttgcccaggctggagtgcagtggcgcagtcttggctcactgcaagctccgcctcctgggttcatgccattctcctgcctcagcctcctgagtagctgggactacaggcacccgccaccacatccagctaattttttttgtatttttaatagagatggggtttcactgttttagccaggatggtctcgatctcctgacctcgtgatctgcctgccctgtcctcccaaagtgtattagatgtaatttaagtgtccgtagaggaatgagtagtgtccattaagagagtattctacagccataggttcaaatctgggctgcgctgttattttttaaccagactcaggcaagttctctaatctgtaagccattctcatttgcgaaacctgcatgtttgccgcactgtctccccgtgtggttaaatgagatgctgtgtgtaagatgactggcacaggccgtcttcagcgacctactggacgtttactgtccccagcggtagtgactgctaaaaattgcatgtttgaagaacatataatgacaggaaataagtgaagcatgtaatttcatatgatccaaatgtcattacagatctctgtttttatgagcaaagctaaaatgtctctggagataggattgtacgtgcattttatctttttatagttttcaatacgttccaggttttcttgggaggcatctcagtattaaaaaaggtatatgtatacatatgtcaaaacttatcaaaatgtctatgttaaatacaggcagcatagagtatgtcagtgatcactcaatcaagctgttaaaacaacaacaagttctcctcactctccccctgcgtttcgggtgtaaagagttaggataggggtgtggggagaggcgagggctgtggagatgagactgttctctgcccagggggtgctcagaaacaagagggtctgcagtagccaagatgcaggccagactgaggaggaggggctggcagaggaagaaattgctcccagcaggctggttggcacatggcactttgctgggggaatggtgactgtcagtggggcagtagaggagggagtgaacgaacctgcccagggggctggggctttcatcctgagtgcacattgatgaggcactaagatgggaagaaggcactcagggagagataagagctggagcagaggcgtggagagaggagctggcccggcatgcagatgcaagggcttgggccgggaagtaactggcttgcagtggcaggaggtccaagtgggtcatggtggagggacagagagtgggctgtggggtgggggccagagggtgggattggggaaggccaactcccttgggtctaggggttgaatggggagcagggagggagtcttctgccctaggaaccagaggctggtaggcctggagcctaaagggttcccgggggacgggtctttgagcagggactttgcagatgggcagaggggctggccttggagggtgggtagggctggctgcttggagccagggatctgtgtggtgcctggaagcagggcggtgcggtgggaagcgagccaggtgtaggtttatcctctctgcccctcgatggctgtgtggctttcagaagtccttcaaccaggggaagctgggtttcttcacctgcagggtgagggcagcgcccacgtcgcctgttctaatgatctgcttgataaatgtgcactgtcattatgaaggaatggtggcatgtcatcttcattaggcttagtggtgcctctaaagtgggtttttctttccgaccttctagattgccagcgtcctgacgtcacagaagccctctgtcctcctcactttggtaagtggctggtgtccaggggtggggcagtgcttggctctggggagggtttttatgggggccacctctcctgcagaggtcgggcccataggggaggattaaaaaacggagaggggttgggtccaggggctcacgcctgttatccaagtgccttgagaggcaaggtgggaggatcgcttggagccaggagttccaggccagcctgggcaacatggcaagaccctgtctttacaacaaattaaaaagttagccaggcctggtggcatgtgcttgtggtcccagctacttgggaggctgaggtgggaggcgtgcttgagcccaggagtttgaggctgcagtgaggtatgatcgcgccactgtgctccagtctgggccacagacaggaccctgtctcaaaaaaagaaaaaaataaaccaagaggaatggtcatcagtgataagtagcgatacctgctcagtctgaatagctgtttatgggaccccatccttgagtctccctgggacctgctgtgtcctgtcgtgaggatgtgggcctggcgccacacccactcctaaggttaaacctggctagaagatgtatttgtgtcaggctgagctcctggaatttgtggatgtagaaagtcagtttaatgggtaccaaaatatagctaggtagaacaaatcagatctggtatttgatagcacaacagggtgactacagtcaacaataatttattgtacatttaaaaataaccagaagagtgcaattggattgtaacagaaaggataaatgcttgaggtgatggatagctcatgtatcctgatgtgattattccacattgcatacctgtatcagaatatttcaggtaccccataaatgtatacacctaatatctacccatgaaaactaaaaataaaaaatttaaaaaggaaaaaagaaagtttattcccaccctctgtctcccctgttaaaggggtctgaaaaccacaccaccgggcgtctgccctcaaggtagcaggggtgtggggcgcagtgactgaccgagggcctgggctagggtggggggtgcgaggtgggctctgggtacgccggcagggttttgggggcacttgagctgtggtgtgcccccaaagaattctctggaatttctcagagaagtgtgctttcttacacttctttgagcttgggagtttcatataagaggcatgtccacaagccttccccccaaagtgacccttccctcttgtctttttttttttttttttttgaaatggaatataaaaagtaaagtagaggtttctcttcaaagactttcctccccgtctaattagaaataaacagtaacttctcttagaagcaaaatttattcaaagacctgtgctaacattcttaaatatctgctagctgtaataaagaaatcaatatactttatgtttttagctcccacaatttaacctaaatatttgccctgatgtgcttatactggtccaagcaaacataaggtcatagcctgttcctcttccttatttaaaagtgtttttacctttctcagcattccacaagttacttcctccttcctttctccccctctacctttgcctcttttaaaaagttctaagttgctagccaatcgggacaaatacagaatgtggggtcccgttccaggcagtggaaaccggacacagcagtagggtggacacgccaggttataaacgaccctgtctcctttgtttggtgaactctcgtggcaaaactgctggagagtgtaccctttctgcaggaagtgaaaatggccttactaaataaattaaatttatgttcaagtgctatttctttatggcactgaagaacaaacatttcaaacatggagttttgctcttgttgcccggctagagtgcagtggagcgatcttggctcaccgcagcctccacctcccgggttcaagcaattctcctgcctcagcctcctgagtagctgggattacaggcatgcaccaccacacccagctaatattgtgttttttgttagagacggggtttcgccatgttgatcagtctcaaactcccaacctcaggtgatctgcccacctcggcctcccaaagtgctgggattacaggcgtgagccaccgtgcccagcctttctcttttcttaattgatttttaccaaaatagttatttcctttagcacttggccccttttttttgctttactgtcttgatggctataagggaaacttatgtgagatgattatggtcatagatgatccaatgtgttcaatttagatatacaattagacatcaagctgaagttctgggtaaagaaatggtgatttaaaatgccttgcccaggctgggcatagtggctcatgcctgtaatcccagcactttggaaggccgaggtacgcggatcacttgaggtcaagagttcgagacaagcctggccaacgtggcaaaaccatgtctctactaaaaatataaaattagctgggcatggtggtgcgcacctgtaatcccagctactcgagaggctgaagcaggagaatcacttgaacttgggaggtggaggctgaggtgagccgagatggtgccaccacactccagcctgggtgacagagcaagacactgtctcaaaaaaaaataagtaaaataaatgaaataaaatgccttgcctttctggagagggcccatttttctccaagtcccttgttttgtctccattcctgtccaagtcccatttggagtctccttggagttaagagagggatgtctccctgcttcacagcagtcctgccacagtcaggtcctgcacacctccccagaagggctgggttcgacaggactctttcggatgttatacagttagtggggagtgtgtgcaggagagggaagatggaccaggctggggagagcagatttatattgggagtggtcccgggtcctcgcctgtgcctgggcagcctggctggtttcagcagagtgctctgacctccatggagaaggccttgctgtgcagctgggatgctgcagagtttggggggcccccacttcctccacttggcaagtggtagcaaagaggtctgtccttgtgttggggccgggcctggagctacctggctgggtggctcatctgttgggggaaggcaggaggggatcctgttcttacctgtcctgagcctagctggaggcctcaggggtgcaggctgtgggggcgccatgcggccccgtgtgtcatgtctgtgttctctctccccagcgtggcgtcaacacggacagcggcagtgtctgcagggaggcctcctttgacggcatcagcaagtgagtcctgggcccccagggactctttccccaccatcccccactcccaccttcactagcaggtctttcccggtctacaaataagacatgaactatgcaaacttctttttaaggagtttgggcattttgaggaaatgtttagaagcataatttgccaaaaatcaccttgatttttcttgaaggaaaggtgccccgtgtctgtttgctccataaggaaagtgctcaggcagccctggccagggcaggggcaggggcaagggcaggggcaggcacaggtgggttgttttccctctaaacatctgctgtgagcccctgtggtctgtgcatcaagccaccaccccctttcttttatttttttattttttttgagatggagtcttgctctgtcacccaggctggagtgcaatggcccgatcttggctcactgcaacctccatctcccggattcaagtgattctcctgcctcagcctcctgagtagctgggattacaggcacccgccactacacccggctaatttttgtattttcagtagagatggggttttgccatgttggccaggcttgtctcgaactcgtgacctcaggtcatccacccacctcagcttcccacactgctgggattacagatgtgagacaccgtgcctgtcccaagccccctctcttagtcccagccattaaccccttccaacccggctctcagcagctcccctgtgtcccctgctgtcctaatcccaggcaggatccctttaacctcttctcactcttaaccaagcgccaggctgagcctccaaaccctgcttgggaagcggttccccttttctctccaggcaggaggacagaccttgggcacagggaaagacgcccctcccctgcttgtcacccctcacccacagcccccgggagagcctggagagggcgggagagccctgcccactggatgtgcttgggtccctggactggctggtgactggccctgggggtctgtggcctgcattgctggctgatgccatagcagacaaggcccctgcgctcgaggctgctgcacgtggacagtgggcagctcccagccccaactttgggacctggatccccagcccctcccctatcatgcatcccctacagcccccatgtcttctgttgtcctctggtggaccaaggcagtgatggaggaaccgccttataattatgtatgagcccaagctgctggaatctctgtgtgtgatgtaggggtgatgagggattatgagctcatgaatatgtatcacctcccacctccccctatgctaagagcagtggggcgggtggaggggcgggtagtaggtttgctttttcactgcacagatcttcgtgtcctcctgggagtttccccaaagcggccccgcctcccacgcctggcagcaattagcccagcttgttgaaatgctggccatggagctgctctctctccccaggcccccaggccctcagaggggctacgggcacagccagctgctgcctgtcccagtcccgggactccctgaatccccccagcactacctggtgctgggtctccagtgtcctgcacacctttcctcgaccatgccatggaacctctctatggcctctgtttgggtctctgcagcagggggaccctcagctcctccacgtgtaacctggtgctgcctgggcttgtggtgggcactggaggagatcatgctcacctggagcctggcacagagctggtgctcagtgacagttgcccgcatgcaaaccccagcaaatcccattgctcctctgtgcctcagtctccccatctgcgtggtgggccaggtgggctccaggatcaccaattcccagtttcccagatgtcagtgagtcgagggccttctcagcggtgagagctttgcttgctcctcctctagagagaatgctgagcccccctggaccacgtctggcagctgtgtggtgggtgtggttcccagccaggagctcaagatgtggcctctgaagcagagctctgccagctgctccttgaggttccccgaggaaggcaggtggggccctgggcttccccagggccctcatcactgtcagtgagtgtcaggaagcaaaggtctcgttctaccccccaggaggattcctaggtgtgacctctcatcccagtctctgtcacctgttgccccccagtccctgtggcctctgccaagagcccagaggagcctgtgctctgcaaactccccaccccaccctgtcaccactgggacactttttggagagccagggactgccttacttttgcaccatctccccaggcaccgggctggtacctctccaatctctgatccaggccaggctggggctgactggggggtgctcacccggcccctcagctgggggctgggctgagacactgccccccaccccgggtgctggtgcgtcagtttccgcacctacgccttgggctgctggccgagtctctgacttggctgttgcaatgcgcagcgggtgagaaccctcgtggccatctctggcctgcttgttctcctccctcccttccttgtcccctgcagggggccatccacccatgtctctcccctcggggccttccacctcactgccaccagggctgtttcactgaggcaggagctctggctggtgccccctaccctgcatgccgtgggccttgacatggggccccagcctttgcctccagctgctcccagccgcttccctgtggacagtcttgtctgcattcctggggtccaggtgcagctcatccccctgccttccactcacccaggctgccagcacttttgtgccgggctgggcagagaccacgtccccaagagccgctgccgctcagcaaccgcattcccctgcctgccgggtgcacctccagctgctagctgggatattaatagcctgtttcccaagcaagatgaatcttgctgtcgtcctcctctccaatacgcagctgcttccgccccagttgcctctcactgctctgatgaagctgcttgttcccggcattgtcctttttgacccttttaaatgtctctgcagcaccttgcaccttgggcttcgattgacctcctcctctaacagaagttcaggtttggcctcttggtttgacctgatgggcccccccagctccccttatcccctggcctgcagggaagaggagcttgtggtagacagtggtccccacctgtccacccagcctatacccttgggaccctggtccagctggatggttgggccaggacccctccaggtgtggctactcggggtgcctggcctggggtctgtcccatttgggctcagccttggtctcagacctccctccacctccccagatcagggccaggccgcctgctgcctgcagtaagagtgtgtggggtctcgaggtgtggggacagcagaggacaaggagcagaggggacagggcagaggtgggctgagggtggtgggcatgcacacggccagagagaccctgtggactgaggcccctgggctcacccagtgatgtggctcggtgtgatgacagtagcgtgaagggtgtaggccgggatggtctgtaggggcttgtgagtttggggtccggcccaggcagcagttccgtgtgtggcttgattggagcagtcccaaggaagatttgggaagagcaggctttgctgcgggctctggcaggaggggtgggtgtgggcatggggtcgggtgctcattgccaggtcctggcgggggcatgatggggggttggtttgggggctagtgggggctgagatggggaggggaaccctgcagcaagagacttgagacttcttcctgcggatggcaagataggctccctggaacacttggctcctgaaggctgggagcaaagtcagacatggtagatctctgaaaacatctaaggaggtagacgttagggcaggttttcctgagagcaggagactgaccatgaaggagagatggtctgttgggggattgttggcaggggctgggtggcctgagctgagggatgcctgtccatcaagtttccatgccttaacgagggtgccttcttggcacaaggcagtcgcctcccagacagacagaagctgtacccaggagccctgggccggggcagcgagtgacaggggctccgtttcctgccattgtatatggtcagtattttacatttcttacatcagtgtaagaaatacacttattcaggctaagtgtatttcttatctttcggcatttacttagatcaccctgcatatttgaagacaattggtaacgaattgattccatttaagcaagcagttaaagatgaaattctgaatttgggggttgttaatgcaggaatattaatatccgaagatgtgaattttaaaacccaggaagtagagggacattattaaaacttgacgattacagcaaaataccaatctgtggtttgaggaccgtggttttctggttactgttaacttggatatcaagttaatatttaggattggcttcttttttttttttttttttagacagagtcttgctctgttgcccaggctggagtgcagtggcacgatctcagctcattgcaacctccacctcccagattgcaatgattcttccgcctcagcctcccaggtagctgggattacaggtgcgcaccaccacacgtggctaatttttgtatttttagtagagacagcgttcaccatgttggccaggctggtctcgagctcctgaccttaggtgattcacctgcctcggcctcccaaagtgctgggattacaggtgtgagtcagcgcgcccagccaggattggctttctaattgtgacccatggagttctcggtgaggggagggaccctcaagaggtgagaacctgacccaaccctttggcagggagcagagtggaggggctgcctcatctttgggtgagatatgcccggaaagaagccagtggcctgggacaggggctttggccctctcatctcccagcccacatttagagctcatcaggaaattacactctgcttccagggcacgcctaccctcacaggcccagtgggatttcgttgatacttttacacgattaatacatgctcattgtagaaaatgctaaccagcatggaggcaaaaatgagaactatatgaattttattacccagggttcaacctgttaaccttgtcttttggattcttccgtgtgtgtctgattgtgtttctctgagtatatttttgtgtctgagtgtgtgtgtgtgtgtctatctgtgtatacacattgatctgtgtctgtgtttacctgtatgtgtgtatatcagggtgtggatctttttgtgtgtcttaagtatttgcctgtctgagtatgtgtgtgtatatgtgtgtctacattcccctaagcttgtgccttagtgtgtgtttgtgtgtatgtgttcctgttcatgcctgcctacatctgtgtgtgtgcatatacagtggggtctatctatgtgtgtccgagcatgcccctgttgtgcacatggctgtatgtgtccgtgtgtgcctcttttccaagcgtatgcctgtctctgtgtgtctgcgtgtgtgcatctgtgtctatgtgctgagtcactctgtgctgggtcactttgctgcttgtgtgcatgtgcacgtgtgtatgcgtacgtacgttgagtaagatgaaatggtggtggtgtgtttggctgctgagtagattggccactgcttttcctagggtcaaagtggcatttggtgcagtgggagccagagtctattttgtagttttgatttatgtcacctgctgccctgttcttcactttgaaccacactggctgcccgtagtctctttgatatttcataagtaaggctttgattccacaacatttaggttgactttgaatcatatagttctgtttgtatagttaaggatcctgaaagcttcagacatctggaatcctctcagtctgctgttacccccttctctcttctctcccctgtccctgcccctgttcagttggctcagctagaagggctgctggcctcacaaccatggcattacataggtgttttcaacaccattaacgaagccatggagggtccctggctggcaggaggacaggaggtcacgaccctgcgtgtgcttgtgtgtgctatccttccctaagatggggcaggtctttttttcttttttaaagagacaggcttttttaaagagactgggcaagagtcactcttgcccaggctgctggagtacagtggtgcaatcatgaatcactatagcctcaacctcctgggctcaagcgatcttcccaccttagccttctgaatagttgggactataggtgtgcgccaacacacccagataatttttaaattttttgtagagacaaagtctcgccacattgcccaggctggtcttgaactcctgggctcaagtgatctttctgccttggcctcccaaactgttgggattacaggtgtgagccaccacacctggctaaggagcaggtcttggaatccagagagttgaagtcttgccgaggcttctctgctgaggcctatagcttgtgctaggctaccttgttctccagcttgagctctgtgtcacacagggttctcttgtgtcagagatgtgctctgacctgatccttttgtctcctggggtcaccttttcaatgatgttcatcttatcgaagagcagcttttggctttgtagatttttcttatatggttcctttttatttcattgctttcttcaagggtcattcttaggatggaagtttagatcgctgattttcagtgttcttttctgctgtgtatgtttagagctatgagttttcctgtaagcactgctttagctgcatttctcacaggttatgatatttcatattgttattttctaatttcattgtatttttatctttgagccatggatattttttgatttctcatttaattctactgtgattaatgaatgttctctgcatctcagccctttaaaatatgttgaaacttccagcacgtgaccattatgataaatgttcacatacacttaaagaaagcatgtattctgcagttatgggccatagtgttctgtatatgtcaattacgtcaagttggttaatttcttgtttatatcttctatatctttcctgatttccctgcttgcttattctgtcactactactttgttttatggctgaaaaatatttttttctatggatacgtaccacatttcgtttgtccattcatcagttggtggacacctgggttgcttccaacttttggctgttcctgagtaatgctgctatgagcatagatgtcagacttcttgtgtgaacatatgctttcagttcccttgggtatatacctagaagtggaattgcagggtcgtctggatgcctttcatgtcttttcttgcctgtttgccttggctagaacctccagtacagagttgaatagaattggagacagcagacatgcttgcattgttcctcatcttaggggaaagcttttagtcttttaccattcagtatgctatgatgttagttgagggagttttttgtagatgctctttatcaagttgaagaagttcccttccctccctagttcattgagtatttattatgaaaaggtgtttgattttatcagtttatttttctccatctatttatacaagcatatggttttattatgtgttctattaatatgattgatgtgttacattgatttctttttgtatgttgaaggaatcttgtattcctgggaaaaaatcccacttggtcatgatgtatatatatcctttttatatgttgctggattctgtttgctagtgttttgttgaaaaatttttgtctctattcgcaaggaatttgggtgtgtaattttgttttcttaaggtgtctttgtctagcttagcatcaaggtaatactgaccttgtagagtggttgaaaagtattgcctccttttctgtttttgttgttgttgttgttgtttatttgtttgttttgagatggagtctctctatctcccaggctggagtgcagtggtgtgatctcagctcactgcacctccgcctcctgggtccatgtgattctcctgcctcagcctcctaagtagctgggattacacgtgtgcaccatcacgctgggctaattttttttatttttagtagagatggggttttgccatgttggtcttgaactcctgacctcaagccattctcccacctctgcctcccagagtgctgggattacaggcatgagccactgcacctggcccttttctggtaagagtttatgaagattggtgttaattctttaaacatttgatagaatttctattcatttcatagaagacatttggtcctgggcttttctttatgagaagttttttattacaaatttgatctcttgttaaggtctgtttagattttctatttctttcttttttttgtttttgagatggagtttcactcttgtcacccaggctggagtgcaatggcacgatctcggctcactgcatgctcagcctcctgggttcaagcaattctcctgcctcagcctcctgagtagctgggactacaggcacaagccaccacgcccagctaatttttgtattttcggtagagatggggttttgcaatgttggccaggctggtctcgaactactgacctcaggtgatctgcccgccttagcctcccaaagtgctgggactgcaggcatgagccactgcgcccagcctagattttctatttcttatatcaatttaatagtttgtgtctttagggatttgtttcaaataggttatccaatttgttactgtatgttatttataatattcccttataaacttttttatttctgtaaagtcagtagtaatttccccctttttcattcctttgtaaggtttgatacgtgatccattggttatttaggagtctactgtttaatttctacatatttgtcaatttttctattttccttatgttactgatttcttatttcattccattgtggtcagagggcatgcttagtgtgatttcagtcttttgaaatgtattggaacttgttttgtgacctaacataaagtgtatcctggagaatgatccatgtgcacttgagaaaatggctgttctgctgctattggctgagtattttagagctacgtgttaggtttttgatatacacacacacacacacacacacacacacacgctatatatatatattttttgaaacggagtcttgctgtgtcgccaggctggagtgcagtggtgcgatcttggctcactgcaatctccgcctcctcggttcaagcgattctcttgcctcagcctcctgagtagctgggattacaggcgctcaccaccatgctctgctaatttttgtgttttcagtagagacgggttttcaccatattggccaggatggtctggatctcctgacctcgtgatccacccgccttggcctcccaaagtgctgcgattacaggcgtgagccaccgcgtttttgttcaggtcttctgtttcctttttaatcttctgtctaattgttttattcattaccgaaagtagattattgacgtctccaactattgtcagtttctctctccaattttgttagtttttgatacatacatcttagggctctgttatgtgcatatatttgtaattgttttatcttctttgtggattgacctaattatcgttataaaatgcccttctttgtctttagtaaaactttgtatcttagggcttattttgtctgatgttagtatagccattctagttccactttcgtttctgtttgtgtagcatatcgtttctcatcattttactttcaacctatttgtgtctttgaatctaaagtgtgtctctttagagcatataattggatcatattttaaaaaatcattctgtctggcttttattaaaaagtcaaaaaataacagatgctggcaaggttgcagagaaaaaggaacacttacacactggtggtgggagtgtaaattagttaaaccattgtggaagacagcgtggcaattccgcaaagacctaaaaacagaaataccattcaacccagcaatcccgttactgagtatacacccaaaggaatataaattgttctaacaacacatgcatgtgtatgttcgctgcagcactattcacaatagcaaacacatggaatcaacctaaatgcccatcagtggtagactggataaagaaaatgtggtatggtatgcaccatggaatactatgcaaccataaaaaagaatgagatcatgtcctttgcaagaacatggatggagctggaggctgttatcctcagcaaactaatgcaggaacagaaaaccaaatgccacatgttctcacttacaagtgggagctaaatgatgagaacacatggacacatagagggcgacaacacacactggggcctattggaaggtggagggtgggaggaggaagaggatcaggaaaaataacaaaataactaatgggcactagacttaatacctaggtggcagaataatctgtacaacaaagccccattacacaagtttacctatgtaagaaacctgcacatgtacccctgaacttaaaattaaaaaaaaaaaaagaattcattcgccaatccttgccttgtaattggagaatttaatccatttacatctaaagtaattattgataaggaaaaactctaccattttaaaattagttttctatatgtcttataacatttttgttcctcactttctccattacatttttttgtgtttgattttttttttattgtcacattttggtttctcatttccttttctgtatgttttagctgttttcttaatgattatggggattacaattgactacttaaacttgaaaatctagtttgcattaatgtcagcttaatttaaatagcatgcaaaagcttgcccctatatgtctccttttcctcattctcttttgtgctgttatggcatgtggattgcgtctttattcattttgtacttatcaatacagatttacaattatcgctttattcagttgtcttttaagtcaggagagaaaaggagttacaaacaaaaaatacatttatactgtctttatatttatctgtatggttaccattgccagtgctctctttctcttcacgtggattcaggttactctgcagtaccttttcattttatttgaaacaattccctttggtttttctttcagggtaggtctgctagtaataaattctcttgggttttgcttatctgggatgttgtagttctccctcatttattaataatggctttgctggatatggaattcttggtggacttttttttttaatctttcagcactttaaatgtcatcccactgccttctctccaccataggttttgatgagaaatcagctaataatctaattgaggatcccttgtaagtgatgaattattaatacttttctcttgctgctttcaagatacttttttgacagtttgattatcatgtgtctaggtgtggatatctttgaatttatcctacttggagttcatggagctttatggatatgtagattaatgtttttcatcaaattggtgaggtttttgctttctctgcattctttccttctggtactcctattgtgtgtattttgatatacttgacacaagagactatgctgtctgcctagtggggatcagggctggtgttttgtagccataaagcttgctctccaactgactgcatttggaggacatggcccaggctgccaggtctgctgaaggaagggatcaacaggccttttgtgggtcaggaagtcatgaaattaaagtgtgggaccctctttaatgcatcacgtgtgcatgtcttgaatgaggtagttcttgctgggacatgacagaccgttggattaatgggcttgatttcttttcgccctacaggttcgaagtcaacaataccattcttcacccagagatcgttgagtggtgagtacggcctgtggtcaccttgcctgtttgttgtgctcggctcatggggatggaatgccctgttgttcctgcccacaccgtctcagagagcccctcagaaagcagattcccagaaccttctcccatagccttttctgttttgcttgttctttgttgttggttgactggccgtactttttttgaaaggacgtgagtcacttaaacatcagttaaacttatttcccttatttgcaatcttacaaaaactcctaccataagtaaaccaaacttagatagctccagcacgaggtagatggtgaaaagggcagaaataaacataacacataatcccattgccagaaaggtaaacatgtcacgcatgtgtcttgacaaaggtggcattctgttctacgcattcttctgtcaccttcttccttcccatggtgatactgttagcccttacctgctgcacaactggcttctactagctgcctacaaagtgagctgtcttatgctgggcgccacctctgtgggccctggaggtggccctcgcatcccagtgtgccaccagttttcttcctaagccatcgcattgctctttgacagcagcaaggcattttttctttgatggatggctgcacgtactgagaatgtagaagagaggcaaggccaggcctttgccacatcatcacttgccaaggagatgtgtagccttctcacatatgaccctaagtctgtatgatcacattttctttcctgtctagctgggagctctgactcgcctcgtcttagagcttgggaccaaggaggtatcctgaaagatgaatgggcatcggctgtggaaaaagaaggagtaggagagagtgaccctggcaaaaggaccactcgttcacagaaacaagagaaagggtggtggctctgtgtggccagtgcggagccagggagcagagcccgagaacagttggagagacaggcagtggctgggtgggccttggtgtccgttttgactttttcttgagaggaatgggaaacacaggaaacccttgaagggtttaagcaggagaatggtagaattgggtttgcatttaaaaaatcatttcgagccgggtgaggtggctcaggcctataatcccagcactttgggaggccgaggtgggtggatcatgaggtcaggagatcgagaccatcctggctaacacagtgaaaccccgtctctactaaaaataccaaaaattagcagggcatggtggcgggcacctgtagtcccagctcttagggagactgaggcaggagaatggtgtgaacctgggaagcggaggttgcagtgagctgagatcgcgccactgtactccagcctgggcgacagagcaagactctgtctcaaaaaaaataaaataaaaaataagaaatcattttggcctcagactagagacccagctgtagggcaagtgtgggaacaggtggcaagttaggaggctgttgcaggggtccagctggcagtggagggctgtggcaggacagatctgagtggtgaagccgcagtcaagagggaaagctcctgggagggaccggttatgatgcgtgagtgaagggcagagttgaaggtgactccaggtttttgtcccgcatagctaggtggtgtgtcactgagatggggacaactgggagggccagataccggggcagatctgggacttggggtgtgttgagtctgaggtaggtgccagtgggagagagggctgagctgggggtggagaactgagggccgatgacaggcgctaatactgaccctcggggttagaggccagtgggtccgacgcccctcacagccacactctgtgaagacagggctggtgttcttcaagttcacagccacctcttgtttttataaagtaacaaagccaagctggtggctcacgcctgtaatcccagcactttgggagacaaacacgagagaatcacttgaggccgggagtttgagaccagcctgagcaacatagagagatcccatctctacaaaaacaaaattttaaaaaattagccgaacacggcattggactcctatagtcctagcttcttgggaggctgaggcaggaggatcgcttgagcccaggaggtcgaggctgcagtgagccatgattatgctaccatactccagcctgagtgacagagcgagaccttgtctcaaaaaaataaagtaacaaatgcctgacttgtccgtaaaaggcaaatgattcataggatctgaagagaaaccagagagcctgtcctatctgtagcccccatttggcagaagaataaatcctgggtacttagaatgggccatgtccacttatactgcctcacatgggacattcccttgtggtcacttacagcttgggtgccttggagaccatggctgggtcctgtactcctgccatctcctaagggataagtcattaattcgtcactttcaaagaagcatgctttaattcaagtgacattttcgaggctttgaggtcgagcccgcgttcctaagcatacctcccaactttattaaagcaagcagcagaaagttgatggcagtagaaccattttagaaatgtcacattgtccctgctgctcaggggtatgttttaatagcctgggtcccagtcactctcggtgggtccactgtagtcatgatcatcacactccctggggcactgaaggaaggatgctgtgtggggcagcgggcgggtcctttattaacaggaatgggtgggctttccatgatgttagattacgactcagggactcatcttttgcccttaggtcttgaatgccttcaccaccctctctctgtgggagggttatggggataacaggaaaccatcaactcgggcacatgtgaattctagccctatctcctccctgctcaggaagtcacttgacttttctgagcctcagcttcttgatctgtaaaacggagatgtggtgaaacctaactcatggtacggatgtgaagattcacccagcctcagtttcctcacctgcaaagtaggctcaaagattgaatgagagtataagtgaaggactggcatgtctttttttttttttttttaagagacaggatctcactttgtctctcaggctggagtacagtggcatgatcgtagcttgctgcagccttgacctcctgggctcaggcgatcctcccacctcagccttccaagtagctgtgactccaggtacacgccaccacatccagctaatttttctgttttttgtagagatggggtctcctgtgttgcccaggctggcctcgaactcctggccttaagagatcctcctacctcagcctcccaaagtgttgggattataggcgtgagccaccgcacccagcctggcactttttttttgagatgaagtcttgctctgtcacccaggctggagtacaatggcatgatcttggctcactgcaacctccgcctcccgggttcacgtgattcttgtgcctcagcccccgcctccccactacaggtgcgcaccaccatgcccggctactttttgcatttttagtagagatggggtttcatcatgttagccaggctgcagcctggcacatcttgataacactgactgtcacctgttgagactccatgtgtacaaggtgttgtgctaagcacttaacacatgtcactgtatttaaagatatttgtggtgtattaggtaagtgttctagttatttccatgctacagatgaagaaactgaggtacagggaagttagtgacttgcccaagaaaatgccagttgagcccagactgttgatcccaggctcttgcactgctccttgcagctctgagggggcacccgtggagtggggctgcctgagtgtcagtcatcctcccagctcactgctggtcccactgaacgtacggtccagcacccttggaatggtcttgtgctggggccagggtatagtagggtggagaaccagggggcagatgcttggcttccttggcacccacatgcaccccagcttctgctagcagcttggctggggacacagggttcctcaggagcctgtcttgattggaaggcagcaagcagcctctcctagcacaggcaaactcgctttctcatttttgttcggctgtcattcatttccttcctgtgactgttttattgttttccattctctcaaggagcgcctttttgattgcctgtaaattcctctataatcatactcttccccacaaacatgagatcataactggataatttcttttcttgtgctgggtagtgcagtttgaatgtgaaggtcaaaagttgaaacttcaaaagagcaggcatcttacttccataatttaggctgtggttctgctttactgttttgcagatgattaaattgatctgaaggcaaggtgggaaataaaaggagatgctttcataccacctgatagctcagtgccttgggtttcggttaagtacctctggaagcgtcaggggagagcaggcgtgtcagcaattgccgtgtgccttcttgggttttaagcgagactgtgttaaattgagtcatctgccggttttagagctgttaattacacagaacgaaaagtgtcctgcatgcattaatcaggcggtgggtaacatgtctatttctgctccccggcctctctgtgtgcacaggagatgggaagctgtggttggttcacaggtagacgtgtcccaggattctacatcctgggtaacatgtcccaaattagaaaagatacgtagatgatgacctaaattctcggtgtgtctgtgaaaaggattccagtagcattgctcatctttgtgtcctcatgaataggcatttaaccctacgccagcaagaaagccacatgggaagtgggactcctaggggagagtgagaacttgagtcactgcgcgccaggaggcaggagatggatgtgggagcatcagacagaaggaaaggcgtggccaggccctggtccagcgtggaggtggacctctgccccacgtctgcccgtccctggctaggtttcaggcacactcagctcgcagctgagctaaaccatcattttcttcatggctttggtttcttggagaggacttattgattgattccccagaggatatgtaattccaaccagctcttttctttctgtccttccccttgtgggattttatcctttgcatcactgggtcatggagtgtgggagggatagttgttgcgggttcagtggtgttgaattcccgcccacctggctccaatagaatcattccctgcacatccatctccaggagagatggaattcctggccctttaaatgagttttgttcaacacggtgccactttgatgcttagaggctgattttggaaatccttcatccttgtctcactactattttaatcagtggagtgtttagatctcagttaattgatatcttaattcagggtttaatgctcagaggcagtgctgtgacttgtgaatgtttaaggaaaaaaataaggttgcacaagtacatctttgcctcatctactttttgtgattttaggtctgtagcaggagagtaggcctacatggggtaggagactttgcctcccagcctccctgtctgtttgagcagcctccaggcatgttgatgcccacagcgtggccatgagctggggactctctgtgaggctgtgcagtgcccacatttcctggcacgttttttcctggccaaagagcctgagctgacttctgccccaagttctctttttagagacagggtcttatgctcttgcccaggctggaatgcagtgttgtaatcatggctcactacaacctcggactcccaggctcaggtcatcctcccgcctcagcctcccgagtagctgagactacaggtgcacactcccatgcctagctgatttttttttttttttttgagatggagttttgttcttgttgcccaggctggagtgcaatggctcaatcttggctcactgcaacttccgcctcccaggttcaagcgactcttctgcctcagcctcccgagtagctgggattacaggcatgtgccaccatgcccggctacttttgtatttttagtagagacggggttcctgcatgttggtcaggctggtcttgaacttccgacctcaggtgatccacctgcctcggcctcccaaagtgccgggattacaggcatgagccactgtgcctggccatctggctgatttttaaatgttttgtagacacaggttatcactgtgatgcccaggctggcctcgaattcctgtgctcagccttggccttagatcctctagccttggcctcccaaggtgccgggattacaagtgagagccaccatgcctggcctgctcaaacttcttaggtggcatctttgtcatcctgtcctgagccatgattctctgttgcttcctggaggaggtggcctttgtcctctcatggggctgtcagccttgtagatcatacttctaacaaccaccccacacatcccctggggcagacaaggctgggactgagtgtgaccatgcatctctcactccaggggccggtggacccacggaggctggggcacccttttgtcctcatctgttcatgctcaagaacactggaaatgggctcatcatattcagggtggtgcattcctcctgaagacagggagaaactgcgcggaatgctggaaaatcctgttcttttctacagttatcttaaaaacagtttctggtgtttgtgctgtgagataaccaggccaggctggggtgcatccctctatgcctggcgcctgggtgagacttcaggcccagagtgccctacggataattggttaagccagcacacagcagacgtctatttaagcatagattcaattgggccaggccaaagcccagccaggctggtttcatcagagaactgcctttgtagaataatttgccctggttcagtttgattttttttttccacttcccccaaagtaagattagaaaagcaagtaggtccctgggcctcgatggcagagatgattatcacctctgctgggaggaggatgtggtcctttctcctttggcagattacgacctcttcctgctcatcaccataggaggatgccccagctgcagtgggaggcagagtggagagcctgggagtgtgggctcctgtggtccaccctgggctgctcttcctacctgtgggactgggacgaggcagtggcagagggattttgggctgctggagcctgaggaggctttgcccctgctgtgcccggtttggcaacatcccatgctgccatggggtggggaaggttgggtggagaggcctccttttctctttgaaatgaggccatcagctctccttgttggaaatgagctgttgtctggcttcggtggaaggacaggtagctttgatgacacatagttactgtgtgtctgtgccggtgctaggaccctgtcttccaggactatatatggcctttcagaagagacttaaattaaaagaattctaagtgttagaggtttctgaggattcgtctagactacccagggaacacagagaagggatttagcccagggtgggagggtagaagggggtcgtctccgacccctagaaaagtgtgtttcgggtgggtgctagaggtgggcaggaacaagttccaggcagaggagggaggaggctgggagagcacatggggtgagtggtggagatggcctgcacctacgtgagttgtgctctactagaggtttaccttcatcctgaggccactggaaacctaaaggccactggaaacgaggggaagcctgataaggtttgcatttcctaaagatccccagctgctatcagggcaggtgggctggaggcctagaggctggagggcttgtccaggccagagaggctggggctggatagagagaaatgggggggcctgagggaggtcgtggagggggagtggcagcccttggccgtgaattggatgtgggaagcagcggatggatgtgatgggagagggcgtctaggatgacgcccgggtctctgctgaagcagcaggaagatggcagagcctcattgagatgggggcacggtgggggttctcgcacactgagctccagggcaccccaggacccacaggtgggtgcagagggaaagcagggagaggcagagggaaccacgccttctgcgagaaggggaggggagggctggcagcatgatgggggtgaagagagaagcaaagaggggagaggagaggggaggagatggggaggaagttcaaaatagaacgcaaaagctgctttccctcctcccccaaggcaaggacggttagggcctggcaggcagcgtaggggaggcttgactggaagaggagaaggaggcaagtgaggggaggattcttcacttgtagaggaagctgtttcggtggccatggagcttctagcaggagctggtggaggttggagctgggatccccaggtgggcgtgtgagcttgggaagaggatgcaccttcccttaaaagggagggaggagaggacagatggggagtcctgggagtttggaggaggagaggtgagagtggacccatctgctggctgctgcgcgctccaagaagtaggagtggaattcattcatctgtggcggctcccgtggggggcagaagttgggggtagatatcttcggaaggtgcgggaagttgagaatagccctcctgcgggttcccctgcagctcacggcagagctggggcctcgctgaggtgactggggcttgcttggccattgccagtgcatgacttcccctggcagtgctcagtgctcctggagcaggcacaggccgagcctgtggggatgggtgggcacagggctgaggagtctacagcactggcaacagtagtggccatagagaagggccagggatctaagccgaatgaaggcagagggcggctccaggagaaagtaaggggttggagggcgggagatcctggccctcacccatgctgtcacccagtgatcatcactgcatttgagagaagagagacctgctccctgacagcgggttccccgggctggcgtcatagagggtggcagtgggaatgacacctgagggaccacaagtgggttcggacctcgggagcctgagctgctggcccctgtcctgcccatggctctgaactgtcaccctctggggacaggagcaagtgcctggtcccagataatgggactgcacccgccatacggcggcatcagagacaccttcatgatgattaacagcatgctgtcaggctttagggctgcctccgccgagagaaagggcgttcattcgagaaagtctccctgggcttgtgggtttgttttttccacattccccagaaggttctgtggtctcgggaaggtgtcgctgcgctgcagggtgcccgcctcgtttcccagtgacaaatggctggctgtcccagctgtgcagcgtcacggagaccgtgtgagtcagcggctggctggcatgggctgctcccttgaagttcccaagggcttgctgcctctgatgggagtgggggagccaccaggcccctcgcattcccgccatcctcgcctgcctcggggcctctgtctgggctgcctcgatggaggccagctcaggtgggctcttggccaggccgaggaggaggaagaggagatgcaggagaggtgccctttgacagaggagcgagtgctggtctgcgtcctcagacaccccagctttgctcccaacagaggggtgggtgctggtctgcatcctcagacactccagctttgctgatcttgagagtgtttgcattgatacctttgtgagagtcacgggtgggcctttgggagctttggtgcaggtaggtcatctttagtaaaggaaaaggagctggccagggggtgcaccgggaactctctgccttgtgcagagggactcagctgggttgcccacctccattctccaggtctctcagtattacagacctccctcaccgggtggccagccccaaaccgaaagggctcgtgcctctccatcattccctcacatagcaccccggctcctgctcttagcagccctccttccactccatcattgtgtgtttactcgcgctgtatccgtctctccatggtctctgcgctccattaggggaggacgtggccctttcactccactccatcaccggtgcctggtacatccagctaacacttacttattagtgatgtgaaatgaatgaatggacatttaccattatggacagcacctcattaaggtttttaaagtgctatcaaagcaatatgtacccttggtttaaaaagccactagtacaaaatcagtacgggaaagctaggttatcatgaaaccagcgactcctgccagctcatctctctccacaccacccctccccaaagcgaattctttgggccatttctgtcacctccacccatcttttcatcatatgtttattgctggttcttccatgggttccatttgccttcttgtcctacatttgagcctcctttagttcttgctccgtgaactttccaccccatcttgcctttgccctgggtgagctgaggctgcacagatggggccctgctctctctacacatcttttctccaacccgtctttacctcccgacttctgttgctgtttccttgttagggtttgtaatatttccattgcatttatgtgagcagtaaatcttacctgtttgggggagacattaactctaaaaggttaaaaaaaaaagccataaaactgtgtttctatgatgactgtgaccgtggtctatgcagaactaaggaatgtatcagggcgggagtgccttctctttgggtcggatgtcacaagcccagggcctccctcaagaggaggctcctagcatcaagagcacataaactgtttttctttttctttctttctttctttttttttttttgagacggagtcttgctctgtcacccaggctggagtgcagtggcgtgatctcggctcactgcaagctccgcctcctgggttcacaccattctcctgcctcagcctcccgagtagctgggactacaggcgcccgccaccatgcccagctaattttttgtatttttagtagagatggggtttcaccgtgttagccaggatagtcttgatctcctgacctcgtgatctgcccgcctcggcctcccaaagtgctgggattacaggcttgagccaccgcgcccggcctagactgtttttcttatataaccaccagctatacaaaatcactccatattttagtttattctctgtttaaagaatggtttttttattagaaaaaaatttttatttcttttttttttttcattagtacaaaagcaacatatatacatgcattgctgaaagttagaaagttcacataaacaggaattcctccagttgtccataagacatcctggacgtggccaatatagttctatctcttacctgggtattgtgatggttttccccccagatactgaaaggctggaccagttgtaccacagcatcccaattctggatttgtatggttgttcgcttgtgttggtggttagcttgttcttctatccccatatttcctgcaaactggaagttagatctaaagccatagaagtttaaaacatttgccagaatacatcccaggtgatgtgtatttcttattgcactgcattcagacacaaattatacttagttgacccacaatcagtgatgctaagactgatcactgggttacattttcccccttgacctggagagtaatctacctggtgttactttggtaccatgtgaataaatgcagccttcatacatatatctgttttgttttgttgttcctagagttttaatttgcctttcgtctttcttattgagagaagaaacatatcttcttcaccatatcactaagagctttaagcttcctattgattttatctgcagaaaggaatccatgccattctttttgtggatgtttttctcagagccacatacttggagttctaatttctactgattgctttctaggcttgctgtccagtgtctaattatacttttggattgactccagtttttaaaaatatcccattatatcacctccttctctttattggcttgtgctttctccctctccccacccttctacccttctctctctgctggagtacatccttaagtacttccccaatttctgagtttttgaatgtctaaaaaggactagtttccttctgtatttggttagtagtttgtctgggtgtagggttctataatttttgcatggagtgcaacaaaaagggggtgagtgtaacagagtgggtcatgcgctctttgacattgtctcagttaagtctcagtgtcgctatctgtaaaatgggaaggtagtacctgttctaggttgggttccatgggaagctgagtctgtgagccaagtaggcaggaagcgtattgaggagtgctctcaggatcagcgtgtgtgtcagagtaagggagcaggcttgggctgcgatgctgtcacaagggcatctcagctgctcccatggggagttttggtgctggagtggcccccagagatgtccccagctgaagcgagggagctgagtcttggctccctccatcgaatcaaggagaccagtagaggggtgtggcctcaggggatgagttgggcagtgcacccagcatccactgcaacttacaggacccaccatgcggcgggtccccagtaaatggcaatttaaagtgaagggaagctgcgtttgcctgctgagatttctctagctttgtgggcctgtcatgaatactggggagtaatgttttgatgagaatcaagatgtcctacctaaggacatcagagcattccacctggctttggggtgggaagtatggatgacgtggtgtctgcaggctttgcatttcgcttggtttctggaacaagtgtacacagcacttactgtgtgccaggcactgtccttagtgctttaaaaatgccaactccgttctcactgcaaacctatgatgaaaacagtgttcatatctccgtttttcagatggggaaaccgaggcacagagtagggatcttggccacaccgctgggaaggggtggagctgaactggagcccagggcctttctcccaggccggtgctctgaatgcctcagcatggctgccctttctgtgcccgcggacccagggtttttttaaatgggtggaggtagaaaacgaatacttatttggctcctctctgtgggtcttactcgcgggtgagattgattgcaaccaccagaaacctaaccacatttgggcaaattaacacaagtttgttgggaggacctggaagcctcaggagtccagttgcaggaggcacagcccagccaggaagggacagcagggtccctcgattgtgactcccctgcccacgtagaccaccctctcatctgtggctgcctccctcttctctgctcctggtctcctgctgtgtctgctgtccagctgtttccacatttgtaccagcacacacgaaactggaatggcttctgtcccttcacctgaccctgtcacccacccgtgggcaggtgggtgggggtggggaggaaacgaggcctcttcagccaacaggacagagccctgggaggcagcaggcttaggattatggcccagtagccatgccatgtagatttcatcccccttcccatgcatggggaaactgaggttgagggaggcagcctgtgacaagctgcagcaaccaggcttcttctcccaccgcagcggcttccagatcttatccctggaaacagtctgcccgctggctggtgttagggaaggtgggcagcagctctgctccctgctagaggttttcttctagactgttccatggagcttgtcactcctgggccttggtggccccactctggccttgcacaacacgccttctgggctgtgcagggtgtggtaggccctgagctctccctggaggggtccagccagtgcctcctgaaagtcactgatttgctgctttgttcttctgtctctgaagccgagtgtttaagacggatatggagctggaggttctgcgctataccaataaaatctccagcgaggcccaccgtgaggtaagtcaggcaccggctctggttgagtggggaaagcagtgttgctgtgtggcgagagaactgcgtgaggatgaagggtttccaggtgggctctaatccctgagggccaagtgagaggtaggaagttttacacagtgattgttctcttttctgttccctggtgggcacagggcagggacagaaggggctctgccccaattcctcagcttagggcacctgcccatcatgcagtcgtggacactaatcctcaggaaattatccaacaaaaagtcccaattctgggagggtagagtgctccttcttcatatcccagcagttctcagctcattttaaagaatcttttgtccttaactgtggttcaaacacactgattaccatcatccattttctgaaaatttctcttccaaaccttcccgctttactggaggaatgagaccaaataaggaaacacatgtcttgaaagatgaggatggcccaccgtctgctcaggaacattgcagttttgtgttaggaaacagacaagggtaattgatgggcagcgtactctgttgtacgagataatgctctccgtgttttatgaaagttaaacaaaggaggccttttagtgatcgtcatagctttcgtggcattaagtattcaccaagcacctcgtggttaaatcctcactgtcctcgggctgctggtggcctctgagctgtaacttgaggcatggcatttatcggcttccaaatggaagtgcttcatagcagtttaaataaactgtatggattttggagcttttaaaaagttctaatttgtcacatgtctgtaccactgcatgcacatatcattctttttttcctttttaaagaagaggtgcttttgaagaagtgctgtatgttatttatcacgctgtgttactgatctgcttaatacaaatgtctttgcttaatatccgtcctccaggtaatgaaggctgtaaaagtgggaatgaaagaatatgagttggaaaggtaagccaccatgtttctccgggtaaaattaaaaggtaaaaaacagtaatttatgttccctgagtgagtaacagatgagacgccgcagtggcacacacaccgtgagcggagattatgaacagggcttcaggatcacaagcaaagattatttttcttccgactgcgcccgcctccctggctcttggcagagtgtttgatgtaatggttttcgatgacttttcagggtggtttagtgccccaccattctactctcggactttgtttctgccatttgcaggaaactttaccaaattgctgctcttatgactctgaaagccgccagtaaaacagcttgccgtttttatgtgtaaacactgccattatgtctgctgtgctcgggcgactgggttgagggatggttaaatggcccataaagagctctggagagctccattggccttctgctcctattagggctgcagcgagccagtggcacccggggagcttccggcggctgcccagccgtggcgggtgtggcctggccagctcagccccgctccaggacccagaagtcagtgtgctgccacccatggtacaaggaaacctttgggtcagacccaaactgcctcagtggctcccttcccacccgtgtcctggggcaggaggcccccattccgagacctcccaccagtgttggtaccacctggaagctctggggaggtgacactgaagaggctgccatccccatgtcctcactctgggctttcctttcctgcctgtccttgtgagagcttggtttctggtatcccttaccccccttgcagggcccaagtccaccccagatgtcctcagggcctgctctgttcagagccccggccctgggggtgctggctccatatcaccctcccaggctggcctgcctgccatcagtggggtgcagggccgaggtcggatggggcccgtagtgggctgcttggatgcttcagttcgctgtggctgtgcttaggggacgagtgtctttttaaggtcttgccctggaaggagttctgagcagtcagtgcctgtgcttctctccttaccccgcccaggaggaggttaaaatggcctgacccaggtgcttggcatcctgggaggggccgtgtaacacacgttaatcagaagcccagctccgtcagccggggaggctgagaagggctcgcagagctatcccagcacttgcgtctgcgtggtctccttctgcagtgcggtgtctgtggcccagcattcccaggaccccctgcccgctccgaggatctgggatgggaagtgtgttgtggggctcctccagcgaggtgggctggacagtgggtccctcagattggcactgccccggaaacctgtcccagcttgagttgaatcacagtgacccatagctgatgcttcaaataaaaataactgagaaattggggcaggaatagctgagcccagtgtggaaccctgccgtcctctgcatgctggctgcttgagccccgtgctgcaggcagtcctgctcccaaggtggctactgggaggggccctgagcctccctccccacagcgtcccagagcccgaccctgcccaacctggggacagggctgcatgggctatgggtcaggggccaggggacctggaatacccgccgttccttagccctcatgccttccaggtaatggaggtctttttttttttttaaacaggaaatttcaatatccaaaataatagaaaagtataatgaaccccaaagtccccaccaggtttttgtgtttagttttgtttgctagagcattttaaagccaaatcctagacatcgtgtcatagcacctgtaaatacctcagtaggtattccagttggtgagaacttttttctacttttacataaccaccatgccaatatcacattcattatcacaaacgaaccgtaactccttcatgtcatgaatatctagtccatattgatcctaaactctttttagcattggtttgttcaagtcaggatccacacagagtccacatgttgtacttggctgctgttggaagcagggtgtcgtgaacctgagctctggggagatgtcacccctgtctacaaactgctccaccttccctccacccccatcccaagaccctgggttggccttgctgccgcctcctgcgtggaccagagtggctcttggagagatgagctcgaagccagaggccacagccgagtgcaccgggaagctctcagccaggagcagcctcccacagggtgctgagtggcatcgggtcagcgtgtgtacctgctgcccatgctgtgcacctgccatgtgcacccacctgctgcaggccacaggacatagggaggggaaaccgtgcccaccagggaagctatctgatctgtgggcccctgagagcttagagcaggggggtgggtacggggactgagacaggaagaacaagagatggaggctgttcctgaggggaccgagttgggagagaggggtcaccccctctgaagatggtgggaagatgggtgtctggggaaagtgtcacatcatggagtatccctggccagatttgaggaggcgccccgattgccagtgtccaggttgaagcccctgggacatctgcagccagggagctggcctgacacttcttccgcctcgagctccctctccagggcaggatcactatgtgatgcagttttgtggtccttgtcctggagagcctggaggcgccttcttggggaccatgtctcatttatctgcgcggtgtctgacccactgtaggtgtcgggaaatgtatgtgggtggaaaagagaagaaaaggttttaagtgatttttctgccatcttctgtgtcactgggaacttgagaattcttttcttaactagtcggggaataaaaatctcttctaaagcccgtgtttttggttacccgggggtgtgcctctttgaacacaggctcaactgctaccagggaaggctggggggcagctgcactgctgtgtgaatcgctgactcactgggttcaaaggaaaccagccgctcttctatatgtgttgacagcaccctgtgagcaaggtgggcatccttaagacctgctggactttctgctgggggcctggctggcttcagccttgcacagggacactgggcatgaaggcagggagctctgcagttcaggactcggggcaggagtcagggctggttttctcgaaggtggacacaccacccaccccaggactcaagcgatggtggcctggacctccagttctaagcctcatctgtttttgttttattatctatgatttgttataaaatcttgaaggcatgttaaaaaaaaaaaagtgagcgagcggatggcatttatgaagactcctccctcatgcggcgcctgggagttgagggttcagaggaatgaaaatcattttccgcaattgaggtgtagtaaattgtgttaaaccaataagacgtccgtgttgggtaaattgggctctaacagcaggcccaatcaggccatccgtttttccgcctcctattatttcatgttagtggcgtacccagcttgtagccagctggcgtggggctggcggccggatccattacctgcaaacgctaatttagagcatgctcccattgggctgtgtaagcgagtccccagctcacatttgccacaaggagattaataacgcgatgtgtatgacagcctgagaccttgattgaaattatgctctttctctctgagctgtgaatggggcatttggggcccttttgtttctggggggtcatgagaatcatgggaaagggagagatctgtgtagtgtgacgggtaccgtgtggtggcgtccccttccaggcctaacccagtggtaccacatgctcgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaatcacttgacctgggaggtggaggttgcagtgagcctctgcattccagcctgggcaacagagcgagactccatctcaaaataagtaaataaaaaagactagaaactttgactccagtaaggacagccaggaggtgggagagtctgtgggcagcccccctcatccctgccagcccacagtgctcaggactgcagggggcgtggggccgcagagaggacgcccctctggggcgatctctgcttgctgcaatctctgcctcccgggctcaagtgatcctcccgcctcagccccccaaataactggcaccacaggtgctcactaccttgcccagctaattttttatttttcgtagagatagagttttgccttgttgcccaggctggtctagaactccagagctctagcattcctgctgccttggtctcccacagtgctgggattctaggcataagccactatgcccggcctggcaccctctgcttttcatccgagtccctcctgtgcagcgactcctgaagaactgtatctcggatgcctgtgcccacatggtcctcctcccgtgtggggctacacgaggctgtgttgccgggcactctgggtggatggtgagacaccttgtgtgtctctgaccagggctggggcccctcacagggcatgcagaggacgcaggtttcactggagagggaagtcactaggaggtccccgtcttcctccgggaggtcctggagatgcagtctccatcatccaggcacagtctgacctaatctgctctcagcctggacaaatgtgggcatcagtgagactgccatccatttagccacccccacaaagggtgctgcagttttgaggactgtttggaacaagtctgggtccaggcggcctctgagaccggagcccccaggtaagaatggatgtgatgggccctggggaccagctgtgtgtccgtgggcaggaccctgcacccgctgagcagacacatcctttctctgaaggctgtgttgatgggtgagggcactggcacagcccattcagagaagagggccccttcagacacaggtctgggctggagaaacaccctctttgcctcaggtggcttggagtaggtttgctgctagcacttgcttggctgttggagacgggccccagcctatcatgagagcagtcaggaaacaccatctgcgtgtccaagccctaggagggcagtccttgagtcctgcaccctggctggccatgcctagggggatttaagctgagcccttcccaagagccagggctgtcttgggtggagaattccttagtccagagcctaccctgtgctggcagggcaggtcctgtgtgcccgtccatcctgctgtgtctacaccacttggcatgagggagggagttggggacaggcgagtgtggagagtctctccaccagagattcgacagagccagggatccgagaatgaaactggggctctcagcggggtcaggctgtgggaccctgtggcttaaagcagggatggctcattttgcctctaggagtaactgaggaatgggcatgtggagaaaaccaacttggtgtccagccagaaagctggacagagaaccagagagaagagctttctgcaaatgtgtaacctggtcgatgaaggactagagattttggggcaaaactaacataaataggcattgtcttttcaaatgctgggcgcattgctcctggagaatcatattagaaatcataaggaactgtgctccctgtggacatctttatggattttcctctagtgtttcaccattaaacctgatattgccaggcatggtaattacacactcatgcctgtagtcccagcactttgggagtccaaggcaggaggattgcttgaggccaggagttcaagaccagcctgggcaacataggagacctctgcctctacaaaaaaaaaaaaaaaatgtttttaattagctgagtgtggtgacgcacccctgtagtcccagctacttggaaggctgaggcaggaggattgcttgagcccaggaagccaaggcggcagttagctatgatcacaccactgcactcccatctgggcgacagagtgagactccatctcttaaaaaaaaaaagagaaaaaaaagccaaaaacctgatgctgactgttgatttcagataaatatttatcacgagtttaaggaagtagcattgtcttcctggcttactagattttatcaggaaaggatgtcgaattttatcagctgccttttcagcatctcccttggccttttccacgtgtgtgtttaatcagtaaactttttattttaggatagttttggattacggaaaagtcacaggaacattagagagttccatgtacctggcacccattttccctattatgtattagtaaagttattaacattactttagaacatttgttaccatggatgcacgttattgatacttaattattatcttaagtccatgctttattccagcggccttagcttttacctaatgccctcctcctgttccaggatcccatctgggagaccatatcacgttccattgtcacatctccttagcctcctctgggctgtgacagtttcttagaattgccttggttttgatgaccttgacactttcgaggagtatggctaggtactttgaagaatgcctttcaattttagtttttctttcagcgagacaggagttatgagttactgggaaggagagcacagaagtgccattgtcatcacatcacatcagcatgacttatcactgatgatgttgaccttgatcacctggctaaggtagtgcttgtcaggtttctccactgtaaagtcactcccctacccactcttctgtactcttggaaagcagtcactgtgtgccacccacacttaaggcatgggaattatgctatttgtgatccttctgtacacatttgtctcttctccctcatttatttatttgttcaaccttttttttttaaacttgaaattgtactttctttcttttttttttcttttttggagacagagtctcgctccatcaccgaggctggagtgcagtggtacaatctcggctcactgcgacctccacgtcctgggctcaaatgattctcctgcttcagccgctcgagtagctggggttacaggtgcccaccaccatgcccagctaatttttgtatttttagtagagacagggttttgccatgttggccaggctggtctcaaactcttgccctcaagtgatcctcccacctcagcctcccaaagtgctgggattacaggtgtgagccactgcgcctggcctcttttttaaaaaacttgtatagacccatggatatttattttatactttataatccagtattctgtgatgctcaaatccttccagctttgggcatcgagggctctttcgtttgactcctgtgtctttctgatgcaccccgtcattttagttttggagcattcccttcctttctggcattgcgggttgcaccgggctcatcttgtctgttccctgctccaacctcagagttagccatttcactaaggagcccggttccttttattggaggatggtattagaaaccaagattgggtgctgggtgcaccttagatgaattttatgaccagacgtcctggtgtagagccagtgaggcatcccagtacacactactttattgtggtttatcaggactttaagaagccgacttaggaggcagtatagtagagtgggtagagcatggtccccagagactagtgttcttggtttgggtcccagctctgctgattaccagcttgggcacattgataacactacctcagtgtcctcatctggaaaaaaataatagcacttcataggaggattaggaggatccaatgaattgatatacaggtatacctcagagatattgcggcttcagctccagactactgcaataaagcaaatattggaaattttcgtgtttcctagtgcatataaaagttatgtttgcagtatactgtagtctcttaagagtgcaataacattatgtctcaaaaaatcaatgtacatgccataatttaaaaagactttattgctaaaaaatgctgacacacacaaagtgaacacatgctgttggaaaaatggcaccagtaggcttgctaaacgcagggttgccacaaaccttcaatttctaaaaaaagaaagcaaggcacggtaagatgaggcatgcctgtatgcataacacatggagcagatggacatccactaagcatccttatggtgcttgttgttgcttttttatttatttatttatttatttatttttttatgacagtgttttgctctactgcccaggctggaaggcagtggtgcaatcacagttcactgcaacctcaacctcccagtcttaagtgaccttcccccctcagcctctggagtagctgggactagaagcacgtgccaccatgcctggctaattttttatttttctgtggacttgggatctcattatattgcctctccaactcctggactcaagcgatcctcctgccacggcctcccgaagtgccgggattataggcgtgagccaccatgcctggccattgttgttattttttcactagcattttatacaggctcaaaataggaaattgagctatatatttttttcctttaactctcttagccatattttgagaccaaggtttttgagatcatgttttgggaagcacccccatgtttttctgttttctgaaacaacttggaaagcatagggcttggctgtttcttgaaggcatgaagtcctttgaatctctcagaccctgttgtttctctggggaagatttctttggtaacttttcagattttcctatgggattgttttagtccaaattcatcacttttagagtcagtaagtatgttttcctataaagtcttagttttcatcaaagattttacattgtaaccaagtaaccaattttattctcatatatttttaaaatcttatgtttttaaaatatctcctttatatctgtagctgttttttctttctcattcctaatgtaacttgtgttttttctctatggattataattgctagagttttatcttctttattggccttttcataaaatcagctcttaaatttatttttcagttctactgttggtcaaactcattgatttccagttttattattaattcctttctcctctcttcctgaaccttgttttgacgcatctgtcttttaacttgtttagttgaatcttagtttattttttattttttcctctttagtaataaatagattttggctagtttatttttgaatactgccttagctatatcctggtatgtctagagtgatttgtttttgaacctaagaactaacctagtgtatttcttttcatttcccagtagatgtggttgaatttttcttggtgaccttttggtttttagctgctagttctgtcaccattggagctagagaatgcagctggtgtgaatctttttggtttttaattttgaagtttttcttcgtggcttatttaaaaatattttggtcagtattttatggaatactggaaagtgtttagtttttatctttagaatatatactttggtgtacatgaatcaggtttattatctaattccagtcctctgccccctcccctatttttgtatatttgctctaagatttagagagatggttttataattctttgtgattcatgatagattttgtcttactcatttccatgataaattgtttgaggcataaaagttgatgattgttatgtctttattatatattttgctttttatagctttcaagaaaccccttttaacctatttaatctatgtcttgaatctgactttgcctgacactggtgttgctatgtttgttgttgttgttacattttcctggcatatctttgcttatccctgtatttttaactttttaaaataggttgtttataaggtgcagcatactcattgttcaaatggagagcctccccgtgttaggagagctgtttgaattcacagtgataatcagcatctgttctcttttctacagccttattttgtgttttctggtttctgttttttcctttgtggctttaaaaaagtttttctatctttggaaggttggtgaaatttcctttgctcacttttatatgtatgccatgttaaatgtagaatcacctttaaatcaagaaaaaaagacctgtatttctgttttctacttatgttcaaaagttaaacaattttaattttctaattttaacaatttaacaattttaagtttctaattttccttaaaaaactagaaaattttccttaaaaaattagaaacttagcatagttttgatgcaaggcaggcaagccctaaagtggggcttatcccacgagggttcttggcttcacccaggaaagaattcaagggtgagccagtagtagggtaggaagaaacagctttattaaagcagcggtgttacagttcaggcattgtgacagctccgtgactacccctgcagagcagggctacctacaggcagtgtgctgagagccgcagctcagggcggttttgcagtcatatttatacccacttttaattacatgcagagtaaggggcagtttatgcagacatttttagggaggggttagtaacttttggttcatcaagtcattgctatggaaaggggtggtaactccctggtgttgccatgacaatggtaaactgacatggcgcactggtgggcgtgtctgatggaaagctgcttttacctgggacctgttttggctagttctccatttggtctggtgtccgagccccgcctccagagtcaagtcccgcctcctgcctcagttttactttataatctccctttcccctaccttctagttttttattatataacttctttttcctttattttcaacatttgcattgtcttaccatcattttaccaacggttatttagtgagcactgtctcactcaatccaatgtggacctcaattttgtaccatgttttccctttgctcgtgtgagtgctttaagttttgattcagtactttcagtgccttgcttgttggagggttcttttgttgtctcctgcgtgaatggtggcttcagtgggtattgactctttgttccataaaaccattccctcctttgttgccagagatctttagcaaatcatattcctccttctttccagggaacttttcattttcttgccctggatgcttataggactattgattcttggaagtaacagtatttcctgaggatctgtctcactgcctttctgggcaggggctgcacttcagggcttagaatcctgccagctgtctgggaggaccaggagaaggcaggctccttgggaaggggcacaagccggggcttgcttagcctccaagttcttcagccagtaggcagcacggggggtctggagggacgagcaactcaggccataaagttcacatcgggtgtgttctgacctagactgataaaaagtcaagaagaagcagtcacacctaacacagagaccaggtggtgcatgtgacagatctgcggagacagaggcagcttggccaccagcaaggctggtctgcacacagtggacaggccagtggcagtggccactcctgcacccaagcgggggcatcacatgctctgcttcctgtctgttacctccctggtcactcccagaggcaagcattcatccccttgggtcctgctacctgagacctgtgatataattattgatcatgtcaccccggacagatttcattccctggtttctctgtggcttccttatcagtttcagaaggtaacgtggcacccgctgggatcggagccatgcacattgggacaccgcctggggtggtccctgtgagcacctgcgatagtctatgaccgacttctttcatctgagcagtgaaagctttctgcatctcagggtcatctttgaaattcctcctcctcacgtactaggtctcctggatgtgatccggggctgttagcttcctctcatgatgtccacttgcgcaccagtgagaaactcaagcctgtctcccattctcctgctgtgaccctgcacactcgttctgctgctgttttcttgtgtgcattttgtggcttggtcccttcctgttttggcgcaggcttctccggtgagctctcctcatggatcctgagaaaacatgggctggtggatctttttaggtttcctctcatttttcacccaggagacctctctggctctttctgcacagctggccaagagctgtctgattgaccccaccatgcggggctctgctgaaattgctcaggcccagaagaaagggggaggaacggtttaggttgcttgtaggttcactgtgcaagatgggcgaccccagaggagctgaggagggggctatgagttgcaccaggtggtccagacagtaccgagtcacctcggtggacatggaagatgtcttctctacagtgggccagctacctggagttggctttggccacacccccatttgctgcctgccttcccccgaggcccctgtgagagtggactgcagcctctgggggcctctgtcccgtcagggtcttggttggggagtgtggggaaaccctgggtccccacctctcattctccaggaagaattttctagcaagagaaaggccagagtttatatactggtggcctctgggccacatccagtacacacgcagtttccgtttggcccaggcaataggtattttaacactttattttggttcattgaagtcaaccaaatttgaaaaatcagatttttttggcttttcctgaaaatcagagtagctggtaaccgtgggctggaatttccacagagcagcagcgtggtgcttgctacatagctttcgttcagggtgcacgccacaggccccaccgctccccgtcacctccccgagcactgaagccgactcttttcatggctttcatgctgttggttctttcataaatgagaaagccttctcataccagcatctctatcaaaagagaaaaaaaagatagtcgaaagggtcatgtatttcaagaaaaataggagagctctggggaaaaaaaaagacttttttttctgttttgcatgccactacctggccagcttcactcctgtgggtgcctccaggcctctggagctggtcccccactctaaaggagcctttcctgttcttccatgccggaaggagcccgtggtagatgggagggtgtttagctgggcaggtggaccagacgcccacctcggaggtggctgtgtcctgtctggttctgcccgtgagaaggcgtggctccaagtcctgggcgcatctagtgaggagcagccccgcaggagcagttattgaggtttggctcccagaacaggcaggcagtagtgattatgctgtgaggtttggtgccggtttttagaaaatcctcatccagacctatcacctgctggtgcgaaagacgctccctgcgggagtaattattccgggccgtgagtttttctcctcctagctctgagttctgtggatgacatgaatggtttcatccaggaagggctgtctccatacctgccggcaggcatgtctgctcttgaagcctggaggtaatttatgataaaaccaaagttgaggctcctccccatccctgttagatactccgacagcaggctctgtgttccggggctgtgaagctgagtttgcgtcctcaggaacctcccgcacaaggccatcctctgcctttgtggttcaggctgagggtttggactctgtctgtggcatggaggatgggcagtgtgggtcttcgtgcttcctctggcagctgtccaggagggagccatgggcctggccacagctgccttcttcagctgccccagagtagggtgaggaagcatcttgggggtggctgagcaggagggaaactggcctggccccacccactcagccaccgtcctctcgcagctccctctggctgtggatttctgttggcttccgtgttacaggttttgaacaggcctagatgcccaggagccaggctgctggtgggcacaggctccatcccatgtcagtgacaggcctcagacttggcctgggctagcacgcccctgccctgcctgcacaaatgctattgtcactgccatgcatcccgggctcctgcacctgcaggaacttggcagggggacagcgggaaatggatctggggtcattgtcactgctgcccacagaaccagccagcttccttcatgtgaattccaccctcttgttagaaaagcccgttttgtggaggcagagccccagggtccatgagtctgtgtccctcctcacccacagtcatccggcactggtgcagcagtgttcccctggggccaccctccatgagtgtgccacaagccttgtggatgcacctgtgacagcacttggggtcccctcattggtgagtggtgattgctgacctccatgtctgcacctggggatagaactcttcccatgtcacaaccttcagaagcagcacggtggcacaggtggccctcctgggcatcccagctagggcgaagtgcaccatagctacttctccagcccaaggtgaccgcagttcattgctggagggccctggcggtctagtcccccacacagccaatgtctgggtggctggttgagtcggagcctggctgggctttgctggtgctgttttactttcttactgtccatcccagcaagataagaggggctagatgcccttcgtggggcctgctgatggctgtggagactggcgcatagactggacagtgggaggcacatcggaaagccgtggtcctgggaccctatcagcagaggtggcagaaaggcctcaccaccctcggtgcggggtcctgatgcccgctgggccctcccctctgggtggtgagcagccgtggctgagagcatgctgcttttgcaaaaggggtcccagcttcaaggctggggaccgaagttcctcctggatgcactgtgcaaacaggggacccctcacttctgctaggccagcatgtgactgtggggctctcggccaccctgtgctgagaggtcgcagaggcttggggatggcatgggcacctggtgctggttgaagctgggcaagtgtcatgatcccacgggtgaaaagactccagagagtgtccacgtgcccgggtgggtctaggtcttagcagccaggatgacccgtccggtgaggatgcagccagtgcgtctctccccagtgttggctgattcataataggctttaagcagtccatatattttcagcatgagctggagtctttgaatcatttatcttggcagctcttcttaaagctggagaaaggtagaaattcatctaggtgctgagaaaggagcccagaagaaaaaagtgtctggcggctgccgtgatgggtggcgtgcctggagatagtgctggtggctccgagatcaaacagatgagaaatggcttcccaggaagaactcggggaattctaagtaggtaatgagtagtgactgtcttttgatttacggcaagacttggcaatcaatctgtaatgctttgaagaggaaagaaatgaatcccgaacaggctgcggggtccaggtggtttggacaggcggcccttccttggtggtgggggcaggggcaggcaggctagaggtcgtggatttctctcttctgccacggggaataattcaggccgctcctggtgggcagcaggctgtggccagagctggcttgggggaagggactcatcacacctgtctgatgtcctctgaggtcctggctttgagcctggtgggactcgagttcagagctcaggtcatgggcagtgcaggccctggtggttcacacactcactggtggatctggggtcctttcttccaccctctggcctgaaggtgcctgtgtgagtgtgctagggctgccccacaaaagaccacagccttggtggcctaagcaacagaaatgtgttttctcacccttctggtggctggaagtccaagatcaaggcatcggcagggctgctactctctgaggcctctctcctgggcttgccgccttcttgccatgtcctcatgcggcctttcctctgtgtgcacgcatccctggggtctctctcatatgctcagatgtcctcatatcaggacaacagtcagagtggattaggcctgccctaatgtcctcagtttagcctaatcacctgtttaaagcaccgtctccaaatagtcacattctgaggcactgtaaattggggctttgatgtataaatttgggggaacactgttgagctgattaaaatagtgcatttggtctctggagaaacgaggcctggtgccttatctgtaggttcatacatgctgattcagcagcgaggcagcaggcagcccagtggacatttcctgagccctgaccatgtgtcagcctctggtctgggccctctgcatgtgtgtagttaaatgagggacaagatccatttaatcctcgaagcaaccctctgtgtatgggaccattgaggaggctgagtaatccatccagcatcacactgtgggctaaagggggaggcaggatttgaaccttggcgttggtcctggagcctgcgttgcacttcactgtggtgacctccagctttctgaagggctgggctggcctcagcctggacacacagccaacatcccaaagtaggagacagacaagtgggaggattacacactgtgataaaatgttgtccaggaaaatggggtgacccttgagctgaggccgagaggggtgaggatctccggcacttgccacgtggagagagacatggtggatggggtgtggcgggtaagagaggagtgggccacacagccaggtctccatgagacactaagtggtttctgggagctggggagtgcctggcccagctggggcttggctttggggggtgagtggacggaggtggctgtggggaggacagtgaggaggctaccatgggggcagactggtaggcttggccatgggagggagggggctggagggtgagtttggaggtgaagctgagagcgctcacctgtggattggatgcagggggtggaaggggaggaggaggggccctgagtccccaccacccagtggcattgagccagtgtctagactaagtcaggccccacatggcatgcatccgctgcctggccccttactgggacacagccggggctgtatcagtcgctgccttttccatcccagcctcacagtcgctgtttcctgcttaaacctctgaggctctgcccacagcctatgcttttatgaagtccatgattttgaatggagagagatccccagggtgctggcgctgcgctttctgtcccagcctggctgggttccatgtcccagccttgagagcatgcatgcatgtatgtggtgtatgcgcttattgcacgcacccctctccctgcctgccagaggacatacagcgtgtgtgtgtgcatgtgcgtgtgatatgtacatgcattacactcttctcgccctacccgcctgaggacacactttgtatgtgtgcgcgcacccatgtacgaacgtaagtgcgtgtgatatatacacccattacacactcttctcaccctccctgcctgaggacacactgtgtgtgtgtgtgcgcgcgcacgcgcgtgcacttgtatgcatgcaagtgcatgtggtacgtacacccattacacactcttctcaccctgcctgaggatactgtgtgtgtgtgtgcacgcgcatgttcgcaagtgtgtgatatgtacacccattacacactcttctcaccctccctgcctgaggacacactgtgtgcttgtgtgcatgcgcatgtgcgtatggtacacccattacgcgcaccccctcaccctgcacctgcctgtcagatcactcctctttcagcccattcatttgttcagcaaactttttttttttttggaataagagtttaaaaggcttttctttatttgggttttcaaaaaatttcctatctttgacttgtttttatgtcgttttctttttaaatttaaatccttaaagaaatttgccatttatcatggcacatggtattgtgtacatggcaattatgttcatacctataaacagcaattatgtaggaaatagaatcataaataagcatataatcttatgaataaatttaaatgaataataatttttggttttctatttaaatatctttttattaacttgttcagtcatgtatcaagagtggcaaattacaatctcacattctccccaaagtggaaaagaatccaaatgtccaccaactcctacacggataaataaagtgtggtgtgcagtctagccatacgagggaatagtattcagtaatttttaaaatgaagcacagggacatatgacagaatcgatagatcttgaaaacatggtgttcagtgacagaagtcagagagccacacgctgtgtgattccatttgtgcaaaatgtcaagaacaggcaagtccacagagatggggcaatgagcttccaggaccgtgggggagaaagcagggaggagtgactgcagatgggtaccgagtttctttggtgggtaataaaaatgttaggaaattggttttgtcagcaaacatttatgatgcacctactgtgtgccagatgctgttctgggccctggggaggcagcggtggaggaaaggcccagcccccgtggagcacagttctgtggggagagccagtggacagccccggtggacgttccccgaggcctgaccacataccagcctctggtgtgggccctgcacgtgtctataattaagtgacaggtaagatcggtttaattctcagagcaaccctctgagtaaggggaccattattttatttatttatttttaaatttttatttatttaattaatttatttatttattgagatggagtctcgctctgttgcccaggctggagtgcagtggcacaatctcggctcactgcaacctctgcatcccaggttcaagctattctcctgcctcagcctcccgagtagctgggactacaggtgtgtgccaccacgcccggctaattttttttttttattttatttttagtagagatgggttttcactgtgttagccaggatggtcttgatctcctgacctcatgatctacccgcctcagcctcccaaagtgctgagattataggcgtgagccaccgcgcccaggcttttttttttttgagacagagtctcactctgtcacccagcctgaagtgcaatggagcaatctcagctcactgcaacctccgcctcccgggttcaagcaattcttctgcctcagcctcccaagtagctgggattacaggtgccccccaccctccaccatgcccggctaatttttcatatttttagtagagatggggtttcaccatgttggtcaggctggtctcgaactcctgacctcaggtaatccacccacctcggcctcctaaagtgctgggattacaggcatgagccactgtgccaggcccagggactattattaagccccttttacaggtgaggaacaaagaggctcagtaacctgtccaagatcacaccacaagctagtgggggaggccaactttgaaccctgatctttggccccagggcctgtgctccacttttccatggtgatctctgccccacagaaggagacctgcttcttccaacccggtagttactgtctcagtgcagggcactggaaaggcacagttgtcttgcagagaagttctagttttaaaatacccataaaaaggacaaatacctattgcattatgaattatgatgacaaatgacatgttaccagagtcaggccagctctagtgaggaagaagtttctgcctgatgaagtggaaagagactgcctgggaaggggctcagatcccccagccacctctgggtcaaggtcggcctcagccaggaagccaggggccattgctgcagccccaacactgttttctctgtggcagagtcaggcatacagcaggcgctcataaatgctcctgagtgaagggaaggaacagggctgcctcctaccctggtggtggggaaggaggactgggtgggctcctcactcagccctccagggattcagcctggctgggcgcaaagacgtgcaggtctgagcaaggtggcggcctccccgggactgtgcactcttgcaggcggccgtatttcctggggatgtggtcaccaaccccagtgagcctgatagcccagtggttatcgaggaatcaggtctgcactactgggctggctgataaggggcacgtgttggtgttgtaatgaggtgcatgtggcaaccgttcccaggtggtcccagggccaaaggccagcctcacccgaaagatgttaaatgccagggcgtgtttctgaaggtgccatctcaggaggccttggagagccagggctgagctccctgggcttggtggagatagtagaaccaggctcatcatcccttcaggatcagacatcgtttccagatgccataggtggggccagaaccatctaaacattacctgtagggttgtccatttcagacaactccaatttgaccattcagagggtttgcctggagtacagcttgggtctcccgatcctctccctgctcccggccaagcaggctgatgggtgcccatcatgcaccacccatcctgggaagtcaggctgcccatggacctgccctgtcacctggctggtgagtgttcgtcatttccagcctgccagtgcccctcaccggattacacacgtgctgagtaacaacaggtgccaggcactcttctaggagctggggagacacaacagaaggaatcccatctgtgaagctctagaggggaaatcagtcaaataaagaagtaaaatacatagtgcattcaatagtgaccaggactgtggaaaaataaaagcggggacggcagtagagggagtcctgggagtgattgacagtgttgagtaggatgatgttgaaagccttgcacagagcggacagtcaagtgagacccaaagtgggcgagggactgagctctggggtgtcagggaacagaaacagccaggagactcgggcagaggagaggactgaaggtgggaggtggggccagagaggtgaggggccgagcagaggagggccacggtccagctgtttggctactgtccaaagcagagatggaggggccaggtcaggagcagcgagcccaggaggaggctcctgtagccctggggttggagtggatggggaaggagcaggcaggccctgggtaggttgtgaaggcagagccagcaggactcagcagcccatcagggctgggtgttgtgggaagagtccaggatgactccaggggtctgaatttgagcagccagaaggatggagctgctattgagtgaggtggggaagacagggagaagagtccagaccccttgtgcctggggaagttgaggcagcagagggatgaacagaagagcatctggggagaggttcagaggttcatttccagccaggatcactcgtcttgcgcaggtcccagtggttgtcatttagaaggtttagaaacgcttgaggaaaagccagtgtcaaatcatttaagaacctctctggcagacacttggctcacacctgtaatcccagtactttggtagtccacggcagggagatcacttgaggccgggggttcgagcccagcctgggcaacacaggaagaccccatctctacaaaaacaagaacctttcttggaaccccaccttggaaagtttggcatttgctccagggagtttataaatggcatttatcagccttaagggtggcagcaccctgtaggttgtgatctcatttaatcacaggacaggctgacagtcgggggtgccagccaccccacacgagctggggacagcctcttcaggacggtgctgggctgtgtgacccacagacactagaggaaacccctgtggtgggcatccctcagccggatccttcccacctggggtgtctcctttgctgagagctcccaaggagctaaagcaaatgacctgggccccagaggcattgccgggcagccctgctagtgagagcagctggggaggctcaatgaacctcacagccagcccacaccagaggccagcccgccctggcctaggcccacgcactcccaggcccatgtgcacaaaggggaggagtctttactcggacccgcctatgcctgaggtctggcccctctgggacaggatctgcaggctctggtgctgctcctcagggtcctgccagaagtcagggccaccaacagccaggacccctcggctcaggtgcccagcccagagggaggcagggggcaggaaggccaggaggcacaggactaaggtgctagtggggcaccctcagggctgtgatgcatgtgagatgtgcccaggttatgggagccctgtccacgtcgcacttttccctcctcaggggaagcacgtggggtaaacagtccatgacgtctcaagcagcccctccaacctcgactccatgtcctgtccttgggcagccacttctgcactgccagggaggagaactgtgccactggcctggccttgagcataggcccctgtttgactagaaggcacgccacctgtctcttatgtcccagcactttgggaggccaaggcaggtggatcacttgagcttaggagttcgagaccaacctggccaacatggcaaaaccccatctctactaaaaatacaaaaattaactgggcatggtggtgcgtgcctgtaatcccagctactcaggaggctgaggcaggagaatctcttgaatgaacccgggaggcagaggttgcagtgagctgagatcgtgccactgcactccagcctgggcgacagaatgagactccgtctcaaaagggcaggaagcactcctttgtcccagggttgccattggttggtactgaggtgtcacagttcagctccgaggaggagaaagcttggggagaatattttcctcctggacagctgcccctgccagggttgggctgtcggcttccagcagaaccctgcccgccccccatcacctcagggccactccagtcctgggtagtggaaacactcaccgttggcaagactgggggcatagagtgccctgacgtaggtcttggcatcagacctcataaggcaaagggcaggggagagagacccttggacctgcctcttctcttgatgtcccgcagttggcattttctggcaaccacaagagtcaccctggtctggctcagagaagagatagccagctgtgttggtctggggccccctgcagggcaggattgtaagatgggcattgttttccctgcagagtgggcacagcctgtaccctgggagaactgtggggagtcgttctgggcccagcaagcaggtggctctcttctctctgtgcccagctgagggtccatgctagaaacccagcaccctgggtctgccctctgagatcccagctgggttcctggacatccctgcagcctgtgtctgggcagggagccagctggtgtgattggagggctacttccaggagcccaggagaattgcccgtggctctcatgcaccggctcctgtttcacggttagacatttcaccacattgtccttcctgcattgttttttctgtccctttctctggctctgctgtgacttcattgttgctgaggggagagccagggtgtcagactccatgtgttattcagagtttggaccctgcctcttccaacaatgagattatgtgccagaaactggcgagggttgagaaaaatggcctgaactgcacggtcggggcgtgcctttggaaatcactgcctgaggcatttctgacaccaccgcccccccaagtctcctcctaatgacaccacctacttacctgtggtgggcagtttggttggatttattccaacgggctctctgcacttagcagttgagaaagatatttgtcatcttgctataaaacatcaaacgcatcatgatctaaacgattgtgacagcagagagttcaaccacagtctaaaattttagcattatttatgatgcttagaggcttggtgcctacagtatcttcttaatctagtctgattctggagtgctgtctcccaggcctgcccccgtgtctcctctggctgttaataacagctcctccaggcgccctgtctgccgacacaaaatccatctgaacccctgcatctcgtgtggctgttgaaaattggcatttctttattgatgcaactggttcctgccaaatacttggggacaaataaaagtagttgaacttcgagacaagcagagaaccatttgttcgtggaattgccagccaattgatggaggtagttaaactatcgtttagaagactcttgaaaggaaaaagttgactgttttgagacactaacattcagagtagtgtgcagagccaggcaacacagcttttccgagggccggagcccggtggttgggggtggtgtgtctcttctttaggctcctgggccgtgttctcagagacccccacttgttttgcttctcccgtggcccctggagcactggctgctctgcctggttgctgctcctcttccgtgccagcttctctggatttcccactttttctttcctcctcctccaggaagtcttccatcaaaccctgtggcttctgcctcatcggactttaacgctcttgtagttaagcaagatctccctcctccctgtggactaggggcctgccttgctagtgctgtgagcgaggcatcacatggctggtgctcggacccaatgaaccggccccaggggcctctcttcgcacccagagagctaggcatgctgactctctccaaccaattcccttcctggccctcccggaaggcaggggtgggcaggccagtgaccccagagcgctggctcagttctggctcagtgcccatgaggtgattgctttagaccagcagcaagtgtgggaagatggaggaggtaataacattgattttcccataaaggtggaatttgtggtgagaggaccttcctggcaggacctaaacatcttcttctcccagcccctctgcccctgcaggggagtggggtgggtctctcgagtgcggcctgccaggcaggaacttggctcatagcccatgcagccatgcagccttgcagcccaggcaggactggagccctcagaccaggcccatcatgatgaggcagaagcacccctgtactcggccattgggagatgctgaggacggctcccgcctgcctcttaggcagggcatggggcctgctgggaaggctgcctggtgagtaccctcattccttctcttcctcccatgcttctttctcttctcactcctcctcttcttcctgctcgcctctccttctctccctcctctccctctccctctccctcttctctttcctcttccttctcctcttcctcctctttctccctctccttcctcttcctccatcttccttctcctcccttctcccttcttttctccccgctctcctcctcccactcctctgcttctttctcctctgctcttctaggccaaaagcagtgccctgaaaccaagatgggggcagagatgtcagagggagccctgggctgcgctaacctcagacccatattctcctccagcagctgcccacacccttccctgctcaccgcttcttggaggccagtatgcctctcccatgcccccaccttccaccagtgtttacagccctgggaaggccgaggacctgctgagagcctggagggcaccccctggcctcagactcacctgagcatcccagtgaccaatccagggacgccatgggagcgtgggttgggctgcacggcctctgcccatggccctgggaggttctgacacccagtcctgtcgtgattgagaactaacggccatacgagcatcagcagattctcacacagtgcccagaggacaacagccaaagcgtggctgtcactcccactttacaagcgcagcacctgaggccagagaggcgtgctgcagggcccagggaccccagcaccagggcaggccctgctgggaccgaacgaggggggttggttctggaggggctgttgtccccagccagacctgccccagttgtccttcgtctgggctcggcgcccctcacctcctggcacctgtccctgccgaggggcccgggcagccggaagtgacagggaggcagctgatgagtcactctctggggcctcagccgggcctccagcttctgttttccatcatgttaattacatttattattcatcaactgctaaaactggctctgggtcctccattttccaagccctcaggttgcgtcccagctgaggctccctgtggctttgagtcgggatcagacgccggcccagccgaggggcctttgggtttggaaatgaaaacaaaggatcccatcctggtggctttcgggcagccgcgggtggccaggcctttgctctcctctgcctggagatgccggatggatgagggagctaccgtctcggccacctcatttggcctccccagcgcccaaggttctctgcctcttccatccctcgtcttcctctggcatcgcattccggctcacactttgatctttcccgagtccctgggcatggaggctgctgtctacccagctgccttccctccaggccgtcctcaggggtttgtacctgccccctccaccccaccaccccccaaccttaacacctgagtgccctgtctcagtccttcactcccagaacagggagggtcagggaccgaggagggctggaccgtatgtgtgatgtgccaggcttctgctgctccacctggctgggttctggccccgttcccaaggcccagtgaccacccaaagggcgtgacctttcccagctgatttggacaccctgggtggcagctttctccccacccagtaaatggggttgggttttactgccctttcctcattcacgataaactttccatttctgtgaagttcacccccgagaccaagggaggccagatgcgccctcgtcctgcggggaatcctgacattaggagaaccccattcccgcctgccctgccagggatggtgcagtggaggaatgcccagtagcccctgggcctactgaggtgccccgatgcctccagcctaggcccacaaagtgatgagcttcaaagtttcttctctgccaggggggataaaaaagcagaaaacagagatgctagaaccatcgccgttacacagctggcagcgtccacacaaaaccaagcattccatgcctggcgccccacactccccctttgcctgccccatgtgcaccggagacacatgaggtgggggaggagtctagagctggggagatgccaagcctgtgtatggcgggtgggtaaactgtgggtgtccatacagggagaactgtcgggcagtgaaaacgagcagattgttgccacagtcagggacacgaacagcgctgaaagtgatgtctagcaaaagaagccaggctcagaaaggcacgtaccatcccactgacataaagttcccagcaagcaaaactggtgacagaggaggagaggggaagagaaggggtggtgagcgaaccctctaggagacaagaaatgtcctgggtcttcacccacggggcacgtttgtgagatgtcatcaatctgggtatttaagatgggtgtggtttactggcatatattttgataaataggcttgcacacacacaccaaaatggccaagcattgctcctgcggccagactccgggcagaaacgctgtgcatctcttgacctgagtggtcctcctaacttgcagatttacagacatctccagagctacagaccgacacggtaaaatgaccatttgtgcacttgcagaattattcggttggccgatgacagaaagaaaatgaaaagttaaatgcaatttaaggaagtatcgcctgggctctctgttcaggccaggacctgaatatcgagtctattagaagcaattataaaagggacagcgcttcttaatgtttctcatttgacaagaaggtttttaaatatggggcattagttaataaaaagaccccaggagcccattgtaatatattacctaattcctaacagttcatagccactgaaataggtaaaaaaggggatgtaaaattaatatatggttattattaaaattgccttataaattagttaagtcccctggaggtacagagtgggcatcattattccaagagtgtctcaagggctttggtgtaccttgtgtgtttgtggagtgggcgtgcccccttggcagggagaagagagctctggctctgcagtttaaggagaaaacagcagctcacactgaaagagaggagagccagccatcagactgcagacattttataaagaaacctcttccttagtgaagttgctggggaggctggcactttgaggcatcacccagcatgttctgtgcccgagaccagtaaggccctgattgacatggattgcagttgattagggacaacatgcaaatgggtgtgtagctcctggggccctggggaccactggcttgttcaggaatggagggatagaaacaattcccttaaagtgttttcactcaagggaacccagctgcaggcagcatggcagtgagggagcctgtcgctccaggccagccacacccgctagctgctatagccgaggaggccgaggtgcctctggaaggcgtgtgcatgtgacccaggccatgtcactgccaccatctccatccaggctgtgggtactgggagcccggaagcgccaaagcttccaactttgccatgcgcttgtgcctttaattgggggatttcaaagctgtgagtggaaatccattcagatctgagctgtttgctgaatccgagatttctgtccagggggatttggcgaacgtaatgttttatgcattctaggtgatttgcccatacctgctggatctgttcatggcagcaggctcgtttccaaggaacagcacagtcctcctggacaaagaggcttcctcctgctcccaggggagagagctatcatgtttttttccagtgagagcaccagagggaaatttgctttttcaatcggctcttcagagctgcgggttctgccccatcctgtctgcagtggaaacctgagctgtcggtgttcccctggggtggggtgggctccttttgcttgggtgggtggtccccagggtggggtgccccgtgtggggagtgtttagccagaggagacaagcaaggctgttttccaaccagtctctgacttctctagctccctgtgcaaaagggatacctccgtgtgcagacagaggttttgccaaagaatctgattccagagaagaaggctaagtgggctcctgaagcaggacttggcaggccttctaggggcttggattctccaggctgcataccagagagccttgccgacagagcttgcttccaaacctgccggtgcagtggagcagctcaggagctctgggtggaggaagggatagggctgcactttcttcccagagtggcccttacctgggaagacttcttagcttcagcctatgactcttagactcgtaatggtcactctgggtttaatcttcccttttttttttttttttttgaggtggtgtcttgctctgttacccaggctggagtgcagtgtcgccatctcagctcactgcagcctccgcctcccaggttcaagcgattctcctgcctcagcctcccgagaagctggaattacaggcatttgccaccacacctgcctaatttttgtatttttagtagagacagggttttgccatactggccaggctggtcttgaactcctgacctcaggtgatccacctgcctcagcctcctaaagtgctgggattacaggcttgagccaccacgacctgcctaatcttcccattttgatcatgaggccaggaagcaggaaagagtggtccctccactagcatttgctacccatcttcaggcagaggtgctgccagatgggtgttaattgggaggggagtgtctccgaggatgtccttcccaggaagaatttttccccctgtggcaaaaaggagaggtagaaagtgggagataatgaaggaaacatcgagagtggaatttcagatgctttgtcttgggcggaatgaagagaggaaatctttgctttgttttctgtctcctcttggggaaatttcccacatgagttttgggatgatgaagatgggcccccagccctggcctccggcggggacctggacattcagattttgggtgatttcaacccatggtagagtttcctgatagagtcagggaggaattgggcttgaattgcttttctttcttttcgtccctctcttccttccttcgggaaggaattgggcttgaattgccctccttccctccctccctctctccctccctccctccctcccttccttccttccttccttctttccttccttcctctctccctttctctgttcctctctcccttcctcccttccttcataggatcttgctctgttgcccaggctggggtgcagtggtgcgatcatagctcactgcctcgacctcctgggctcaagcagtcctcctgcctcagcctcccaaagtgctgagccacagcacctggctggattgcttattttttactttgtccacaacaatggtatcaaaacagagatacactgtggttccttcagccaggctgaaggtttttcaaggagctctgtgtgcgtggcagacggcgtgcacttgcgacctctggtggcagcttcccagtgtcgtcctcggtggcagctgtgcttggggagtgtgcgctgtgtccactgggcagaacacatcaggacaagaagccccctggggccagtggggcgaggctggggcgaggggagcaggtctttgacaggtagcttttatttcttcccaaaagtgttttcaaaatgaaaatagctttactctgataaaaagatacatatgccagtaggaaatccagtcagtacagaacattataaacaagataggaaaaaaaccctttgatgcagaggcacacaaaaccttattgctgtagcaaacaggcttccggtctctctggggcacagacagacgggctttgatctgctgggctcacactgggcagagtttttgcagcggaagtctcttcctggcagtgaactggggcacactggggctgcatcataatccacttacccagactgcccccggaagccaggtggttcccagtgtgaacgacacttcgaccgtcaaccctacctcgccgtctctcgggtgtcaaactgaccgtgtccttggggtaaactcctgcaaatggaattgctggaaaaatgttgatgcccaaagcccagtgccatctagaaaagttgttctcccttcacggctggggctgggttagtgtctggtgagcagataccatgtccttcccggggatgttctcatttaatcccgtgagggggagcggagaggagtgtggcatcctctctgcattatagagaccccacagtagacagatgggtcttagaggagccaggtggcctctctccagaagccatgttctcagccagcgtgcaggacacccctcctcccaaaccatgagtgccggtgtgcccacccaggcctcaagattaattgtgttatttccattattcacctttatcattctgattagggaaaagtaataccccgtctttatttttgctgatttgattactgacgagcttaaacttctcttgtaagtatttcttgggcatttatctttgtgggttttcagtcctttgcccatttgcaatcgggacatttgtgggtgacttattgctctgtaattgggctctttgtactattgttctgtgtgttggaaatatttttcccaatttgatgtacagaaattgtaaatatcagttgtcatgttggtcctttcctgtatagtttatgcctttgcgaaattgctttttctactacctcaatataatccagttatcagcatgttttttctatctttatagtctgatgactttcttttaaataacagtttttgcataattatgaaatatttcaaacactgctgtgtatagtttaatagatatctgtgtatccacatggtttcgtcttttatatttaatacgttaattgagctaaactgcatttaagaataatatataaacaaggattctggcttttctgcccccgcgtaattactaagtgacctgttgtctttggagtaatgtctttgccccccattgtaaaattccatttttgctgtattctaaattcccaggtgtattagtcagtatagggtagcctttggggtggtaacaacagaaacccagatctcggtggcttagcacggtaaaggctcatttcttgctcatgctgccatctgtggctggcccagtggctctcctccagcagggatgcagggctgcttccactgcccaactctgccccctctgagaaggaagagagagaacatgaagaattcacacccactcttaaaagccatggcctggaagcagcacatgtcatttcatattcctcttgggatgagagtcagtcctatggtcccagcctagctgcagggaggctaagatatgtgcccagaaagaggaagcagagtgaacacagggctagatctccactcggggctgcctgggcagacagggtttcggctgcctgtggatgtgtgcgtatatgcatatgtgcatgtatgtgtgaatgttctttggattgttgggcatgttcaggcctgctgttcctgccatccgttaccctttcttcacatgtttactgaggacctactgtgtgctcatcactgtggccagccttgggtatgggtgacatgggcctgcctctaggagtgcccttcaagactgggagggaacgggagggtgccaggctgaaagttctgcagtgtagaagtgtggggagggacttgcctacagagggcttttggtggtgagaggtgggagaagccccttggggaacccagggagatttctggagaggggcgtcagcctggcgcacggtggttttggatggtaactggcggtgagcaggaggtggagcgtggacatcctcccagctcctgaagggcagcagctgccaggagtccactgagacccctctagccatgacctcctggtgggaaggtgggccaggaggggacctgttaaagactggcaggtggttgagggtcagtgtggaaggtgtccgatagaaggtgctagaagtgggtgggcttgggataggtgttgctgtgggtcctggaagagggagctcggggtatgctggacaggtgtgtgatgcctgggctccctgcggggacccagcaaagcacatcaggaaacccggcatccacgggcgtgactccctcttctgcatcctccaagccctccttggcactgtgcgaattttctaaatttcagtgggtggcgctggcgagatgcttcagagtgtgtgcaggctggcgagtaaagtcaaggaacttcctggctcctggctatgcaggaggggggcccagaccctcatcacataacgaccacttctgtcttcaagcgtgtctcttacaaggtgggggccaggagagtgctgcccagagccagtgctttgccatgatcagattgccgcctgccaggacgggggtatgggttgcctacaggcaccgtcactgctgcacggatctccgggagcaggcttcacacacacaattcctgctagcaatctactggctttggggagtagtgttggtgtcataaagaaaggatatttaactttgcatcgataggcaaagaataattaagatataattaaaagcacaaattcttctaattattggcttcgtataatgtatatttaaaaacaagatctgttaaggcttccttttgaatatatccagaagccaaaagagggtagcattttaattaaaaatggattatttaaaaaccagtttaatcatcctgtcatccaaagacttagactttattaattagctattgataaataggtttaagctaccccaaagttgaatttgcaagagttattcctggcatcctccgattggaggattttttggaacttgccctgtgtctctgggatgtcagcagcaaaggtttaggacatgtgagttggttcttaaatcgcccctcccatcctctgtggagccaaagtggacatcctgctgcaggtggggaccgatggggggctcctggggctgtcccacttcccccatctcctacctctgtgctctgtggcacgagagggtgctgaggacctggatggtggcatccgcactgagaggtccccgatggggcacaggtgcagaacatgctagagatgccatgagccacgacagcctccgcctccccagctccatgcttggagtgcatccctggccaaggcactcctcttctcaaggctgctctctgtaggggcggcgtgactgccacccccattcatcatcttaagtagataaagactttcaaagtgataaatagcgttcctgttgttccttcagccaagtgtgactaaaataacgtttggagtcgtgagtgaggatggaaaggctcattagaagaggggttgtcggcagttcacgcctaacagccggttcgctgccataaaacacagccgcacgcggtggaggggccctgcccacctagggcctgtccaggctggccctgacagatggtgtctgggcctccctccatggcacatttcgctgcgtcctgggccttgtggttcctggatgcttggaagaaccttctcagagaggagacgtctttcacaggcatctgtggtcctcgcttcctgcaggtgctggggatctggggctgcagtgacccagctcctcctgtttcctcagtgacccagctcctcctggttccctccagcctaatggggtagccaaggccacctgctgcgcagtgaccactggcttggcgctgcctcccgggtgaccaggtccctgtatccagtgtcctgtgctcacagtaccgagagtggctgtgagtccatgtggacagactgcttctcctctcttctccagagccctcagcagaggacgatagggagggaactgggtactagaccctcaggatgaactgagtgagttgcaggggctgcccagagctgggcccaggtgcgacagtgctttagaaagacattgataggaaacagcactttccagagaaagttagatctgaaacgacacatttgtgaagtattttcagattgtaaggctgaaaaagcaatttgatgtttagaaataaagtagtgctggactctttcaagacaaaacagaaaaatgccctagagggaatccaaagcaaagcacttgctttttctagaaggggtgacttggggattctgtcctcactctacaaggtgggatctgggtgactcccactgttgcccaggctggagtgcagtgacatgagacctgagatcctctgccaaacatgtgttccctaaatattgaacctgggcctggcacagtggctcacacctgtaatcccagcattttgggaggccgaggtgggaggatcacttgaggccaggagttcgagagcagcctgggcaacatagcaagatgctgtctctacaaatataaaataaaataaaataaattagccaggtgtggttgtgcacgccagtagtcctagctactcaggaggctgaggcaggaggattgcttgagcccaggagtttgaggctgccatctggggacttggggagcttctgaaccaaaggccttgcccaagaacgaaaaaccaggcttttcctcaaagaagccttaaggcgggatctcccagagttagtcattccatgagacaccctggcagttttggtcaagttcttgtctcacctctactattatctgcttaatcgttttctttcaattgactcattttttttcctttaaatatatgttttaagatgctttttatcctcgtcatgaatgaaacccaatctaatttgccattaacagacattagcgcttcaagataaatacctagtgcatgaaggaaatatgctagtggggtactacataatgtcatcccgtggactcgtattgtgctttgggaaatgtgaacttaaaagcagccccttccctccccttgcccctgctcgcccctccagaaagctccctgcatacctggcttgcttcccccacaccttcctggggaggatggagacagggtgccagcgttccttagagggacaatgtggcctctgggttgtgttgaactaggatcatctgccactctggcaagcctttttgtttgtttgtttgtttgtttgttttgagactgaatctcactctgtcgcccaggctggagtgcagtggcgcattacagatgtgtgccaccacgactggctaatttttatattttgagtagagacagggtttcactatgttggtcatgctggccttgaactcctgacctcaagtgatccacccgcctcggcctcccaaagtgctgggattacaggtgtgagccactgcacctggcctctggcaattctttttgtttcctggtcatgtggtttgagcctctctggatgtatctgagggtaacctggtttttattgttgttgttgtttgtttttttgtttttttaaagagctggggtctgatatggtttggctgtgtggatattgaatcatgggggtgctttcccccatactgttctcatggtagtaaataagtcttatgagatctgatggttttataaggggaaaccccttccactggttcgcattttctctcttccctgccaccatgtaagatgtgacttgctccttcttgtcttccaccatgattgtgaggcctcccaagccacatggaactgtgagtccattaaacctcttttcctttataattactcagtctcgggtatgtcttcatcagcagcttgaaaatggacgaataccgggtctcactagattgtccaggctgggcttaaactcctggactccagcgatcctcccgcctcatcctcctgagtacaccatcacacatgcaccaccacactggccttctggtcctttttaaaagggggagtttttgttctagggccaagaaaggtgtcatctctacagtcagcatggattagtgagattgggtcagacgcgaacaggtgtggatcccagaataagtcagagaacagttggccaatggtgcttgtgtttacacagctcttcccaggccttccaaagccggagctccctcgctggctcaaggtgccaaacacaggtctagagtcacagcattgcgaatttccctcaaggcgggtactgcgagctttgaatttctttcggttctgtgttgtcagcctcccaggcaccagtcaagttctgcctctggtgtcctgtccttcttcctgggaatcagtagagaaggtacttactggagggggtcactgcagggccagctgcttggggagggggtggacttgccctgaaagccccagtgagggcagtgggaagtcccagcacaggagcaggtgacaggcgcagcccccaaccacccttattatgtaaaggatttatctttcaacaagacggtgctccaagccagcgcacaaggggcagttagtgaaagcaaagaaaataatcaaatggcattctgcctcatgacctacatcacaataaattctaggttcattgattaagtaaatgtgcaaacaggaagcccacaaaagatgatagagtttatataatcataggggtagggaacgacttcttaaaggaagaagccataaagaaaaaaatgtaacagatctagccaataaaaatgtaaattatctgtccagaaatgccataaagaaaattaaggagcaaaggggaaacttgttacataaatgatagtcagatccactgcctgtgttcttcctgtataaatcccttaaggatcaataagaaaatgatgaacattcgcagtttttaaaaaaggaacaagccattcagaaaggaagaaatgtgaggaagtagacatataagcatattaaaatttgtcagttcatcagtgaaacagtgaaatacttttgtgttttacccaccaggttcccattcctgtgggcagacgagccttgcagtgtgctgctcaggaccccaaaatccttatgagtgttcaggggtcctttttgcagaacatgccctgagaattggaaatgtgcatttggtcaataatctcccttctaggaatttagcccgaggacagtgaagaggcacaaggccatgcgtggccatcatacagagaggcagaagaagcctccatctctaacagcaggaagttggttaagtaaattagaggctgtggtgctgctcatacagccattcacttattcagtcactcaacagaggtataccaaagacttctgatgtgccaagcactgttctggtctcttgagggatactacagtgaacaaaaagataaagctcaagcctaatgggaggctagagatggttggatagatggatggatggatggatggatggatggatgataagtaggtaagtatgtaggctgatatagatgatcatcaccttgatagatgatggatggatagataggatgatggctggatggatagacgataggtaggtaggtagacatagaaacagataattgacagagtattggatgagtagatagagtgataaatggatagatgatacgtaggtagatacagaaatagatgattgatagaggaatagatggatgggtggatagatatagagagatggatggatggatagatggatagatagatagatagatatagaaggatggatggatggatagatagagggagggagggatggatcaatgataagtaggtaggttgacagaaatagatgattgatagagggatggatggatagatgggtagatggatggtagatggaatggatggatgggtggatggatgggtagatggatgataggtacgtaggaggtaggtagatagatgatagagggatggatggatggatgggtagttggattgcacttaggtagataggtagatatagagtgatggatggatggatgggtagatggatgataggtaagtaaatagatgatagatggataggtggatgggtagatggatgataggtagatgatagagtgatagatggatgggtagatagattataggtaggtagatgataggtaggtagatctagagtgatggatagatggatggatgggtagatggatgataagtaggtagatataggcagatgattgattgattgattgatgggatagctagataaacatgtcagatggtggtgagggttacaggggagggagctacctttatccagggactcaggatgcctccctgtgaaggggaggagagacctgaagggggagagagagcatgctgtggctttctggggtggacattccaggcagagagaaaaagctgttccagtggcctggtgggaacttgcctggcagttccaggagcagcgcggagttcgactaagaagacaagacaagacaggggagtaagggggaggtgggctgccgatgggaagccggggttggtgtgagcagaggagtcctgtgattctacttaagttgtggaaggatccgtttgtggagcacactctgtaggggacaagggctgaagcaggggggccagccagaccaccatcaccattcaccatccccagccaccatcgccatctcccaggggagagagaaccttggcctgcaccagggagggagtcgtggtggtgcggagaagtggtcagattctggacatagtgacagcactcactataaaaactcggccaggcacagtggctcacacctgtaataccagtactttgggaagctaaggtgggaggatcgcatgaggtcaggagtttgagaccagcctggccaacatggtgagacccccatctctactaaagatacaaaaattagctgggtgtggtggtgcgtgcctgtaatcccagctacttgggaggctgaggcaggagaatcgcttgaacccgggaggcggaggttgcagtaagccgagatcgcgccactgcactccagcctgggtgatagagcaagactctgttgtccccccgttccccccgagcccccacaaaaaaagagctggttacaggcagcagcaattagaccgcgtttgttggatcatttggtgatcacccatctgcattattcatctctgagttccctagaggcgaggctggtgtgtggcttgctcctggcccctggaacacagcaggcacttggtaaataatcgatgagtgatccattacggagggcaatctctcctttgtcatctnnnnnnnnnnnnnnnnnnnnaaacatataaaaaaaattagctgggcatggtggtgcatgtctgtagtcccagctactcaggaaactgaagggggagaatcacttgagcccaggactttgagcctgcagtgagctgtgattgcaccacttcactccagcctgagcaacagagtgaaaccctttctctaaaaataaaaatgaaaaacaaaaataaaaagtacatacatgtatctgttgataaggaaaatgttctttgctttaacaagaaccttcagtgggtcagcccagcccctgcgctggaccgggctaggctgtttgtccttgcagacttgtttcagcccagtttgggccccattcacaggtatggagaggaggaagtttcaggacagtgaccacaaagatgtgactactcagaaaacctgttgggctttgtctactaaagctgaccccccaaaaaccctgtgacacagcatttccactcctggctgtttgctcaaccagagatgcatgcatgggccccaaaagactgtacaagaactcatggctgtactacccataatagctgtgatctggaaacaacccgaacgctcacccacagaagaatggagaaacacacgggggcccacccccgcagtagaacaccggccagcagtgagaaccaaccagggactgctgcccacctagacgggtccacaaacattgtggcagcggaagcagccaacgcaagagaccatattgtttgattccatttacatgaagttaaaaaataggcaaactaatctatggtgataggagtcaggctgcccctggggaagagagactgaccaggaggggggccaggcacacaggcgtgcccaagttgtgctgggccattgtgctgtgtctgtaggatttgagttcttttctgtatgtatgtcccacttctgtaaaaaggtgagttttttttttaattacagctaatcatttttatttatttatttatttatttattttgagacagagtctggctttgtcgcccaggctggagtgcactggtgcgatctcggctcactacaacctccgcctcccaggttcaagcaattctcctgtctcagcctcccaagtagctgggattacaggcacctgccaccatgcctggctaatttttgtgtttttagtagagacgggttttaccatgttggccaggctggtctcgaactcctgacctcaggtgattcacgcaccttggcctcccaaagtgttgggattacaggcgtcagccaccacgcccggccacagctaattatttttaaaataattattaaatattaatctgtgtttatacctttaaaaaaaatgcctggaagaatgttcaacaaaatattggatagagaagacctctgggtgttaacacgatcagtgactttttttctttgtgcagagaatttctaagacttctccatgtacatataaaacataagtatattacagtctgatgagccagggctttggggacggagaaggagatagaatgttttatccgtaactgatccgaggaactccgaaactcaacctaatcaagcacgttgaaaataaaggggaagatttgttaattgaatgtcatgttatgtcctcagttatgcttaatacaagataggcaatttagaattcccaattatccaattaaaatgctaattatcttgtgccttgataaggcagctctcagagagagagtgagctgctcctgtctgttgtgtctcttcctcctgctgtgaccgctgctgtcttggccgctgcccttgcctgtgattggcggatccccccttctgggcggggcctcagcatcccaggcctctctcagaccccagctcctgctttccaccggctggcctggggctccttcgcccaggacttggtgggccagttgtccttgcagacccttttctgctcagttctggccttgtgcatgggtgcaaggtcagggctccggaaggcgttagccatggcatcacccactgccagtgtttatggagttgaagcttttccctgcatcttcttcagccttcacagcaagccccgaggtcagcactgttccagcccccacctactgacagacctgaggtttcagaggcatccgggtcaaaaccataagctttgcagtcggagaccctgcgtggactccgagcccgaacacggattcagtgggtttcctgaccccagcccgtcattgttctgactgcagcatcctctgtgcagtgggaagatccctcagcccccaaagggttgttatcatgctaaatgctgcagttgactgttcagtttttcttactggagcagctacacaacctgcctcaagcctcagactgagtgggcagcagggcctggattgaatcagtctgcccacccatccccacagtgcagtgccttgtggggctccctggcaggagctgagtagtcagggagagtgatctgggcagcagtggggctccaggagtgtgacttcatctgcttgcccacatggagatggtccatgcaagcccaagaagcctggccccatataccctgtgaccatgctggctggccttctggaagccctggtgggaaggtgttgccccaggtcaaacagtctctgtctgtgggccaggactggtgtaggagcggcaggaagagggagtgaggagctccgggcagcagagcaagctgctgaagccgagcaccgcatctgctgcagacggcctgtgtctgacgctgccatgttggtgccggctacacggtgatgctgaccagctctccgctagcaccagttttattaatcatgcatttctggctttagtccgaggcttcaggtcagtcccttcttggtgacacatcacgtgaatgcctcttgctcatttcaggcactcggagcctcagagggtgctcattcctagctttgtctgtgtttgtcgtcatgctggggcctggggaaggggaggcacgcagcagtcccccagttcactgccaagtcccagtacctgctctttggaagacctacggggaacagtgctaaaagagccaggacctgcctgggagttggggtcctggataggtcgctggtgccacccaggcggcgattccaagggtagggcttgggcgccttcgcctgtgccttctgatgacccactggtcaccccagaagaagggcgtggagcagctcccctccttccatgggaattcaagaagaatgtagtacgtgcttctggttccatgcaaaaggagctatgccagggctccactggtagaaacatccggttttggctccaagtcctccatagtagctgctcccactttggggaccataaggcacgctctgctcggcctgaggtgtctcagggcatcccctgcaggactgtatggcccttactctgaaaaggattttcccttagtaagtggtgtatcacgttaatgacacaattatggtcatgtgtacccagaaaatatcgcagcaattacttaaaataaatgtgaattataagcaacttagtgctgagacgactatacacagcacaactgcttggccccaaacatcatgaggtacttctcactctctgtggctctctccctcttatgtgccccagtcctgggcgcaccccgggaaggcggggaccctgggtcagctccgtgagggcgaggggcagctgtgaagggatggtgggcacaggccccctctgtccagccagaagcctgtctgtgcgcacgtgtcccggtagctggtgcagaggacacacctccgcgtttttgctggtgaacatcctggagatgctgggagtgtgtgggcccaggaaggacttctgtagagaacttggctgcctggagggtgcgggagtgggtgtccgggccgtggacctatgcagattctgtttggttttaaaggaatagtcaagaggctgtttctcaaagcctggcacaggatgcccacgacctcctctcctgctgcctgaggagggatccccattctccagcctccctccaggcctctgaacagtgaccacgatggctaggtcactgtacacagagctccttgggtaccaggcaccattgtgtatactccatgtatgttaaatcattcgactggcatagcagccctgggagggaggcaccgctatcatccccattttacagatgaggaaactgaggcacggagaggccattcagctggccagcagcagagccaagatttgcccttgaggttggtgttgagtcccagaaggctgggtatgtggggcccagagcagggagcccagcacagggaccggggtgcggaacacaccctccccacctcaggtttgtaaccccatgtcccaactacctgctttcctaagccctctgcccagctgagggggctccaccagctctgcgcattttcactcccaagcttctgtttccggcccagcctcccctctccacctcttgagtacctgagatccattgaggcccagccggggaaagggaatgatgtggccagggccaccccttacactgcctcactaacctcttcggcgctaccccacccatgctcgaggcacatagcttggccgacacttgctgccaggcagcccttctaccgctgtctgggcagctgcagcatttttataggactgtgactcgtcttcatgttaggtgataaacttctgagggcaggagctgggccgtgtgcccgggagcgctccacgggctggatttgtgggtcccagtgggaggcccagcgacgccgtctctggggaccccattcctgcagatctgggtctgggaacttgctgctcctgccccatttgtcatctcctggcactgacagatgtgcctgccccactgacactgcagtaactccatccacctcgttattcaccactcatgcagttcccccaggttgcttaagggctctctcacttatgcctggatacaagcctcttctacccgagtcttgcctgggagaaatttataggtgagggtgttagaggaatggccacataaggaaaaacaacggggcccacacagcagccgggatgtcgttggctgggacttaggcagaccacggcctcctctcagccaatcaggaagcccctccctgctgctggggaggaggtgcgcgctgggcttgagcctggctggggtgtgtgtaccaccccatccgccttccaggtgagcaggagggagcaggggctgttagacccagctggtccggggctgcacgatgtgagtcataaatttatggaaggagcctatggagatggtcgcagtggggcggtgacactcctgcctgtcttgctggctgctgccctctgctggagagcctgttccaggtgttaattattttgggtgggtagtagctagcctgctccagggatgacttggctggacccctcctgcctcgcacttggaggagttgtgatgctgccactgccatggcatgtcggtcatccacgggacaggctgttagcctgtcctcatagcccacacttgctcctggtcatcccagcaccacttgccaagctctggcccagctgtgcgggggcacacgttgcgtccacatcaagcatgggccccagtttggaatgtccacccctcagtgctcaccgcttgaagatcagaactgtgccgcgccgggctcacacgcttccacaggccccctgtgccgccacagctgcccagaacttgggtgcccttgtgcgtccacaccccaagcctaaagtctgcagaaaacgtgggctcgttttgcccacctgttattgccaccaaagcaccagtgtgtcctcaagttgcgtcagaaaaggtcatttaaaacaaaattcaggactgaagtccactgtgaagcatttcagctttttttaggcgggcgtgaatatccagcacgtggtgctcctcctcttttcaactccttcctatggaacagtgtgtggagttgtcaacgtggccggcaaaggtgaccagtgtcgggctgcactttgcaggtgaaaactgggtcagcctttctttagtttgatgcttctgtgagctgtgccttcttgaaggcactatttttttcttaaaaagcagcaaaggcattcaaagacagttgtctccactgagtgggttatgcagggggaagcttgctgcaggcgagagagccaagtttcctcactgcctcccctttctgatgtttttttcttgtattgattgattgattgattttttgagagctggggtcttgctgtgttgcccaggctggtcttgaactcccggcctcaagcagtcctccaaccttggcctcccaaagtgctgggatgacaagtgtgagccactgcgcccggcctgccgctcctttcttgtagaatatgtgagttcctctgcacatgcggatggcatctctgtccctctgcctgtcttttctgaagccggccagtcccagcgcagcccgtggttgtctgcaggtcacttgtcccacagaggtccgctgtcgccatcacgtcgagaatgaccatgtgacctctgaggttcgcttctgttggtgcaggaccacatctcacaaagccaagggagcacccctgttccacggcgtgggtcaggcctcttctcgggctttctgggagggcgccacagaggtgtgaagtggcttctgaggccgcctgtctggcctggcgcacagggcttgccatgtggggcactgcccttgcctgccttggtaggaacgtgcctggactgtggcgaaactcagcgctgagactcccaggagcgaggtggaagcggcctcctgagcgcttgcaccacgaatacgggggcggctgaggagaggagcatgtggctttcttgcttccctggcagctcctgaaatcctttcttttcaggaaatatttcactcgcagatacccaattatcctgtgaggtttggaaggcaagtctgaaagcccattgaatctaccacagccgttcctgcataacaactgcttaatatccaatcatgacaattatacataatttgtgttgacagtgcctagaagatgaaactccctcgtatggacgttctctaaggcaggcctggaacgtgcagggcaggaccgccatgtggcgtgcccttgggcggccgcaacgactgccctggtcgggggtgggcgggtgggggccacctgggcctgtctcacgtggtggcaggtggaccagctgtggtccggcaggaaagctgttgccgaggcctcagggagggggtgagggcagctccccacgaccacacccctcaccagctgggttcagtagaggaagaccaaggcagaatggctcagtcccttggagctcaaagatccatgcagtgactgtgctaccatccgccatcctagaggcctccccggtgcaggttctgggcttagcctggggccagggcttgtctttctctccagacttggctgtggccctacccgctcagggtgggagcttgtagagtgggcccagccagcaggcagctcgttccaaggagggagaagcaggatgtgtgccccaggccttgcctctcccacatccctggagaccaccctgccctgccccacctgcaggaggcctgtcccttgccccttctgcccatagctcctgtgccctctccccgggtgagcgcaggccgtagatccagcccctcctggcagggtgggtggtggcctctgggcacggagtcacagggaatcacttcctccagctctgcagaaatgtgtggcctctgccccagcccggcttcccacagggcgcaggctccaggagtcccatctgtcctgatgtgcctgggaagccactcgccatggcagtcagtggaggctggcgagctcctctggcaggtggctgcgccctgctgggcccccagcttctctgtcactccacactggcctctgagattctgcagcctatgactgacccccaggctgtaagcctcacagactcacactgagagtttggaccattgtggggccacggcaggggagaccatgggccgagggccttcccttggggttcatggggctcgtggagtggggtgtgcctgctctagtgccccaaccctgacgcgtctctccccctgcagcctcttcgagcactactgctactcccggggcggcatgcgccacagctcctacacctgcatctgcggcaggtaagcggggcaccctggctcccctgggggtgaccagtgggaggaggtagggcagttagtgagtggggggctccaccatcccccagctcagccacacttgctcactcacacgcccacaccagcgcccggcccaagcttggaagtcgctcctccctcccaagactcccggagctgaggtggcctctgcctgcaggacctggcactgggtgaaggagggagcatggcctgcccactgcagaggggctgcttggcgtcccctccctcctgtccccagctggtcagcacagcagctaagcacaggaaggccactcctccacacgggcacacacacagcatgtggggaccgggctgtgagctcaggctgggcagcttctgtgtgcagcaggggtggagtgtggaagggtcagtgcagaaagtggtggtggtgtgtctatgtgggtgtggctgcgtggggaccagtgctgctgtatgtgggtgtgcatgtcactgttggtgtgcctgctcgtggcacatggtgccgaggggcagggctctgtgtgggtgtgtgcgcttgggtgtgtgccatcaacacctggctgggtgtgcttggaggcacacacatggtagaaatgacagtgatatgggatcattgccatgctgtgtgggccatgcacagcggcatgtgtcccttggggtgtgtctgcccccacatgcgtcctggctgtgggcgtggccccctcgtctcctgcgctctcccagccagtctccctgctctctgcccctcgggtctggcccctgcccggccaggatggagccaggcagctctgccaatgtgcacgtccccggcacatgaataatacatgtgaaatctcagtccttggaaatgttcttctctggtggatggagagaaaaccattatttctacttttatgattcccaagactcctgagcagggccataaatattacacccaggtgggggtttccttcccccctttggacagacttaaaagtcctttttttcttaaaggcatcgctcattagggaagccttctcaggcagaggagcgaggatcctcttggtttcctctctctccagcctggtcaggacgccagggcagctccaggacagccggggccctttccatagaggccctctcccctttggccaccaggaaaggaggggttccgtagggcccttctccaggcccaggaactgctgttccccttttttgctctttttttaatttaaagacagggtctccctcttttgcccaggctggagtgcggtggcatgatcatagctcattgcagtctccacttcccaggctcaggtgatcctcctagctcagcctcctgagtaactgggattacagctgtgagccacctaacccagctaattttttttgcattttctgtagaggtagggtttcgccatgttgcccaggctggtctcgaacttgtgggctcaagtgatctgcctttcttggcctcccaaagtgctggcatgacaggcgtgagccaccacacccggcccattgctaagttttacatgtgttccacatgatgcccacatcccagcccagagggcagccgcctaacgacgccttcagccaggaggctctgcctgcagactgaggctggttgccagccatgtgactgcggggtgacagggccaccatgtcccccggccttacctctggctgtggacctggtccagccacgcctgggcctgtgctggaggtggggacagtgctgctcatgggcaggggatcgagcatccaccccctccttcagagcctgctgcagaagaatgggctttgatcaccctcccccggctctttgcagtggtgagaactcagccgtgctacactacggacacgccggagctcccaacgaccgaacgatccagaatggggatatgtggtaagtagggccagcggccctggctctgtgtgtgaacagccaggccaaggttggactcaacttcaagatggcccagaagcctctgggtccctgtcctgagagggctgaccacagcaagtccctgggcttcttggcccagacttctctgccaaggctatcggcctgcgtggtgccttctccagggccaaaagcctgcaccccccagggagcactgagagagagggtgcaggagaggggcccccgatggtttcctgtgggccatgggattgtgggctctctgagggggcctgaaccatccccagcctctgtccaggctgtcctctccgttcagggggcaccacgctcgcatctttctgtcttggtgccaggagggcaggcctcttggtctggagctgggaagaccgcagggagcctcccacgctctgaaacctgccatcctcctgctgcaggagcccgtggcctctgcggccctgcgttcagcaagtcagcagtgctgacccgtggctgcgtgcagggctttcctgagcacgatgtgccgtgctcacagttcttcatagaagccacgacaaggagatgtgggcaggccctgcggcctccgcccctcgggtagtcttttctctcattggaggacttgcagtcctacccacagcccctcggtgtgcagggcagagcagctgggccgctgccccggggcagggaggaggtgtgtgagtacttgcagcctggcctctgctcagtccctccgcgttctttgcctgtgccctgcacgtcagatgtcagccagggccagcccaggcagtgcagagctcctgagagctaccccagtgctggagccctggggctcagccacagccacgcaggccctgtcttggcctccagacatttcactgtggtcactgactagcagaggatgtgccttgtccctcccagttctttggtgccctttcttctatggcagatgcacccgaacaagcctcctgcagagccctctgccccccagcagcatggcatgtcctctgaggcctgcgtggcgcccagctgggctgcctccgccttcccatcgaggagccaccccaatgtgccagctcctccagcgggagttcccatgatggctgctcaccggcctggaccccgcctcaccctacagcaggtagtcgtgggagcccaccccccagagtccccagccatgcccactgaaggacaggaacacacatgcccagacctatggacagacaaccagctgcccagagagctgccgagcgttgagctgtcagggccgagtatttgcaggaacacactcagtctcggggtcctccctgcccttgggcacatggcctactgagactgcccgggctccccgctcacccaggtccatagctgatgagctgttccagctcaggccatgctggcaggagctcagctcagaccttgggtggggccagcatatgccgccacagtagggctgtgttaggaacacggcaggttgagggtgcaagcggaggcaggccagtggaaccgccacccactgcgcgctgggccttagtggactccctggcctacccgacagcactggctccacggatcctggttcactctggcaccacagtgagccccacaaatggtgggcgagtccccagtcccccctgcgtagccaccgtgctcggggctgggagggtcagagcggagctcagctttcctcctacatgcctggggccacaaggtgactgggcccttcttctgggtctctgtggattttctcacccactcctcgccctgatcctgcgatgtaggcacctcaccccatgtgtgggccaaggaactcagacacaaggagggcaccaggcccaggtgtgaggccagaggcacttggggaaagaattggcaaactcagacttggctcagcaggggactagagcaggagagggggtggcagccctgcccccacaccgtggacccaccagtggctccagacaccacctggtgtcctgaaactttttaagagacggtcttgctctgtctcccaggctagagtgcagtggcacaatcatagctcactgcagcctcaaactcctaggcttaagagatcctcccacctcagcctcccgagtagctgagactacaggtacaagccaccatgcccagctaatttttttatttttaatattaaaaagacagggtctcaccatgttgcccaggctggtctggaattcctggacttaagtgatcctcttgcctcggcctcccaaaagtgctgggattacagatgtgagccacggtgcccagccctgaaaccttttctaaagctctttaaccctgtagcgcattctggctgggcctggaggacaggacatgggaacccagtctcacggcagaggccacatcagtgggtccccacagtccagggggcacttctgggtggctggagagccctgtgccagagccacgtggccatgagcttttctcctctgtgggctcagcacaccccagaagaagtgactgctcctttatgaccctctttatctgccccggagagggtcctggcataatcccagatgctgtggcctcggccctccgggacagcacatggcacctgcatctcccagctgcagctgtagaggcaggagtgatccgaggatgttaatgccaagtccaaattggtgatttgatttttctagtgctaactttgaaatgtagccagtagagtaattatgagtttattgtagtcaatttattatgcagcatttagaacaacatgttttgttgattactgctactgccagattgctggtggcatttatagtccattgttgtattgaaattgatctgccgagcgcctactgcgttcggtaaataataaatcagtctgttatcccaacatgaaagccacgatgcttcatcctaaggtatgaaactaaagcatgagcccagcgtagaattcccccgaagccgagcgcctcccagagcagtgcgcctgctgcaatggcctgctctgggttttagtcctttgactgggggaagacaccccagagatattttagcttctaggaatgggattttgtggggaatcagagctggtccagggcagccagattatacagctgtactgcagaagggtggggggtactaagaggaggccagccttttccatccctctctccacagtcccagatatgagcactcccccaacacgcacacacatggatacacacacagggaactgaccgaggctgtgctgcgttgcaatgatcacagtgtaagcccctgcctccctctctcgcagtggccacctggcacagcgtgggccctcttcgggcaagagcagcaggcccggtgtcctcaccgagctgggcaggccaggccctgatgcccacttccagcagctggttctgcagcacaggctggaggtgggagccacaggcagagctcaggccaggcctggtttattctcagacagctcccgtcccctggttgtcctgttccgtgtcttcgacccaaaagtgtcctccatgatgcgtacatcaagcggggtttggggctggctaggcccccctcctactgctccgtccttacccttccagcagcttccctggagctaggctgagtccactgttggccacagtcatggtccaagagggcctatgaaccagacaccctggttcctgcttcaggtcaggcttgtcagccaaggactgagacagacttcctgagggccgtccctcacccccagccagccacccccgggccccttcccgcttctctgggtgtgatgccaccacacccactcgcatgcacgcaggggtgagggacgggactttgtggtggctgcatacaccctcagcctggttcagagccaagcggccccatgtggggcctgtagccgtcaagcctccgggggttttgctgttgttctcagagtcttttcccgctgtgatcctggggttcgccatgaaccccatctccaagtcactgtaccagaggggccattcgctgctttttttgttttcctttttaaacccctcaggcagaccttcaagaacagggttacaaaagcgcagcacacttgctaattaacactttcaacatgttcacacagattgaggtgcctgagatcactggaggccattcctaagtgggaggccccagaagacccctccccactcactccagccccgaacaggtttgtgtgagcacagaggtggccaggactcatccccctgcttctcctggtcgtcttctgagcccccatgtgctgccccctccttccacaaacagcctgggctgtgggcaccagagccactgcaggccagcaagcttcgcagctagggcagggggcgcatggtccacgattctgggaagcagtgcgcccagagagggaccatcccttgcagcactccgggcctgaggccgccccaggtcctggagaggctcaccccacagggcagaggtggagggctctggttgggaaagcagctgggacactcctcctgcctccctcacttcccgatcaggtggtgggggttggaggggggccttaatctactgtggcccctcgcagagtttctagagcacgtgtcccaggatgccccaggccttggttgtcccagtcgggatgcagctggtgggcagcaagcctgtccttccagaactggccagaagagggcagtgttgtctcaggacgatgggccaggcctcacccctgctgggcctggtcttttgtgttgctcctgggcatggggggtgggtggccagcctggctaggaggagagacctgtcccagccctcacactcagcagccaccagtgccctcttcccctccttccctggctagataatggcgagacctcgaccctgcaggccatggggtgcccgctcacccaggacctcagcagccaccttggcctcacatgggccctgcagcctgggatgcggccagcctactcctgctgtctactcagcctgagtctgtctgccaccatcgcgctgcggaccccatgggtgacaagctcctggggacccccttgccccactccacctggggcccaatgctttggtgagctccagggtagagcgttgcccccaggcctgctctctgctgcctgtcccagcccagctctcccccaccaccttgctgtttcctccgagggagacttgttgtcaccagccagccctgccctgagcactctgcggtcttaaagacatgctcttggggccacagaacgccctcaggagggtccagacccacaggcatggccgtcccatcccatcccagttaggagcgtgctctccattctcacccgtcctcatacacatggacaggcctggttatgagcagacacctgcccacgcgttttcggtttgtctcttgtttgtgcttcgtggctgcaccctcctcagctgatgtcatgacccacagtttgaacagcacttgtccagacatcctgggtgctcccagacatcatgagacactggtcaccaaaaaaagcaaaatacagcatgtgctgcgcgtgtgactctccctcccgcctgccaaggccactgccctgacgcccgggcctcaccccactgtgctttcctggcagctgtccttgtgtctcacccacctctggacgaggcaccccacagtgctcttctgggacccggggcccctcactggtgccgtgcctctgtccatgtcatgcataaaatggcaatgccagttccctccagacacccaggaggcccacaggacgcagctgctcccgtcacccaccgcgtgcaccagggattgctggctctggggaccagaagctgctgctgtcatgggctggcggcatgggcagctttcctgtctgccgaggccctggaggagtggccgtcacacgaaaagggggcagagatgcccaggaacgcactggagagaggtccccttggtgggttaggccatggcacggggagcctcagggactccgagtggtggcctttgtccctgctggccacgcttggagcttggcactccacggaaggcctggctgggagcaggcagccggcccatgcaccctggagaccacagctcgccaccgtgtctgcaggggccgcccactggggcagatgaagggaagagtgacccatacgcctccctttcggtctcacactgaggagaagcaagtgcttcctgctgctcagcaatcccccagcctggcctgggacactgaccagggcagctgcacatcggagtctgcagtgcttctgcagccccgaatatgagcgcgtgtaaactgttggattgaacagctaagagccgtgccactactcaggagattcaaatgaaactgcaaaccaagtccaaagtggctctcatataaacattgcagcatttcccccagaaaactgttcccaagccttccgtcactggccgacccatcttggaggccttctgcctctgggctggcgggtccctgccatggggcccagggagggtctgggtgggccagtggtggcaggtagcccaggcccaaagctacccagaaggagccagaaacagagccctcagaacacatgtggggagtgagacgccagcacgttgtttggagatgcatcctgtctcccagatgtcttgtattatcatcgactcactcggccaaagatggtagggtccccagacagccaggaaggagggatcctgcgtgcctgttctcgattgagccaacgtatgaccgaattctccattgtcggtttgcattcagaggatggatgaagtggacgcagaggagcgggagggagatgatttatcaaagccatggctttcgtccctggattccagaaaagcttgcatctgaataacttatgtgtgtagaaactctagggggatttttttaaggcagaaaaagatagggaactgagaggagcacgaaaatagacttcagctccatacccgagcctcgctgggcaggatggagctggctggctgggtgtatacttccccctccagaaagcagatcattttcaaacaagaaatgcagttacagtcttctacaagctggaagataaagtcaggctggcggatgatatccaggcacccaccatcccatggtctttctgctttgctggcgggagtttggggaactgggatctgagtctggtctgcactggagaacagtcttgtttttacattcctagatgatttcattgttcggggtattcttgtgggcttcctggttgttgttgttgttgttgttttttaaacgatagttcagtttctgctttttcttttgtgtcagcacagtccggtaggactttctgccccggctgctgttgcaggtcaccttctgatttggcgcctcctaggaatccgtgtcccccatactcctggccctgtcctctctgcccaggctattcttgcatgttctaaaaccaacaaaccacaaaccatttttcttggttgactctggggaacctaaatgaaaatgcttagctgtccccaggcaaaactgggctgtgttccatatggctccactccccagagctacagcagtgggagggtcccattttacagatggaaaaactgaggccgtgaaggttgagcactgccgccaggacctaagaacccattgctgggcttcgagttgtttaccctcctgactcagggctttcctggacccgtgatctgagcctcagtttcccttcagtttagagcttccatgtgccccgccttcccggccagccgtggggaagcctaggccctgtgcaggagtagacttccaggcagttgttggcctaagcagcccactgcatccagagatcctgtgactctgacccaccccaaagctccctgtcatgcaggcggggctcctccccccagcctgagagtcacctgaggtgttatctggacctttctgccctgttgacactgcttatggtgttttgcaatcagaaaagacaggagattaaaaagtgcccggctggggactttggatttcagcaaagcgtcctggccgtgcattcaagtttttcctttagaaatctgcctccatggggcggctgacgctgcctgtccagccacgtggccctgctccttgctccacatgaggccagggtcctccaccccctggctccctcccatgggacaggaccccccacaggcaggcgcacaggcagcttctggaatgtttgtggagtggttgtgtttaccgtgagagctgggatttgggtgagaggccctcgtgacggaagccgcggctgtgcccctggcctcagacttgtcaggactcacccagctacagatggaccccatgggaagcccagggtggagccaaagaggggcagctgcacttcctcagccctcctggctctggttctggaccctgcagacgtggtgggctctggtcctagggctagaccagcctccgccagccagggtcatcaccatcagtgtcgtgacttggccatgacctgtgaaggggctggtggacccgagggttccgctctgtgtctgctgcctgcagcctcccgaggtgcctaggtgggatggatggaaaggggcaccacctgcgcccctccgccccctcagccaggcccagccttgtccacctgggctgcttccggggagtcctgagagccaggtttggatccagcagcccttcccgtatcctgtcccttccacaccacaggatgagcgggaggctgcttctctgccgttgcccagagagggccctgaggtcctttgcacagcaaggacaggccctactccttccgggccctgctgtgccaagggtccctcttacagggcatccagagggcagccccagccaccatcctcctgcctcagcaggcctcctgtcatctgtcccacactgtctgtcccacgccatctgtcccatgccatcctgcctctctgctggcccccaggcccctcccgtcctggacagctggcacctctgccccattctccacgcccctgcctgtgtcctgctggtctctgcctgccaccggagggtgccagggtgcaggtggacagggtgagggggcccacctggcttcggggacatgtggccagcaggccctgggaaagccttgctggacatgaggctgtctggcacttcctccctgccctccccttgggccctggcagaatatgtccgtcccatccccatgggcagaggggtagtgtcgggcacacccctccagctagggggccccagagctgcagcagagccagaggccctagccgccgactgagtgtctgcccagatgctctgggtcctggaagaagcaggtggtgtgattcaggcccggagttctaggccgtgcatcccatccggggtccctgcccagccccctcctcctctgcttcccacaagcacggcctcagcctgtgctctgtgctgggtgcagggagacctgggagagcctgttggggtgccgggtggaggccaggcagcgggcggggtcctggggcatctctgcctctccttagttctccaaacaattctccatggctctgagctcttggaggccaggccacaggggtgggtgtcatctgcataggacagccccactcccctcagccttccctgcctgggctgagccctgagtccctttttccctggaagacacaggtcttccaggatggcttcgggtttccttgctgcccacgcacccgtgggagacaccaggtggcagttccccacaccggtctcattgtgagggggagttgcatccaggacccgggccagctgccctcgagtccagggcaggtggggagcggtaagggtaagggggcggtggcaccccagtacccacttgccctgccttcctctctccgcagcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgagcagcgggtcggtggggggaggcgcatctgacgtggcgttgggggcgctgctatgtggcaggtgcctgcagggaacgggtctgcattgtgtgacttgaatctgccacactccagatgcttagtccctgagattccagtggcgtcaggtctccagggtcactcctaggaaacaaggctgaccaccaggcagggacagacagaaccaggaattgcggggctcaggccaaggctccccggtctgctggcctccacctgcgcatctccactggccactagcacgccagcctgtctcctgctttgtccttaagcggtgtctactccagggagggctcaacccactctggacactggcatggggtcagagcaggttcacgtgccgctcagcgctctgtgaccttggatggaaagccctcctctgggtggccgtttccacatctgtaaatggggaagcagccgactcatggagactgagttaagctgtgtaaagcacctgcaaggccgcctggcctgtggtagtgccctgcaggggtcacagtcaccaccatgatggccatgttgaggccaggatgggcctggtgtttctcccagcggccagcgtaggccaacctgtcctgccctcagccctcccaaccccaggcagcctgcacaggccccactggtacctcttgacctcccaccgcgcgccgttgatgtctgtcagggcaggcagaggaggtcccctggaggggagccagcatcctcccaacaaggccagctttcaggagttccccctgggcacctcccgctgttctcccatgcccgttgcagaccagcactcgctttccgagtgaaactccctgtggtcactccactacgacactgggcaaggcggttggagtacttagcacctctactaggtatcgtaaccccgtagctgctcgtgccactggcatacacattagacaaccagttgtgcctcacgcagtaggattggagaggtgctctgggcatttgtctacgctcttcgcaccacgaaggtagacgaaatttgatggaatagtgggtgcttgctgcatggttgcttgccattgcatagcacttgctcagggccttgcttactaccagcaacaccctcaccagtgaatgcctgttggattgcaaccacgagcactcgggcacggttctcttatcgggatgcaccaatttcgctcgacctaaccgctctagggcctggtcccttcctaacagcgcactatgggctcccacgactctgactgagatctgttcggcagctgccagggtccagcctgcagcgcagaggggctttccctgcccacaccggcccaggcacagctggccccccaaggcacgcaggttctgcatctttggttataagcaacagaacagtctccagccaattcggtcatttggggctgccacaaattcacagaggtggaaaatcaggtctgggctggggccagggctgcagtggcacaggacaatggccctgtactcacagctggatcgtctggccagggcccgccctcagcacacaggccccagccaccttctgcagcctggagtccctccatctgggtcgaggtcagagatcacctcgtgttggccatgcccaggtcatagtccagcccccccagcttgcccccaccctcgcccactgcctctcacccacagctatacagacctccagagagacaggcaggcccaaggcagccccctgtgtaggggagctcaggcgtcctccaggagccaggtgggcttaccgcgggcagaggggatagcccagtagcgcaaggcttcagagtccaggatgcaggccccagacccagagtgccccgagcccagccccagctctgccgcctgctggccaggtaccttacttaagccccaaacaggcgaaggatagacccctgctctcccaaggcagagtccacttcagagcgggcctggccagctctggaccgtggcatctagttagacatggagtgccctctgttaaggacccacagagagctggcagctgccaagtgcgccctcagtgttcaaggaaaaaagaagaaagaaagatctggagcctccagaatgcggcctcagaacttgatggctcggcggtcgactgagcagtccctgcggccccacagcccgttgctgggatgagttgcagcctcgatcgccggcccaagtgtgcttcagaggggccctcagccaccgtcgctttcagaggaggcagactgtgggcaggcctttgcagatggtgcccagtccagcctccagagcccccaccagaggctgaggagccgcggagggacgctgggggcagtgccaggccccagccccacaccttcacgcatccaacaggaacagagcttgacaaacgcatgagtgcaagcagggggaccccagatgtgccccaaaaggaagacaggacagaaaatccaaaagtcaataagcttgtgatggggtgacagcgctgatcggactcacctggtttagcagctgccgaggaaaacagcattttctgcggaattgctttgcttaaaaagcagcaggccgggctctgtggctcacacttataatcccagcacttgggaggcgggcggatcacttgaggtcaggagttgaagaccagcatgggcaacatggagaaaccctgtctctactaaaattacacaaattagctgggcgtgatggttcatgcctgtaatcccagctactcgggaggccaaggcacgagaatcgaatcgcttgaacctaggaggcggaggttgcagtgagccaagatcacaccactgcactccagcctgggtgatggagtgagaccctgtctcaaaaaacaaacaaaaaggagctgccacccctgagtatgaatatacaggtgtctccaggcagatgggtgggtgaggacagaagagcgccagagggtatggccagcgggcccttgtgggtaaaaggaagagggagtgagagcgtgaattcccgtgcgcctgtgaaaaccataaaggaggtgcaggaagggacgggacagtttgcttgctgcgtcccttcttattctttctgactcttcagccatgggaagcatcccccgttagctgtcaaatccaatccagcctccacgaagcagtcgcccaggggcgccactccttctccttccttcattctggggatgagaatttcttgctcagttttaaataccactagtcactcgaatgaatgatcagtgtttcagatccagcaggaggatttggcaggtgagcgtggcctgtggtgtattcacctagtatctgtgagcccagctcctgtaccctccacggagagccctccgccgggcacagcctctcaggtgggccagagtctctcagacacccttcacgtacagggctggcctcccactctgtagctgtgccaaggtgggctgtgtcattgcgaactgtgtcaccatcacatcaagtggtagtgtcagacatccacgggcagtcgtgaaatccagatgtccagaaagtcagagccccaggctgcaaggggctgagcctcccagcggcgaagcagagctttgcagcctgtgaggggcgggggcccaccaagcccagcaaccctgtacacccaagcatcaggctgaggagctcagcttggtcagcaggcagtgccgggcccatcagggtgccagaggtagcaccaggccacggggagcagggcggcggattgacgcagcataggggccaaggcctggggggtgtttggtgggaaagccattgtcttacccctcagtctcctgtgctgaaaccagggatggcccagccctggctggcctcacctgcaggaaagcctgctgcggcctgggcaggacctgggtggcatctccacagctggcatcctggccagctccctggcccaactcagcagccccaattctgtccagaaagtggccagacctcggggcaagtccccaggccccatgtggcactgagaaaggcctgagctgggtctcccatcccgtggtgctgcctggttcatgctgactcttggggcaggcacaggcctcaggcctggcaggggtgtctggggccaccaggccaaatccagctaggctcatctcagaccatgggaggcaggtcctcccccagccccgctcccacccaccactgggcttcgctgcccagacccagcctggggtctggaggatccctgtgtaagggaatggagcagccccccagcagcccccccacacctaccacccacactgagctgtgtggcattggtgtcccccaagggcagagttggactccatctggatcacacacagtgaaggcccgtggggcaggccctgggcccacagagctgccctccggatggggcaggtcgcctcccgtagcatcgaggaggccgtggccaggtcagccccctgccttgtcccagcggaaatgccctgggttcgtgggttcaattcctgggccaagacaaacaccccaccgagactgcccgactgcatcctgtgaccttccagggagagtaaataaagcaggaaaccccatagctaagcccaaaggagaggcaggaaagaatggtcaggaccctggggggttgaggaatgcaggccttggcccctgatcctagggctggtgggggagcattcctcactgtcattcacagtcggcgaggaaggaggctgcgctcgctcagacggagaccctaccctggcggctgggagtccacaggcgggtggcagggcaggcccagcagctgcaggacctcggggagtgccatgcacgggaggttgggtgggatccaagctcagcgcggctcctgtgttggggcaggctgcccaccccatgcagacccctgcatgcatggtgaggggaatggggggaggcgctgctgggacggatgggcgagcccggcagggtggccctgagtcagggtctgcattggcacagccacagcaggaaggctgttcctagaagcagcacagctgtccctgtcccgcgggctcagtccctgcagccaccctggagctccagaggaccccagcactgagggccccatgccctccgcctgcaagccccagagcctcctgtagcctcgcctcccagccccgacccagctccctctctcctcacccccccaccctccctggcctccccgcctttctctactctttcctgtgctcacccaggagcctcctgtgcccctgtcactgggggcccagctcctatcaacctggaacagcaatggtggcccacgattcatgagctcttttgtgtttcgttcccccgctcctggctctgtccctgccctcagggtcctggccacttgtgagtgacgggggtgctgccaatgtgaggtcagaggaggggaaagaagtggcaggaagtgtccccacctccaaaacagtcctgacggggcgagagaggggcactgaggcgcgggatgaccaggtggctgggagaggggcccagcagcacctgccccggcccacctggcatgtgtctcctgtggccccgtggtcagggggcacctctgccagctttgctcccctcccagccagcgccaggggcaggggcccagcagctagacttcctgtcagtcctcatcctccgagacggcgtggagtgcagggctcaggcagataggcatggcggccatgtgccaccccagtcatagataccctctgcggcaggtgccaggacggggaggactgtcttcagtgtgggcaccatgtccacccctcctgccggccgcaatggtgagccagttccttggcctcttcttactcctcggggcactctgccagggtgtgggggaggagactcgaggagcagcctgggccaacacagcaccctgctctcacgcagggtgagtgggtccccagaatttctggcagcagatggggttcttctactcacgtcccgtgcagggtggggtgagctggaggtcctcagccccgtgccagctcagccagccctcagggcctgccctgggaccccggccggagcctgctgtcctacacccctagagcctggctcacacccatccatcccgagggccatgttccacagatgaagtgcgctctttgtctggaggcagctctgaggatgctgcctttgtagctcggtcaggcccgggagccccctggggctgtcacactccgggtaggaggcctcggggctgtgatggatgctttgaggctccaaggagctggcctgggccctaggcccagcaggagcgggtgctgcctgaggagaccaagtggacccagaagaccactcaggggctacgctggccacacctggggcctgggtggcaggagcagcggggcttgttcctctgagccctgccatttcatgaggcgcatgatgggacactaacctagaggccaccctgcccgttctagggtctgagtacacagaggagtgggggatggggcacaacactggctgcaggagagccatgagagaagctggggctcctctccttccaggcgtttaccaagcatccgcagcatgccaggcacagagcagagtacgggcaccacccttgcaaggcccagaggtcataaccaggcccagctgtgctgtgtgttccgtgaattctcaaagtacaggaaggggtaatcagagagggcttcctggaggaggagcctcaccacagaggcccacaggaggaatgggagcacatctgggaaaacgggcttggaggaggtggccccagctaaggaaacagcaggtagggagggccagttcttgggacccgtggccttggtccagccaccccacccaggagtgggtgagggagaggctggagaccaggccaagctgagaacctgggcttcgtccggggccgggaatggccctgtttgccccgttcgttctaaagagatggcccaggcatccaaggggtgtgcagcggaggagggagccaggcagactccaggaggggtggggcaggtgcaggggtgcttcgggaaagccagaatgaggtttggtgcttgctgggggttggggcacgcagggcagctggtgcccaatttctgctgtgtgattctcagtgtggcatctgggtataggctggctaggggccgggggtgccttccagcctggactagagagcttgacggtgtctccaggctgccagggtgggaggagcctgagagtgggcccaggccagcaagggaaccctcaagttggtgcccaccctgccagcctagtgcaaggacagtgaccctcacacactccaggggcccccgcccaggcggtgggtgtcgtaaccaccatccgggccagaggctggggccaagttgctggaggttgaatcactgtcacaaccctaaccacacacaggcagaaactccctgctcccggccaagagagctgtgtgcaaggccttccccgagggtgcacaggcaaggaagaccagcggcgccaaggggacccccgggccggcacatctgggcggcgccgggcctgcccccgggaagggccaccgcagagcatgatttatacctgattcccgccctctgcggaggctgggccaagaacgtagcccactgctgaagttagcctggttggaaagctggctgcacttcccggggctcccctttggtgaccagagaagggcgcgtccgagaggaagcagttgagctgggcttggggcacgagccactcacaggaggcctcccagccccatgtgccaactttgcaggctgttgggagacctgaggggcactcactttatgccaggcccagcggtgccctcgggagacccccaccctcggagtgagacatgagaagcaaacgagcagatccgtccaggggacggctgcaggctggatggaccgtgcaaggagaaatcaccaggcctgggacagcaaggcaggaaggtctcctctgagaggggacagcttttatgcagagaccccttggatgaggcatcacaggtcaaggcctggcacaggccatagcaaagggcctgaggtaaaacggcctgtgtgccttggggtggtctggcctctggaggatgcagcagcagagaggaagggcgaggtgggccaggattgtccgggctgggttctcagagaagagcagcagcagaggctgggcaggcttggcgcacacccccaggaacaagtgaatgtcaagtgtggaaccagggctggctggtcatgcgcgatggaggaatggtggccaatgccactgtccggggtgctgcctccagcccccaggtgacacagaggctctgagagcaaccccccggggcctgccttgtggctgtttgtttgaccagcggcagctgaggctcacggaggtggggctgtttgaccagcggcagctgaggctcacggaggcgggggagcggccaagtgggctgcagttatccaggtgtccttttccgggatgttgtgcccctcagaaaagccaggggtgcgggctgggccagccaggggtgtgtgtgcccagggctgccccagatacagggcagctgcagccagagttgccccaggtctgcccgggctctcccccacgccagaccccgggctctcccccacgccagaccccagaccccgggccctcccccacgccagaccccagaccccagaccccgggacggcctccccgacgccagaccccagaccccgggacggcctcccccacgccagaccccagaccccgggacggccgcccccacctcagcccctaggaggctgggctgatggggagctgggctctgaggaggatccctgctctgtgtggggggtgggggcaggtctgggcatctccacccctgccacccttaggctgctgccgtggctggggcgctgtgctgtgaatggcgggcaacagccatactgcctgcccaaagccgtgcacccccagcccgcctgagaccccagcaccacagtggccaactctggcacttaaaggggtcccaacatgaaggacttgtgcccagtgtgtcgggggtgatggcctgtgtcccagtgtggactctcatccctgttcgccagccgagcccatcatctgccctccgccagccacagaggttcagaaccctgcttctcacagcccagccctcgccagctcagggtctccccggcccctcccacagcagtgatcgggaccatgcagagcaggctctggctctgcgccaaggcaagcctggcagggaggccctcgggagccaaggtcactccgcctggtggggctggacctctccaggaggtgccgcagggacttgctgggcgccctctccagccagtgagctgcacattgataggggccccccgccacgtgcctggccagagtgtcctggggccccggcctctgccagcacgtggcctgcccaaacccagcccccatggggccagggcaggaggcctcaccggcctcgagtccttatctggtgctcaagccaagtccagcagtggaagctaccatgaggagaggctgatgctgggattccacagagtccggggatgggacgggcgcacccgtgggctgctgaggctctacgtggagagctctctaagggcctccttcctagcggccatgctccagagccccacagagcctgtgtggcccccaaagctctgtgcttaggaagttctctctttggtggcctttgccccacaaacatgcggcagagatgagttggatttgaagccgggagttggacatctggctcccctggagatggtgcccctgctgttggcaggcggggccccgaacccctgccagccagctcgtggggccgtgccagccgcaccttctccccagaaacctttgctccctgcagcagctccaggggtgtttcatccccattctgggatgtgcagggacccctcttttcagcctcgggcttccccactgcaccacagcagcaaaaccccatcggagctctgagccagggtttgggtctgagcctcagggccagagcccacagagtctcctggtgtctgctactggggagacgtgcatgtttctcctggtgcccagggatttggctaggtttccctgggcccagaagcataggctgttcagggtggacacaccatgggctacagagtagacccaggctgggcccttggctacaggtgacaggaacctgcccctagaggcagaatggagggacaagaagggtcccgagggccagagcttttgctgggaaagcccagcacggggggccaccctagtccttgtccccctgggcccccgatgtagtacccttgccccctcaccccccacctcaggccctcccaccacagccagtgtgagggcttcacatctcccagcccctggccctgcggtgttggctgctgggctctgtggctcacggcagctccctctggcccacaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagaggtcagtgtggacatggcaggcggagtggcctgcccatcagctgccgctgagcctgacccccagggcagggtgggactctaggaggcagcaggcgtgtattgggatggcagggatgggccccatggctccctgtggtatacggaggccatgaggaggggggaatcgggaccctggccaagacaggggtgcatctgtgagcattccacagaactggacatagaggcggtgctgtctgcctgctgggcccaggtgtcacctgtccagaaggtggcacacagtcaggatacggtgcatggggccccacaggacagtggtgctaaggacaggtcttcgtgatggagctacgtggcacccctcacgtcctgccgcctctggcttcattcagacctggggcgtggggagttgatgaggccccacccactggcgactcaccctggcccctcacaaacccggagcagccctgctctgccgctggttcgccctctcctcccaggcccctgggccgcacacctgggaccctgcagcctcctcatccccaggcattctggggcccgttggcagataagggaggctgggggccatctccagacaaggttccccggccctcagaggaccacccagagggtaagtgaggcttggggaggcccaaccgggcaggtggctacggcctctcggctgggcggctggggcgctcccatccctgcccttggcgggctgcccaatgcagggggctgattgtgcaatcgtgcacgccctggggccccccagccagttagccaagacaaggctcagcctcttggctgcagggtgttttgaaagcactaagaatgattttttggcagggtgggggcagtggggggaattgcttaagagaagcattattattcaattatttttttcctcaagtgtaaacagttaaatttggagaaacaaaatcagttttaatttcctaatgtctattcatcccattgtgtgcagggagccaagagctgggccttccagacattgttagctgaggttcgttattcattagtcgccaaagcgctttttttccaccagcaaaaattggcagcaaactgttttcatcttttccagtaagcacctctttgtgctcagagtctattcttctgacagataaacattgtggaaaaaatatggcttttcctataaaagtcatttgttttatttcaggcctgcagacacatctggggctcctctgcttggagcccaataaaagttgaggccttgtcaagccctgtgcccaggcagaggcgagcatgggcgcggtgagggcaggacccctccccacccctgaaggctgcgcttcctgggccacaggggctcgtgccctccccacatggctctgcgctccacccggcccagcccttcccattctcttatggcgcctgcgccctgttctcagcaggtcccccgggcaggcccctagagccaacaccctgaaggggcagctgcgccactgggctgaggcaggccttgccctgtgcccgctggggatcccttctaatctcccccaccccacttcagtggtggacctcaagatttcagaggggaggaaagttcgtttctctggggaaacaaacctgcccctcaaccgtgtaccatggagcagccggggtgggcccatggggatggaggggtgactggaaggaaggaaacctgacgttggcaggcccttgcttcccccaggcccctggcttcgattgctgtgggtggagacagggacggacacttcaggaatagcatgaaggagagggatgggcggcggtggggtgggggagcccagcacaggcttcggatgacagggacgggaaggtcctggagcagagaccctgggacccccagcagcttctgggcaggagacaggccccagctcggtccacatgcacctctcacctgcgcagagggactgtcactccatacggttcctcagccacggggcatccctgccctccggcctcagctcccggtcagcggcccagaggcaagtgttgtggggccggggccacaccagccaggctgtggtgtctcctcatcgcctcccgcctggcctgctctctccaggtcagcgtggctgtccctgccctccgtggaatcagtcacagcctctctggccgtgcccagcgtggaggccgagccagcctgtttctggttaccttacgtgaactgctaattggagtctgatgttcttggcccccaaacagtcagaaatgacagctcccgctccagcagctgggcttcctggggagggagtgcagccgggcagggcaggctcatcccctgaccagaaagcatactcgtgcccactggctcagaggccctggccgccggccggatggtgccccggggacctgaggcgagcaggagctctcctgtaattcccagagcacccgctgccctcagccaagctgaggccccctcagctgtgcctgtgagtggacaaggccaggctgggtgtgcactggggcagtgtggggcgcagacaggggcccctgcagggagcggctctaccactgtccctcaggcgttctccaaggctgggggctatttcccagggccctgccgtaaggccccgagctctcctctgggagccacacctgccaagccacgcgcacacggcacatttgcactggcgcactaaggctggcagacccaccctgatgacggcacctgtcctccctggacagtcacacggaaaacctgggcctcggcctaggggagctgggaccacgacttctggggccagtttctacttgggctgcctggaaggaaagctgtggccccaaggggcttcacagccgccttaagagcttttttggcttcagtggtttggcatctgccactcctctggccagcagcggggcctggctaagggcagcccaaccctcagccagccccacaggcctgtctgggcagcttgccccgggtgtgtgcacatgggtggccacagggcttctcaagcaagccctagggtagtgtggccagggacactcaagatccaggggtatgtgcagggtggaaggtcttatcagggtgcccatggcccagcacagcaggggcgagtctaggctgaggaccccaatggtcaagagagcccacgagactggcaccggccctcacatgcccatctctcctgatgaggccacggtgagccctggagctgctcatcaggcccctcacctctgttccccacagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtgagtgcccacgggccccattcttgctcccagaacatctgccacctccactgcagctgcagactccttagtcccaagacaggggccctagtgacatcttcccttgaggtgggcttagcctgccccttcgtgtggtctgtcacaggatggagcctcacccctcagtaggaacagacagagatcctgcaaaacccctgcccgctccaggggctcccatccacctggcaaagacagggtgagcaggtgacatgggcagatggctccatgaaggagcccggaggccacccgtctcccagggagtgtcagctgctcccatcccatggtggggtgggcctggaatgggcccggccctctagcctggcacatgaggctgctctatgataatgtgtgtctgtcggcttgacccaggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcctttgtgcgtggcttcccctttattcctttgcagatgagcatttgggaccccgtgcaccctgaaaagatggctcacctggtgtcagtatcaagtcagttccaggaagatggtgctggcagcacaggccctctaacggctgcttctgcctcagactggcctggcgggacaagggcagagtcctccccgaggagcctgctttgagcccctgggactcggggctctggtgtcaccctgtcacttgctgcaaggtttcccaagcctaacaggcatcagaaccactggggcatttggtaagagattcctgggacccccacagaccatctgacccaacgtctaggggcaatggcccaggaattgtgtatttcacaagcgcccgccagatgctcctgacagacaagtgtgagaagtactcctaggcaaggtggttttagcttgtcagtaccagcgcagcccgaggtttgaggtggggcaagcaacgctgcaggaagatcctaggcactcaggtcagactggccaagtcaccccgcgccatgcctttgcgcaagttaaagggcggactgatttaacacaagtctttctgatacggtcactgcctccaaactagatttctgaaggtggtagaatcatgtagcgcttgagctgcagatatttaaaacctgagacttgcagggatctcttgtccttgatttctttttcatgtgggacacactagccaaagccagcatctgtcggagacactgccaacgaaggcagcgccacagccaatttgcagagaccgcttgtcctccctaagtgtagtccttgaacaaattctaccaggcaggaagccagccagggcccagccatgcctggtgaagtatctgtccttgcctctgcttgtccagttctcccagggtcccgcagaacagcccacccctggagctggtttctagaattctgtacaccattccaggtttgccttctcacagagctcccatccaagagttcccaagccaaggtgaaagatgacaagtgagaaggatgccacagatgaaaccatgaggatgagggggtggaaaactgtagcttaagagacgttttcagaagtcaccaaaggccagcacagtggctcacgcctgtaattccagcactttgatcacttgaggtcaggagtttgagacctgcctggccaacatggcaaaacttcatctctattaaaaatgccaaaattagctgggcgtagtggcacacacctgtaatccgagctactccggaggctgaggcaggagaatctcttgaacccaggaggcagaggttgcggtgagccaagatcatgctactgcactccaccctgggcaacaaagcaagactgcctttttaaaaaaaaaaaagtcaccaaagagtttaatacaaactgatttcttcctatggtaataacacagaagtgcttataaagtggtcacattaaaataaaagccaatttcagttccaaatcaccatttatcttatctgcttcttagatttataacatccattctttaaggttttctgctggtacagatacattccctaagctatccatctgtgacattgagcagtagcaattatgtctttttagccaggcgcagtggctcatgccttgggaggccaaggctgaaggatcgtctgaggctgggagttcaagaccagcctgggccaacatagggagatcccgtctcttaaaaaaagtaaaaataaaaaactagctgggcgtggtggcacacgcctatagtcccacctaccctggaggctaaggtgggagaatcgcttgagcccagttcaaggctgcagtgaactatgatcgcaccactgcgctccagcctgggcaacagagcaagaccctgtctcttaaaaaaaaaaaaaaaaaaaaaaaaaaagtatcttctgagtgtaaggaaagttgaagagttcaccaagcacttctccacccctgttcccctgtgacagacacagtctggtgtacagggctttaatttcca

SEQ ID NO: 13281 - DNA, 9739 bp, Human; identical to SEQ ID NO: 12131

SEQ ID NO: 13282 - DNA, 8524 bp, Human
aaacaatgtgtacacacagacgtacagagtggcataatagacaattggagactccaaaaggtgggaaggtgggaaggtgggagggggcaagggataagaaattacctatcagggccgggcacagtggctcacgcctgtaatcccagcactttgggagactgaggcgagtgggtcacctgaggtcaggagttcaagaccagcctggccaacatggcgaaaccctgtctctactaaaaatatgagaaaaaaaattatccaggcatgtggtgggcacctgtaatccccgctactagggaggctgaggtaggagaatcgcttgaacctgggaggcagaggttgcagtgagccaagatcgcgccactgcattccagcctggacaataaaatcaaaactccatctcaaaaaaaaaaaaaaaaaagaaagaaattaccaattgagtacaatatacactatttgggtgatgattacactaaaagtccagactttattacaactcaatatacatatgtaacaaaaatgcacatgtagtccgaaatctatagaaacaaaaattttaaaaaaccaaattgcagtgttagaatacacatagtatgtattcaaattcaatcatttaaaaacctgtaggaagcaaattaatttaaaacattatcaaaaacatccctctattaagatttgtcacttttatttactttccatctgaacagtcttattcaatgggaaacaggtggatcactaatagcaagcctacctggatggtacatcaccacagtctgtgtatctatgcaacagtccagagtagatgagcgttattactgtgccattaacaaatgcaaaacctaactttatcaggctttcatagcaacttgctttcctacagaaaatcctgttgcttacagaatttcctgccacaaacatttttgggaagccctcaggacacttacacaggcttgtgaatcaatcacatgctcagcaggtactgttcagtgggatacacagtgtagcgatgcatcactctgaaatattttagtttctttttttcccctaaatctgggtatgttcgtgggaatttgcagcacatgtgaacaacttctgtcattcttgcatgaggcaaagggaattgaaaaccacgattactttagaaaactagtttcacagattggtcactgtataaaagaaggatattggttttggtagcttgtgaccacacaccatttctgatctgaataaattcagaacttataatacagttcagaaattgaatgcagtttctcaatatgaggaaagtattttagaataaggcctatttttcaaaggatctgtggaaatcaatgctatgctctcatttaggagatggaaagagtgaggttaaattatcatttcgattaaatctacagtccagattactggtggatgaattgaatgtacttttttattcatataaaacatttgaaatcagaaatctggagtacttttaaatcccattatttattttgttttaatcgccaggtaattcctgagacaggagtgtcccgaagagcctttgcaattatgtaagaatctccgaggcagttcttatgttcctcaattcaaaagaaccacataactgcaatttaaataacaccccacacacacacacaaaataaggtcgaagtttatctcaaaataatttcccctctctacactgggataaatatgtataggaataatagggggaaattcagtgcactgagcattaagctgtcaaaacaggaatgtttaaaatatcctgttagtggtttaaaaataatttgtactctaagtccagtgactatttgccagggagaaccaaagttgagaaatttctattaaaaacatgactcagagaaaaaaatgcagaggccggtaatgaaggaaatgattggatctcattcccaattggtcattcctaagatcacatgttctgagcatctttaaaaggaagttatctggactcaagagggtcacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggtaaggaaatgcgttgtggaatgactggatttataatattttcttttgggaaaaagagtttacagctgtgtttatagcaatgtctggaagccctggccagaaatgaaaaatgctgctttctatagagaggctgcacacatagcaagtgataatcatttgtttctagagaaattctgaaccaaagctacaactaatgtttcctaaaggtgtaccaatataaaaaggtgtctaaatggaatgtttattgtctttagaaatgataagatttgactttatttgaaaaacttgggtatccttggtttacttagctctttgcctgtttctctttcatccccttttgcatgtaaattaagcaataacttggaaaaaagttagtatgcaataattttcatttcaaactgaaagcactctagttcccttaatgcaaggttctttttcagtaaccgtatgttagccaattattttcttgtctcaatgttaatctattaaaatatgtggttgttttatgatagacaaaaattttaatttcagaaaatatgtttcttaaatggcttaaatacttcctttgactagaaatgacatagtatgccatagaattatcaaccaatttaaaaggagaatgttacgcatataacatacctcttctttgatagtagaggtttttaattttttagacgctgttaactgtcagcatgtcattggatgaatgtctctcagataactatggaggtaaatcagaaaagacaacttctcactcaggcagcttctactttgaaaacctttctccctcaaccccatgcatgacagtccaataaagtcagaactggggttagcaaactggggaggaattttatgcaatcttagggtttagaatgtaatcattaaatcgcaaaacacttaaccctcctgtaaattatacagtatatatttttttgcttgtctgtaactatgtttcttgtttttagatgatagggaaattggtgacttcagcatgagagagactttctagaataaactagagtgattcaataaactaattaatatgcactgatgcagaaaagccaggatttggggccatttaactatttatttttagaaaaatgttatacttttaatatttatattttctaataatactgtgtttttaaattataaagggctgattataattaaagtcaataaaacaccttctgcatgaaattagctgctgtaattgaggatgagtgggcaggtattgtcttcatcatcaaataaaagcaaaatcaagcaaatggagactggtttttcccaaggtcagtcattctagaatcacactcagttttgcctgcattcacgaagtggactcacttcatacatttaatgttatattttgtaactgagccaggacatgaagacacacctgtggccatttttcagacagacagccaaatcggagcctcagcattacttattttgcgccatatatctctcccagttcttcccaatttctaacctttggttgcctttagtcaaagaaagagcttagatttacatgcacatgtttaaaaaattcagcaaatctatgactgccataaactctgcatgacatacacagtgtcagcaagttactgctatgttaggctgtaaattattcattccataccttgcacaagaaaatatattcccctttttaagaaagaaaagttcacaacttaggtgactggaaatcaaagtattggcttctaacctattttaaactaagaaatagtgatttattaaatgttaaagttttcacaatttgatgactagtcccttttaaatatcccctataaattattagcaatgatatcaccattctaaaatgttataaatgtaggaaacattttgccttttgtagaaattcatgaaaatcttcatttcatggtggagtaatttgagaaagaagcacagaaaagtagacttggcaacaaatgctatgaaatgtgacttttgtatactcaaaacagacgaacctttaactaaataactctacattaacccccaaaattctgttgaaaattctgtctttgtgccttcttaaatgtaatattgagtatctaagatggaatggtcaagtagcctcaagtattttattaagagagaaaaataacagtggctaacattttaaatatatatcttcccaaccacttaacctttatacatatttttgttgaaaataaacaatgggtctcctgagaagttgtatccagaccagagaaagggaagtttaaagaataggcctacacctattgtttctcagaggttgtgtttttgttttctttgtgggttttcttttttttttttttttaagtattggcctgattttatctgcaggagctgtttaaattaggcctttaagaaactctctgtgcctttttcctcctgcacatgcacctgtgtgcacacacacattctctgacttggataagtacgtgagagaaaatgtaaatctgacatcttttcttttcctaactgtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaaggtgagaaataaggaagtggcacagagtacatgcctggtttctaaatcaccactgctataagaaatcattttatgataaaaggaggaacaccattttatcataagccaaagatccctgaactcctacatctaaactgtgtttccttagatatagagttggtgaatttttccccattttattaagttgtcctcatgttaaaaaagtattattatttttagagacatgttctcactctgtcaaacaggctgcggtgacatggcacaatcatagctcactacagcctcgaattcctgggttcaagtgtttctcccacttcagcctcctgagtagctggtaatacagctgtgtgccatcacacccagctaatttcttaatttttttgtagagacagagttttactatgttgcccaggctggtctcgaactcctggcctcaagcaatcctcctgccttggcctccctaaatgctggaattacagttgtgagccaccacacctggcctgtctccaaattaacaaaaaaattattaacataatttatttgagtcatacaatacatagagtatttcaagtgaattaaaatactataacaatgtaagagaatgtttataaaaatggaagaaagaaatagaaaaaccacccatactactaccatcgcaatgtaaatttctttttcatattccttcacagtaatttttccaattatgtaatttgtataacactctggacataacgtatccataagtggttatgttgttgtttttgagactcattttttttcttgttgcaatatattcttgtcatttagaattactaatgacctcaaaatattcctttgaacaaaggcactctattttaaatttttttctgcctccctctgcacattgtcattacattttcttatgcctacagagcaccataaccttagatgggggtgtcctggtacatgtgcagaaatgggatggaaaatcaaccaccataaagagaaaacgagaggatgataaactggtggtggtgagtatcttctagctacttaattctggatcttactgctaggttatctcatgatcactattccacttaaggaaacagattttccttttgattatctgaaacaaaaagaggattttattggaattatgcttccactctggcatttgcccttcatgcttttgagttcaacaaaggcatgctgtcttctaggaagcattctctgcctgcttccaggcatcctaaggctgtctccagtggtacctccaccatattgtattacctatctctgcttatgtttctcagtcaccatacagattttaaggcacctggaggggaaaacttgtattttcctggtctttatatctccctatcttattacaatatatgggttacatatataggagtccagaaatgaatatctttggaatgaatattgttttattcccaacattcagagagacaataaataaatccatggtttaatccagtgattgaccaagaattgttttttgtgtctaggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatattaaatccttctttaccatagctacagttaagtaggtgtatctcagaaacctaaggtagttttaaatgtagtgaaattgtccacagcaagctggcccaagtgctcacattttatacccgctctgtcttagtgcgttgcaagagaggagtatatacagtagttcccccttatccacaggggtacattctaagacccccggtgggtgactgaaaccacagatagtaccgaatcttatacatactatgttttttttctaaacataaatacctacaataaagtttaatttttaaattaggcaccataattaataataaaacagaacagttataacaatatactataataaaattatgtgtatgtgatctctctttctctctccctctcaaaatatttttaatatctctccagaattcagtgcaaataattccatcatactcacttcagaaaagtgaagatagtcttgtacatgagtagattcaaattttattgtcgtggtttccaaagttttatttttctcaccaatggaacttttgattcaaataaaatatccaagggatttcagcttataaaacacacaaaattgataatgagttttccaaggtactgtgtgtgtgaatgtgtatgtctgtgtatgtgtgtgtcgtctgtatgtttttcccacctcttgtagaagctacgaagcacctttccatattattgaggtttcctgtacgtagactgaaatttacaaatcacatgcttacattttatagtaagacaaaatctgccaaagtgtatattgctgttgatataattctgtttgtgattctctctttaaaaataaatccaaaggttttcatttcctgcatacttatcctatgcataacaccatgatatgcagaggccagaagagatggactagttcactgaccataagaatttactgtttttataaaaacatagagttagactctcactttgggtttgaggaacttaaatatagaagatgtataagcattgataaggacaattcttggtaaacaaatgtttattaagtactaatgatggtgccaggcactttgcaagctttaaatcatttgtcatcaaaataatctgatgggaggatttggatttctgtttacagataaagaaattgaggcacagagctaaacatcataaaactgagtaagaaatagatataagaatctgaaattcaagagagctatcctgtcttgaatatagacctggaagccataagtgcccaagtggtaacttcattcagaaaatgtgataaagtcaatttgaagagggttctggaagatggcagagtaggatgaacaggaatttgtcttcctacctagacaaaaaatgcactggcagaatctgtctaacgtatctattttgaaactctgaaatctattgaatccttgcaaaattcaggggaagtcttagatgataagttgcagttaattttggtcaatttcagctcttaacccagttgcagatactcatacccacccacaaccctcataggaggccactctgcacatgttcctggagcagcttgcagtcatcttgcaggaactaggatgggcaataagaaccaagttttccaaatgttatggatctgtgttttgattgatgattgctgcttctgatcacaaagtgcagacacattggccagcagctattgttgcacacacacacacacacacacacacacacacaacaccccttattgttgtaagtcatttcttcttgggctgaagcagcttccagtgtatttaaaaagtcagctccttccctacttcccacatcatattttttt

SEQ ID NO: 13283 - DNA, 9984 bp, Human
gaaaccagggaacttttctttggcattgtgggtactaagatgcgccaggagtcccgggtggtgcgcgagcggcggaattcgtgacatcgccaagttgcgagaggcaaactccccgattccatccaaagcctctcgcggagcctttaagagacgttgtgtgtgcgcgctgcgctagtctccccgccggggcggaaacctcgggtgcgggatgtggggagagcagaggcagcgctcgcagggccagcacgggcccatccccctctcggcggcggcggcggcggcggcgcggccaccccgtccccgcccccccaacccccggtcccccgcgtgccccgcgccgcgccggcgacgccgctcgcgctaggaccgggctgcgcccgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaaggtatcggcctctcatttctccttccctcgtcctgggtcccggggtcctgggtacgtttggctagcctgctctgggtaaggacaagaagccccaagctcttctcttcgtattgcagcggaaaagggttttatactagaagcgagttctgcattggaacccagaccccaaatccgcatgctttggccgactgatttccttctttactctctctttgggctgtttccatttcctttgcattgattgtgagttcactggagtctgcctttctgcaagggatggggtgtttgttgttgttgttttaaagcctagtttacttctctctctctgcccttgtttttcctgcatgttcaacatgtccctccccctcacccctttccccagcccccaccctctcaaaaaaaaaaaaaaaaaaacctgagattgtacttttgtacaggaggttcaaattacaaatggcaattttatgcacttcgccgtattaacgctgccgcccgggcagcgctcatgtgaccctccgtggattaacatcctgctaaaaaaaaaaatacctctgctttcttttttcctttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtgccggccggcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggaggcaagtgtgcccctctggccctcagagctcgcctgggtggtggtttgaaaggaatggtgccaagagcctggcgactccagctctgtggcaggcctgcctggttcttgcgctgctcagggcctgggtcaggtgggggtcgggctggggcagaccccgccggggaacctggggactgaggctggtcattaactgtggagtgtctcctttcctccccgcagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcaggtaggaaggagccctgtcttctcgtgcccacgggctcctagcccagagctggggcccagagaacttgggagtccccagggcaaacccagtctgctccttgaaaggccaaactgttgagtgcaacttaaagtgggaactttttatagctgctgggcactaccaggcctgtcctggggagaggagaggaaggctggattgcaggaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcatattcttactggaataatgcagactgccaggagaggcgaaaagatgtgtcaggatggggcaacaggaggaaagggaccgtcataactcttcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaattaacttgaggcaaaatgatttttgaaggtgtctggctttccattttgggccacacctgagctttttggctgcctccaggctgagttcagcatagcccaggtggatggaaatcaccaaccccctttcacattcttgtactaagttgtcagctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggttgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaattcttcttcttcttcttcttcttctttttcttcttcttcttcttctgtttttaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatcca

SEQ ID NO: 13284 - DNA, 9962 bp, Human
ctctgtgctataacaataagatagtaacgtctagaaattatatcttaaaaccttcagagtaaattaataaaaattcaacatacttcaagttatcactgtattttttctataattaccttttcgtttactgtttcaatttattgaattatacatacaatgaagagcacaataaatgtacatacagcttgatgaattctcacatagtgagcctgtgttacaagtaatctattattaacttttaagatgatacagtgctatgatcgaaggactaaaatgatcaacatcaccataaaaggcagagtcataaacaagaacaattaagtgtaattaaatcaggtgggaggcacacttacaaaaatgaaacaatttttggttcacattttacaccacacaggtattctgtatctttagaacatgagaaaatacatattctcagtctgataggtctctgacttgggggtttcttttactgtactttttttctctctagtagctgaacattttaaagcaatcagcagaaaaaatataaaacttcagaaccaattagacttttaaaagcaacgttcttgccctttccagagatacattccttaatcctcctacaaatcatgacctcacacgataactttaagggtgaacatcaacttatctacattttggtgctttctttcccttaagtggcagatggtttctattaacctaaaattgaagtcattgttgggggacccctaattccatgtctagtcctagtgcccagaggctaccaaagacgatacgaatagcttctcaggcactctacccaccgtttaccttgttaatacaaatctttcccagacctgggtcccgaaattattttaccctgcagagcagaaatgttacggtgttcattcagtgaactcttccctagtttttaatctttgtattttctgcgtatacttcaagccaccagtaactttcccagttaccaagaaacagtgtaacacaggtcgctatttgttttgttcggaatttacgagcaatttaaccacacgtgattagcaacattaagggggctcctccaggcaaagaatccacagaatgagaggcccttggtacccaaatgaagcaacaatgaaagatcggcgaagctcagcaaggttcctgagcgccacggacgcctgctctgatttcaggttgccggcgcgcgcccgcgggtctgcctttatggacgaggcgcaagagggatccaggaaagacggtgcccttagagactcggagattagcgtgggcaaccctgccaccagctgcccctgccaccagccgcccccacaacaaaaaggaggaaacgctccgcatcccgtcaccaggacaactctgtaacccgacaccgaggctcaagattccgcatcccgggcagcgaacacaggagaaaagcacatcgcggcccggccgcggggctccaaggcgtccgtgccgccgctgttcctggggtgccgagagcgacgcggggtccaccctctccgccggcccgaggtccgaagctcggcccgccaccgctcccggccggcgcctcccgcacgtggcggccgtgattgtcccggggcggtatccctccgcgcccccgcctcagtctccccccgcccttcccgggaccctccgtgcccgggcgccgcggaaggatcgcacgcacgcgcgcgcgcacgcccagccgtgtccgcggaaaacggagggcgctgcggtaaggagcagccgccacaggcacagccgcttcgcagcctcccgccgctggtttgtcagccccgcggctgcgggcggccgggcggccgagcgcgctctgaggttcgtccctcatcgctgaacccgcgtcctcccgccgcagctcctcggggaggggggcggtcggtgcctgcgcagagccgcctcctccccgcccccgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacggtgaggaccagtggcggccggtaccctggtccctgcaccggagcggggtggccggccgcgggggcaccgcagcgcggggctggaacactgagggccgagcccgcaggtgtgctaggcagcgggcgccgaggatgcggctgccgggcgggcggggaggccgaggcccggggacgccccctcacccggggctgcgctgacaggctgggggcggcggccggactccttgctggccctggccgggcgcccccggcgttcccagcgtcggtccaggtgcccgggttgggggagggggcacgcaccggccagggcaaggggaggggttccttttttcctcctagtgcggttcccctaggttctcttgaagccctgaggtttgctatgcacgttctggggtggaagcgggggtcggggatccgggctggggcgcgcgggccccgggtggaggtccctaggctctctggccggctcttgctccgcggacagcgcgcctcccgcgcctccggctgtgggaggcggcggccccggcccggcccccgggattctcgaagcgactttgcgtaggtttaccgatgtccaggcctctggggcttgcgagagatgtacgccgaccgcgtaggtggattcgtgaatctcgacttcagctctagctctataggttgttttttttttttttttaaattctccaagatggcgaactgccattgatttctcttctcatatggagattcatcgatatacggttatccccagttatgcaacatagctcaaaaaaggggtgcttttcgggggctttcaattatctgcgaagaccaggagcacacttcacttctctaagtccctccctctttagtggtggcagtaaaggaactaatgcagttttatgcttcacattgcctgattttcttgagacttgatggttttgagttggttgcaatatgtttggagaatatttgccacaaaacctccagcttattgttttgcctgtttctgcccaaggctgtttctaaaattatgataattgtactaaatacgagaccattctctttatttcttagcaccacgctccctttccattaagcaccaaaattcaggtcccctattaagggtgctaattattcttttaccacttaacatggtttaaagtctaactttagaactcagtccttgatagtagtactttaaggtctcgtatacccgcagtggactacaattcttgtagggaattggcatctggtcatcaacttttttcctgcagtcctcttgtctttgtgtgtgagttcccgctgtctgactaggaagattgcgggagtgtgcttggaaatggctggggcctgctatgactctgcagttctgatgggggcgacgccttccttcttattcatggaatgttagaatgcacgttttctcctttccggttctggtggctacctcagtttctttcccaatctccctccattttttctgttttactattgcctaccgcagtgctgtagacagaatccactttgcgtttgcccagaaagaaaactgattactgagatgggaggggaagggaagttggaaagaaacgggagtcgtggctagaaaaataggagggaaatatgaatttggaaaagcactgatgtccaggggttgaagtccatctcatcacgtatatttctagttactctaagcagagaagtgaacacatcaaagaacaggctttattttgggagactttgaagcaactttaaatttgatgaaacatgatttactgtaatgggactgaatatgatagaccagctttgttcagagttgatagctgaatttttaccattacgtgaacactttcaggcaccagctgacttaatacagtttataaataactctttaagtttgcactttgtctagtgtcaactgtcaactctttacagtttctttgtatagactggtcttggttaagagacgacatcattaactgaagtcaaatcaactcatgtaaaatatgtgattatataggattaaataattatttagaaaagactgaatcttggttttacattagtgaaatgtggctatctggcagtggtagcataagcctagctacagcccttcctgttacatcaagccctaaaaggagttaactacaacttaatgtgtgtgtttttttttttttctttttggtggggggcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagaggtgagtaaggcattcttttggttaaagttgcatgccacattacaacttattaagcagtttcttttaacattttgaataaaagttagtccataatggctattaaggtggtttttgtgaactgcccagcactatggagaagcactgctttagttttacctactctacagcatctatgacctggcctcttagatcctgattttgtttctacgatagaatattcgtatgaactcactttcagctttattaaacttaaaagtctcttaaactgcttgacatgtcaaatcataatcctgtggtgtttcagattgttaaattgttcgaatcacttggttattttagtcccttttggtgtgtgtttgacctttggatctcttttcttttttttcttgcttgtattctaaccatttcactactcagcataaagaaggaaaaattaacatccgttcatttttcagttaggaactttgctggggaaaagataattagatgaggattttggagtaagttgtccattcactgaaatattttcaaagattgtgtctgagacttagatttgaaaagtaggaaattacatttagtttgtatacttggtccagaaattcaggtgtctccagactgttgtcagcattatagaaactcttaattgcactaaagaagtctccctactttttcaaaataaacttttgaaattgagttttattatgacatctaattgatttacaaatacattttaatgtgttaacgcatacgaatattttgtaaatagagagtgcttctgtagcctcacatagctgacttggcacatctaattttaataacagctctaccatgtgaggggagttgaagctgctgtgagttataattaatgctatggctctaccagctccctgtgattatcctaaaagttactcgtattctggtgtgagttgatgtttataaggatttataagaaaattagatgactttgaaatagtgacaaatctctttaaaccttagctgcactatacgctgaaaagaagcgtcaaacacaagacaaaaaaccagaatattttatacgatacagcactactgacatctagtggtagtgaatataaaatttgacatatacatatattttgggttatacacctttgaattgcatcatagaagagcaattagaaatcgtaaacctatttttttagacgcaattaaaaacaaggctactacggtgaagttatcagtaagcaaacaccttaaataatttaatttggccttttctgaatgatactgagtatgctacttaaaatttgatcttcattttcctctggaaataatagatacatttagcctcactggtaaaacttaatagtttaaacttatcaagcatgttaaaatttggggagagtttgtaagtaagtaactccccaggtttattaagtttatattttgggggcaagtaataacatgtacttgacatcagccagaatttttttgccctaaaatagaagacaaatggtcacttttttttttttctgtagctagtgtaaagatagttgtatagaacttttgcttgcattgattggcttccaagatgcagtcaagtttactattttctgtttagtatattactagtttgaaagttctttttggaaacctacttgacttcagtgcttggcagttcatggaaaactaacttaatgttaacttattaatccgggttctgtctgctaaaacttatgtgactttcttgattaacacttcttttgaaacacttttcttctttctctttcagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaatactctaggctcctgttgtttatatacattgtttatataaactgttaaaagttgatttttgacaaagtgggaatacacagaataggccaaagtctgctgcaagcataaaacttcagcaatattaggtgatggcctacttcaagtaatattacagataaaattagtgcctgggaatttctttttaatggactctgatctgttacacatagcttttagtcatttcaggctcatcttcaggagtatgtgagaagcaactgacttatctgctagaaaataagtattttcctcttcttgctggtttctagatgtgaaatctaatagtaaagggagtaccaagaagggtttctgcactattgtggatttttctgtattgaaatgtcatatgactttagatttggaagctgtgttggcaggctgaagtcagccagctggggccctcccacataagagcagaagacattccttaggcagcatataagataattgggatgcttttgcattttttggctttgtagtgacatgttgaccatggctatgtaataggtttaaatccagaggccataaaatccctgatatatattgaagtttgataaatatgtaaatttagggctatttacataaatcattattaccaacaactgtcaagcggacgcttagagccaggggtgctcaaaagttagtaggtctcagtaaaactggggagctggttataaggcagactatggactctggggttccactctggagatggagagtccataagcccaggaatcccttttcagaaacaatcactgagtcagtctgattcattttaagtggtgtatatgctaccttttgagaaaaaatgggttagggaataggaattaacctgtcttaaaatatactatgcataatgaaagtttttttttctttgactagttgtcaggcactggttgtgaatatggttgtacatacacagggatgtacaaatatgggagataaaggatttggggctattttggtagttggacataacctagaaattgtaaaactataataaaaacctggtatcagtttcttgacctgttaaggccaaaagacggggcaaatgaaaatttggtggttgagttgtgatgatttgagattttacaataatacacattcacactttacatgtaaagaactattagggtaaccaattatagaaggcagtgaccaaaattctgaaactcttaattaatctgtaagtaggtgaaggggcagtgtgtatgtgtgtgttcagagaggaggttgtgggtagagaaggtggtaaagggtgagtgtatcactaaaatagtatataatgaaactattcattggctttctacccacaatttcattagaaaaatacttagggaaatacatacatgcgtactttgctttgtacttagttctaggaatttagcatatggaaatgaagctatacaaatttgtataccagaatgtccatcatgctgcattacttatgacatccaaacttggaaaatatctacaaagttcagctttttaaggggtatggtttgaataaatgattttaagtccataggacaaaatagtcattgaagaatgacataagaatgtttaccaatgaatgttaataatataaggatataaacatgtcacatgacagtgcacatacatacagtattaatatacatgtattttacatatgtatttctgaaggcaatatattaagataaatttatctctggagtgaaagtttccaggtgactatattttgatttctagtgttaatattacttttgtaatcaagaaagttttaaatgttttttaaatagaaattggattttaattgcacctactgtcctgtttgaaaagctataccatgaaattatagaacatttcaagtgaacattcacagaacctagtaacagccctagccagtgctgctaaataagacacttcgtagatttttttttacagttagttagtaattatttggaatttcaaaaaaaaat

SEQ ID NO: 13285 - DNA, 65848 bp, Human
ttcccctgcctcagcctcccaagtagctaggactacagatgcgtgcctccacagccagctaatttttgtatttttagtagagatggggtttcactatgttggccaagatggtctcgatctcttgacctcgtgattcgcccacctcggcctcccaaagtgctgggattacaggtgtgagttaccgcacccagccaacaatataattttttaaatattacgttcaggtattagatatagtgatgactgagttttggggtgccccattaaattttgccctcgaacattattaaaaagtcaagaaacagtagatgtctgcgtgtatgtagtgaaagggggatgcttatgctatgcactgctggtgggaatgtaaattagtacaacttgtttggaaaacagtacagagattctttaacaaactaaaagtacactttggggctgggcgcggtggctcacgcctgtaatcccagcattttgggaggctgcggcgggaggatcactagaggccaggagttcgagaccaacctggccaacatggtgaaaccccgtctctactaaaaatacaaaaaaattagccgggcgtggtggcacgcgcctatagtcatagctactctggaggctgaggcaggagaatcgcttgaacccgggaggcggaggtagcagtgagctgagattgtgccactgcacttcagcctgggcaacagagtgagactctgtctcaaaaaaaaaaaaaaaaagtgcactatgggaggccatggcaggcaaatcgcttgagcccaggagtttgagaccatcctgggcagcatggtgaaacctcgtctctacaaaaaatacaaaaattagccaggcgtagtggtgcatgcctgtagtgccagctacttgggaggctgaggtaagaggattgcttgagcccgggaggtcgaggctgcagtgaaccaagatcgcaccactactctccagcctgggtgacagagtgagaccttgtcacgggaagggaagggaaaggaagggaaggggaggggaggggaggggaggagagaaaaagtagattcaccattcggtccagcaatcccaccactgggtatctacccaaaggaaaagagtcattatatgaaaaagacacttgcacacgaatgtttgttttttgcagcccaattcacaatcgaaaagatatggaaccaacttaaataaccatcaaccaatgagtggataaagaaaatgtagttgatatacacgatagaatactactcagccataaaaaggaacgaaatgaagtcttttgcagcaacttgcatggagctggaggccattattctaagtgaaagtgattcaggaatggaaaaccaaacactgtatgttctcactcataagtaggaactaagctatgaggacgcaaaggcatacagagtgatataatggacaatagggagaatgggagggggtgtaacacacacacacacacaaaaccctacacattgggtataatgtacactactcgggggacaggtggactaaaatctcaggacttaccactatacaattcctccatgtaaccaaaaaccactggtaccccaaaagctactgaaattttaaaaacaaacaaatatttgcacccgaggcgagcacctcattcgcctctcgctctctcgggcacctcctggagccagagggtcccatgcggccagctcctccgtggaagcagttgaagttattccagcagcgatcaggccaccgaggatgtccgcccagacaaccacccgcgacggggagactcgctccgcctgtgtccgcccaccctcctcccgcgcgggacacacctggcgggcgcggcactccctgtccgcggccacctggcgcgcagctcccggcgccgggcccgcccctcgcggctctgccggggctcccggccggccaatgggagcgcggtatgcaaatgagcaggtgcggtggcggcccgcccggaacggccgcggggctcccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcaggtacagccgggccggggccccccaccccaacccaggcctccgtcagccttccactcccgggcgagccccgttcacttgccctctagcaggacccaaggtgacagcttctgccctcccttccctcgctttccctctcttctctccaggcaacaggtcactgtcgtcccctccaacccctccttcctctctccaggaacttgctcttcctttccacccttaccgcctggcccgcctccgtgccagctctcccatttccccagcacccctccttccagcgtgttccttctgcagcccctgccctccgacaacctggattcccgtttctgtccccagccccccatacgcctcggctttccttcctcttcacttatcggcctctccctctttgcaaccactctccgtttctgtttggataatgggctcaacctgttcccacctccccatcccacctcacttctgcttcaaagaggcacagatcagtaactcttctcactagcttgggtttcctggtgccgccctggccttgcctgggccatgtctggggtggactgtgtcctccaacctctcagaccttcccttatattcttgtcctacacgctggcttgggactccaaaagagtgaaatgaaaggcatgagccagttttgccaaggaaaagggaccagcactttggaccagactgtgtgctgagctgcacgcttctgtgcagtaccagctcccgatggtatttaagtccttaactcaacctggggcaggttttgttattcccatttcaggatatggaatctgaggctcagggaggctctgattaatgcgcctaaggtcaaatagctaaatagtgggaaagccacatgtatctgactccaaaatcaatgctggctccatcccaaaagtcttcgggtggaggagacagacctagtccacaggattccaggtaggctcaggccagaggcaaagcgactctcttgatgttccccaggcctggctctgggactggtatggggccatcatgcttagatatacagtagttcccccttgtccaaggggatacatttcaagaccctcagtggatccttaaaaccacagatagtaccgaatcctatatatgctatgttttttcccatatatgcatatctatgataaagttaaatttataaattaagaacaataggaagagattaacaacaacaataatagaatagttacaacaatatactgtaataagagctatttgtatgtggtccctttctctcaaaacatcttatagtactgtactcactcttcttgtgataatgtaagatgataacatgaggccaggcaaagtggctgacatctgtaatcctagcactttgggaggccgaggtaagaggatcgctcgagcccaggagttcaagaccagcctgggcaacatagggagaccttgtgtctacaaaaaataccaaaattagccgggtgtggtggcatgtggctataattctagctacttgggaggctaaggtgggaggatcacctgagaggtggaggctgcagtgagccatgatcatgccactgcactccagcctgagcaacagagtgagagctcacctcaaaaaaaaaaagataataagatgcctacatgatgggttggagtgaggtgaatgacaggtgtggtgatgtggcattggctactattgaaaagtaatttaaaacttataaattatttctggaattttccatttaattatgtttttggacccaggttgaccgtgggttactgaaaccatggaaagtgaaaccgtggataagggggactcctgaaaaccaacaattgtcccctgcttctaactcttgctttcaagatgagcccagcaactactcttagatctttggttgaaaggacttagcacccactgtttcaggtggcttttcattgggtcatcctgcctaatttctccatcatttattcagtcatggaactggttccttaatgggttgacagcactgtgctgggtgtggggagatatcaatgaacaaaacgaattcggttcctgtcttcatggagctaatgggataatggggaaggagagggaacacacagatcacatgatagttgcttaattaatggtgtatcagagtacggatctagaggggaggagcatagagagccttcttgagaaagcgacattgacactgagagctgattgataggctgggcttagccaggtggcatgtagcaggaagaatattttgggcaaagggaacagcacgtgtgaaggctctggcaggaagagcttgacatagtaaaagactgcaaataaaaccaacgtggccagaggctgatgggcaaagacagggatgtggggggaggccaaaagtcggccggggccacatcacacggggcttcgtaggctgtggtcaggatttgggacttgactctaacaaaaatgggaagccaggtgagcccgggaggtggaggttgcagtgagccaagatcacgccactgcacttcagcctgggcaatagagcaagactccatcttaaaaaaaaaaaaaaaaggaagccagggaagaggttcaggcagggttcatggtcagatttgcatctttagaagaggacgctggctgcagtttcaaggaggaacagagacagcctaagtgggtgtgaggagatcaggcaggatgctgctgcatggctgccactgcagtggctgtgaccatggggggaagggggatgaattcgggagagtctctagacaatatgctgggactcagcattgtgtggtgagggcccagtttaatctgagaggttggtgtttggtgtcggctcatgctgaagggtttagaagaagatataagaaaaactgagtgcaggaggccaggcacggtggctcatacctgtaatcccaggaatttgggagggtaaggcgggtggatcacttgaggtcaggggtttgagaccagtctggccaacatggtgaaacgctgtccctactaaaaatacaaaaaattagccgggtgtggttgtgcactgggtgtggtggtgccctcccagctgcttgggaggctgaggcaggctgatcacttgaggtcaggagttcgacatcagcctgggcaacacggtaaaatcttatctctgctaaaaatacaaaaattagctgggcgtggtggtgcatgcctgtaatcccagctgctcgggaggctgaggtaagagaatcgtttgaacccaggaggcagaagttgcagtgagctgagatcgcaccactgcattccagtctgggcgacaggtaagattttgtcacaaaaaaatagaaaaggaaaaagaaaagaaaagaaaaactgagtgcaggaaataagagaggttgagactgacaggtttgcggtggctcatgggcccgccctgtgttgtcactgtatcctctagaaaggagccttagggtgtggctcgtcctcgcaacaccatcctgagtatgcttacagccacccctggccagctgccctggatggtcccacctcccagctctgctaaccacctagcaccatggtttgccttgtctgatgcttagagagggacccagggacccagtctcacatgtgcttctgacctgtatgctcatctgttgcctaagagcccgagggcgggccatgctgcagacatccttacttctgggccccaacctgagcatgtggaacaaaactcaaaacaatgcatctgcagacgcatagcccaaacttgacaatggtcacactagcccagccctccactgggctgccagcttctgccttcagagttctaacctaagaactagtacagggttgtctttaaattgagagagaggaaggctgggcacagtggctcatgcttataattccagcactttgggaggccaaggtgggtggatcacttgagcccaggagttcgagaccagcctgggcaacatggtgaaaccccgtctctacaaaaaattagctgggtgtggtggctcgtgcctgcagtcccagctactcaggaggctgaggtgagaggatcactggagcccaggaggcggaagttgcagtgagccagatcacaccactgtactctccagcctgggtgacagagcaagaccctgtctcaaaaacaaacaaacaaacaaaaaacttgtgggagaggttgtcaaaggagaaatctgggggtgggatatcctttcaaagagatgcctggctggagacaatttctgttcttctccctagctaagcccttctagcaagcctcaagctgccttttgcacttccctcctctcctgctggaccagggatgctgacacccttgtggttagagccccctgtctctggaggagcaggaggcttttgctggggaaggggagtgccatgaaccagctctgttgtttggggctcgtttctgaatggtgcccctcctagggccctgtcctgctggtttagcccttggatgggagcatcctggcccttcccccagggagaaggcctggacccgtttgttccccctgcaccccactttgctgcaccctctgtaggtacacacattcacactcacacgaaggcacattcacaaaacaagtccaacttgtttgagccaacatgctgcctgccacggccttggacatggtgaagccaagctgcccaccttgagcgagtgacagagccgtggctgagcagggaaggagctcagggcggtggggtcaagagcctcaccccaagctcaggcgagagcagtgctctgccaggtgcagccacatgttagcagagtatgaagtccacttattgagctgcgaccggcatttttcacaaaagaaatagacaaggaaaggactttaggtctaaacctccttcccaggctatattactgtgtttcccagactctgggcatccatgaatcaccaccccaggtttttttccccccagtttggtgtactatactctggttactcttcagattgtataagtctttcgccttttaccaatttggtgtaccacttgaactgtcataatgtaatatttatctttaaattgacccactttatttttccatgtactcatgcttggcgataataacagtaaaatcaaagcttttacgtgcactttaaagggaatgggggccaggcacggtggctcatgcctgtaatccaggcactttgggaggctgaggtgggcaggtcgctagagcccaggagtttgagaccagcctgggcaacatggtgaaaaactatctctacaagaaaaaattacaaaaattagccaggcatggtggcatgcacctgtggtcccagctacttgggaggctgaggtgggaggatcacctgagcctgggaagttgagcctgcaataagctgtgatcatgccactgcactgcagcctgagtgacagaggagaccccgtctcaataaataaataaagtgaatatggaactggggtttttcctgagccccaagcctgccacccagagcgatgataactgccagagggtggctcatactcccccatgccccaccaatcctggagaggtcctaccgttggcagatatctgactatgccagctgaccatgccctctgcttgagaagactttagggagaaggcaagcctgactcgtcagccactagtgttggggtaaccttgatgtgtgaaggtctcgatgccatgttttaattccacagggcttgtctgtctcagcatggctgagaagtccacagattcagccacacatgggtctgtaagactttgggctctggccattcagagcttaagggcttgaataattaaatggggagggacaataaggaggagatctaagtgcagaaagacttggagtttccaccctacccaggaccgggaacatcttgagctcagcccatcttggaaagccggtctgataaaaactgatgcttggggaatttgctgaactgccgccaccttctgagcagagtagagccgagaagtcgacttactggaggggttgagatcacttggcctctaagggggcatcccaggggagcctgcctgagcaatcaacagtcactgccctctaccacctgcaggggcttctacactctggcctgctgtggtgccagtcgagtctcacctggaggacgaagctagggccagctggtggggcatccagggcccaggtcactgcagttccatggccaccccagggtcagcacaagctccaggagtgctctctggtgtcaccccacaattcagtgaataaagaggctttgagacccagaattgggaagagggtcaaaaattaggattctctggaggaaataaaaagaaacaaacaggattcctagaaatacatgagagtaattgtctttggaagtattcccgggaaataacccagactgatgcttcggcaacagcattcatcatcttcgcttattttttttcttatgacacatgctcctcattggtctgtatgtagtcttcatttatttagacaggtgataagcatcccatgcgctctgaaacccaccacatcacagaaacagcccttgctggcgttaccaggaccttcgccttcctccacccggtggtcagtgctcaccttaccttgcatggcctggcagcaactggtgacaccattgatcacccttcctcccctccagtacactttcttcacctggctgctggatgccatacccttttagttttccacctgaattcatttttgattgcttctctggcaaattatcacaaactcggtggcttaaagcaacacacatttactctcttacagttccaaagtaaaaaatgaatctgcagggaagcattccttctggatgctctaggggagattcttttttcctgccttttccagctactggaggctgcctgcattccttggctcttggcccagccagcaatctcatcatgccagcctctgcctctgttgctgcgtctcctcctacgactgatgctcctacatccatcttccacttagaagtacactcggggtcacactggacccacctagatgatccaggataatctcatctcaagatctttcacttaatgacatctgcagagtcccttttgaaaagtcaggtagcatattcacagattgtggctcacacaccatccagaccccggttgtgacttctcagtctccattgttagtttctctcacttctcatttcccagaaaggtgcacaaagtttaaacatacagctcagtgatttttttttttatgagtctccctctgtcaccaggctagagtgcaatggcacaatctcggctcactgcaacctccgcctcccaggttcaagcaattctcctgcctcggcctcccaagtagctgggattacaggcacacaccaccacgcccagctaatttttgtatttttagtagagacggggtttcactatgttggccaggatgatcttgatctcttaacctcgcgatttgcctgcctcagcctcccaaagtgttgggattacaggcgtgagccaccatgcccggccaattttttttttttaacctaggtaaacatctctgttgccaccacccagatcgagacctagaactcttccagcacctagcacaggctcctgcctcctcccaggcaacagcgcctcccagaggcagccactgttctaatctctatccccataggatagttttgtgaatccctcatgtttatatgggcatcatgcactctgttgatggctgctttcactcagtattatgtctggggtattattgatgtttttcttactcttcacagtaatcgtttccattggctactctgtcctagagaatccataggcagagggagaaaatggggagtaactggagcaagaagagccaatggcttggaccacctgttgatcttcaggagcccccccccttagttttccttctggaacattcccctcacttctgccctagtttggctagagcctcgctacactcactattgtcgcagtctcttgggcaggtcttcctctgttccccattgtctctgaacctttctgaagagaacttgatcatgttatggcagggctcctaagtattcaatggctccctattgccatatcccttaagtccagcttgaatcctctttcttccacagagattctccttacctcctcacctatatctgcttttttccccttcactcagactctcatagctctttacctgaacctatcttacagcattcataacttttttttttttttattgagacagagtcttgctgtgttcccccggccccaggctagagtgcagtggcacgatctcagctcactgtaacctctgcctcccaggttcaagtgattctcctgcctcagcatcccgagtagctgggattacaggtgcccaccactatgcccagctaatttttgtatttttactagagacagggtttcaccatgtttgccaggctgatcttgaactcctgacctcacctgcctcggcctcccaaagtgctgggatcacaggtgtgagccaccacacccagcagataacattctttcttatttaacatatttccactgtggctcttgtcttccctattgttttgtctactaatctgtaaactccccaaggactggacttgtctagttcacctggatttctctagcacacacaggcaccactggtacataccaataggtactaataaatatttgaatgctctgggtatgggctcatacctgtaatcacagcactttgggaggccaaggcagaaagagagcttgagaccaggagttcaaggccagcctgggcagcatagtgagaccttaggtctacaaaaaaattttccaacatagccaggcgtggtcatgtgtctgtagtcccagctatttgggagattgcttgagcccaggaggtcaaggctgcagtgagccgtgactgcaccatttgtactccagtctgggcagcagagtgagaccctgtctcaaaaaaatgaatgaatgaataaataaatgtttgaataagtggatgaatgagttgcttggaaaactgaggtacgtgcataattgaaaaggaaatattagcatatgcaagatactttaagaatgaaacatagccgggcacggtggctcatgcctgtaatcccagcactttgggaggccaaggcaggcggattacctgaggtcaggagtccgagaccagcctggccaacatggtgaaacctcgtctctactaaaaatacaaaaattagccaggtgtggtggtgcatgcctataatcccagctacttgggaggctgaggcaggagagtcgcttgaacccaggaggcggaggttgcagtgagccaagatcgcgccattgcactccagcctgggggacaagagcgagactttgtatcaaaaaaaaaaaaaagattaagaaaaatctcttttctgtgtcttgttaaaaggttgggagttgatggaaaggatggagaaccatcaagcaagtcactcatttctgcctttgtcctcggttctttgcagccggagagagttagcaaaacctctcccttagcaggctcttacagtctacccgtcccatgagtctccttcaggggttagaagtgaagttaaccatagaaaatctcaatcaagacccacattgctctcagggttaagacccccccagtcctcatgtagctataagtacctgggtgacactcataggtatgtcccaggttgcctgggtttctagtcctgtttactctttctggtgtcttttcatgcaaaattctctaaagcacatagactcagaacagtggttctcaatcttctctaattgctcctattctttttttttttttaaacttctaagttcagcaatacatgtgcaggtttgttaaataggtaaactcatgtcatgggggtttgtagtacagattattttgtcacccaggtgttaagtctagtacccattagttatgtttcctgctcctctccctcctcctatcctgcaccctcgggtggaggcctcaggtatctgttgtttccatctttgtgtccataaattctcatcatttagctcccacttataagtgagaacatgtggtatttggtttctgttcctgacttagtttgctaaggataatggcttccagctccatccatattccctcaagggacatgatctcgttcttttttgtggctgtatagtattccatggtgtatatgtaccacattttctttatccagtctaccattgatgggcgtttgggttgatttcatgtctttgctgttgtgaacagtgctgcaatgaacatacatgtacatgtgtctttgtgatggaatgatttatattcctctgggtatatacccagtaactggattgctgggtgacatggtattgtaaggtgggcagaagactctaatgaccactttccccacctgctctttctctctgatggaaaaagagctcagccacaacaacaaaattcgagaacaacaaacttgatgctagcaacactcataaagcttataactgagaaatatgaacttccaactcagtactttatattgtgaaacactgcctccaaaacactattatccaaataacttcagtttcttaccttgatggtatattgcaaagtatttaaacagcaataccaggcaagcaaatttgaaggtggtgggatttgctttaacatatttgaagtctgatgcatagaaagtatttttaaaatcctgttacagtaaaactagtagccaccaatttcattcatgaaagtatgtcattatatacttagagtgaaccatgcaacctgcaataaacttgcttgaaaattacctaagtaaattagttgtaatttctcctttaagagggggagtagaattctagttctctgtgttctcttgtgcccagtaggacctttccagtgttgcttagcattgaatgatgttcagattacctaatgagaaatggaattagagtttttagggatctctagaaatggctggttttagtttataaattccaggccgggcacggtggcgcacgcctgtaatcccggcactttgggaagctgaggaaggcggatcgcttgaggccaggagttcaagaacagcctggccaacatggtgagacctcgtctctactaaaaatacaaaaactagccgggtgtggtggtgcgtgcctgtaatcccagttactcggaaggctgagatacgagaattgcttgaacctgggaggctgaggttgcagtgaatggaaatcacgccactgcactccagcctgggtaacagaatgagactctgtctcaaaaaaaacaaaaaaaaattccaaacgttaataacttataataacccacttaggtacttgtacatagcccctagtcttaggtaataacagaaatctatgaaatggcatcgtttactcacaaagatcaaagaaagacctcaaattttaaagtcagtttgatcaaggcctacactttgggaccctgttgtggaggaataaggagcacctcgctggactgaataaatccagcttccatgatcctgtgttgcccccaaacagggaaaaggacagatcagcttggtttcatggttgctttctcttgtgccaggcaaggtcttctggaaacaaccataatgacttctgctggttggagacaaggtgccataaaaaattcagttgttccttagacccaagtagaagagtccttgaatcctaataaaaggccacttttttaagtttttctactctaggccgggtgcagtggctcatgcctgtaatcccagaactttgggatgctgaggtgggtggatcacaaggtcaggagttcaagaccagcctgaccaatatggtgaaaccccatctctactaaaaatacaaaaattagctgggtgtgatggcatgcacctgtagtcccagttaatcgggaggctgaagcaggaaaattcttgaaccagggaggcggaggttgcagtgagccaagatcgtgccactgcactccagcctaggtgacagagtgagactccatcttgaaaaaaagttactctattctaaatgaagaccaatatttcatagacataggacaaggggttgggagagggaaattgattatctttaaaaaagaaactgaaaaggacttaaagttcgcagtgttgcactgatttttagttgagcaaataatgagtcaagtcgtgttggttttgtgcacatgtgtggtttttccaaaaaaattgtatgggccgggcacggtggctcacgcctgtaatcccaacactttgggaggccgaggcgggtggatcacgaggtcaggaaatcgagaccaccctggctaatacggtgaaaccccgtctctactaaaaatccaaaaaaattagccagacttgatggtgggcacctgcagtcccacctactcaggcggctgaggcaggagaatcacttgaacctgggaggtggaggttgcagtgagccgagatcacgccactgcactccagcctgggtgacagtgagaccctgtctcaaaaaaaaaattgtgtggaagcacaatgtgacatgccataaactccaatttgaacattcacagcttactcctaaatgagtcatcttattaacaagtgtatttaagggctaagggtctctcttcatcctttaacaggtctatctcttttgaaaggcttcttccttcattcattgcccctttttcaatactggcctccttatttggcaatggagttgtgagtcaaacagttctccactgctttcagtgacttcatgaagttttctattttttttctgcatggatgtttatcttactttgcattttgatacattgcatattgttggatgatagcaccctctaaccatcaaagagagaacactttgcctagatgggcagggcaaagttggggtaggaggtggtcagtatttgagcaagggccaaatttattaaacaactgactcataaatatctacatgatttttgctgtcttttgcaacttgaatcttcaggaacgcagataaagaacagttggataacgatgatccctgtagagctaatagtaacacaccttaagtgtatatagtgatctacgtttttctttctttctttctttctttcttttttttttttgagacagagtcttgctctgttgcctaggctggagtgcagtggcgtgatctcaggtcactacaacctctgcctccctgatccaagcgattctccagtctcagcctcccgagtagctgggattacaggtgtatgccgccatgcccggctaatttttgtatttttagtagagacagggttttaccatgttggccaggctggtctcgaactcctgacctcagggtgatctgctcgccttggcttcccaaagtgctgggattacaggcatgaaccaccgcgcccgaccctatctacatttttcaaagtatttttccatagactttttttcccttccaacttttattttaactttaggggtacacgtgcaggatgtgcaggtttgttacacaggtaaacgtgtgccatggtggtttgctgcccaggtcatcccatcacctagatgttaagcccagcatccattctctgtctttcctgatgctctccctcctcccaccccgccccatagatttctacttgaactcttaaagtgggtggagtagatgtaggaacctgtatttcagagagatcctgcaatatgggtctccaagtgcccagtattttcaatgcatactcattagggacaaatcttagacatgagattaagccgaggggtaccaaatacatttctttcagatctaggagggatgaggtaccatccaaggtcacctctgatccttctgactgggctgaagtcaggcctctgaagacagaaggagaaggatccttaggcggaagctgtttgctttctagacttcataaacttgtcttctaggatgacgtgaggcaatgagtatactcatgtgatggggatttcctggggggagcaggcatgccttcctctgacgtgtcattgactccctgcacgctcagttactgatcaatcagcggatcactccagcttcctggcagctgccctttcatggggtgagggagtgtgggtcagagtgtaagctgggatgatgtgttggcttgaaaagctttacctgccatcacaggcgcttaggaaatgcctggttgctgcagttgtatcccaaagtctttaatttagacaattttagtttagccagtctagagaatacttcctttatgagcattagggcctgcaaaacaccccaaatacatgggaaacctgaaataataatgatttgtggctcccagcatgctccctcgggggcctggtgtcctggaggctggtctgacttgcccggaggtcactggtgtgtggctcagctgcagcggcagcgtagtgggtgtccaggggagtggacaagcaattctcctgtcatttgcaactttcttcaggaactcagataaagaacacttggataacgatgatccctgtagagggatttcatctgtaccatcacacatggaagaggagttgctaggtcaggaaaggcagctgctaagctaaggttcttgtccctttgtccttgcatgcctaaggaggggctgtccaggacaaggtaactttgtagatcctcacctccttcctaaaaaaacttgccatggggttgcaatgtgccatgtccatcagtgctccagcagacaccaggagaggaagaggggacccctaggaggtggctgctgcttctcctgtccaagatgcaagtcctgtccaggtgaaatagggcaggcgaggccctggctgcactgccagacagtatcccataggcagacagagcctcaggccagcacctcgccttccagccagcatggctgtgactccctaagcagcctgatccaggattgctgttacctctggagtgtcttgctagcagaggtgaccttcccggggaaagtaagggaattttaaatgctccttctatctaggtttctcttgtttagaaaacaaggaagtacatgtgggtgacacaggtgtgctcaacaaacaggtttaagaagggtctttagtgggaagaatggaaaaaggagtgggaaactcttacttcctccaccactcttgatctcacccacaaaggtgagttcaccttgcaccctgagtgggttggagctgatcccagccaatcagccgatggcatgttgctacctcatagccaggaaaagcccatctcagcagtaagacctagggccttccacatcagaccttctctacggcagtggctggtctgacttgggaaaatggaggaagatagatgtgtcatgaatgaaacgtgtgtagtatgttggtgcacatttaaagacattgaagactgacatcgaagttcccttatagaaataaatgaatcctggagttctaattgctggtcccacctaagtatcttctccttcaggataagagtataaagaatgtcccagactagatgtcatgagtctagacccgtgttaagggagaacctgccaggtgcaacagagtgggacgtgacctgataaggcaggggaccaaggtgactcatgaactttagtgcagagccaggcagccatgatgagagcagagtttgtaggcagctacctggctttgagccttgcatgcagccaagatcccaaggccttcaggaggattcccctggaatgttctagatacaggaagcggtacctgctgaaagggctgggaaggagatttttcctggactgtttcaaatccactgtgtcctagacacttgcatttttttaaattattttttaatattttgtagagatggggttcttgctctgtggcccaggctagtctcgagctcctggcctcaagtgatctgcacacctcagcctcccaaagtgctgggattacaggtgtgagccaccgtcctggcctagaaactctcattctaatcgacattaattaatactctctaatggcatttcgttaggattgatgtcaaagttttatcacattctgcagtattctgtttgttcagggaatggataggatagttgaataaaattagagtagattttttctatcataataattacatattaatatagttcataaaaatttaaatagttaagacgaacgtgcaaaaaagaattgtttccagccgggcacggtggctcatgactgtaatcccagcattttaggaggccgaggcaggcggatcacgaggtcaggagttcgagaccagtctggccaacatagtgaaaccctgactctactaaaaatacaaaaaattagccgggtgtggtggtgtgcgcctataatcccagctactcaggaggctgaggcaggagaattgcttgaacccaggaggcggaggttgcaatgagccaagatcacaccattgcactccagcccgggcgacagtccgagactccgtctcaaaaaaaaaaaaaaaaaaaaagaattgtttccctctcactctagtccctctataaataccatcattttttgtgtaatctcacagagattctacccatatacatgcgtatatatatatttaaagacaggctctcactctatcacccagactggagtatagtggtgctatctcagctcactgcagccttgacctccccggctcaggtgatcctcccaccttagcctcccaaatagctgggactacaggcacaagccaccactcccagctagtctttgtattttttttgtagagacagggttttgccatgttgcccaggctggtctcaaactcctgggctgaaacaatccacccacctcagcctcccaaagtgccaggattacaggcatgtgccacgacgcccagccacacatatagtattatctttttatttctcacataaaggaatcatatgaggcagactgcttgacaacttgctgtctttttcacccaatgacatattttgtacctctttccatatcagcaatataattttactccattctttttaacagctgttcctattgatgcttttatctattacgtcagtgtcacaagaagcattcttacacaatcgctttgcatatatatgcaaatcaaccataatacagagtcctggatttggaatttctggatccaaataatacacatcttatattttaatagatagtgccaaattgcccccaaaacagttgtaccagttttaactccctccaaaaacgtgtgagaatgcctgtttctccacactttcaccaattctgtgtgttagcagtcttttcaatcattgtcaatggatgaaaaaattgctccctgtttaaattcttatttatatgaaggataagggaggttctgagtctttccatgtttctgaactttttgcacgtttttagtaaactgccttttcatgtcctttatccatctttctattgatagttgtctttttcttactgatttataatctctccttagaggtaaagggtattagcctgttttttggcatctgtgttactatttttcttccacttttcatttgccttttgccttgcttaatgttttttttttcaacgcaaaacctttaaatttccttgtagtaaaagacaccggttttattcttagaaggttctgcccctactttaagattttatacataaaaacaaaatatttcagtttcctactaataattgtatgcttagtgtttttcttgtgtgtttgtttttgcttaaatattttgcttccctggaattttttttggagggatggggtgtaaggaaaaaaataggtattattttaggtttatatttttccaaattactaaccagttttcccagtagatttattgaatgatctatctttttccactgattttttttaaaaaacctactcttttcacatatcagtcatttacatatatagttatttaggtctgtttttggactatattctataccaatgaaatcactactgttttattaggttttagccatttgcgtttttcctccttgcattcccttgcagccaagactctgctccgctagagaaagaaaaggaacaggaggtgggagtgattctggagcctgtcaccagccttggcgaacacagtcaagtttgactttcaaaggctagggctgccgggcttgccctgggccctgaggtcatgtggctggagcagataagaagccactttggagaaacccttgcaagcggcagcccccagcagcatgtgtgtggcccacagtggttgtccgtccaagcagtgatggaatagtagtgatttcagccaggggatgcgggcatggggaggggtgtggaaggagcaggtagctgcagcttgtcctggaactcagcattcaggtgggtcctgcttattcttcctgctttgtgttcacagcctgtggttagaggggaggcctgcaggccagattccacgtgtgcgtggatgaccaaggctaggacggcagaggggcagccatgattgctagggggaacatggcacctctactggaaagccacttgaatctcaaactttactctccctctggccgagggaactggacatgtattccgcatctcctcctcgttcctttcatcagaattgcatgaggagcatattaaaatagattcctgggactttctggggagatggaactggtctgtatcttgatttgggcattggctgtaaggaggcatatcgttgtcagactatacccttacggttgatttttttttaactatatgaaaattacgcttagtagggggaaaagagagccaaataaatttaacaccagctttatagtcactcctaagcaggtgacctcacatttgcaagagttagtgctggtatacacaagccttataaagactgctttggaaagaaaaagtagaatgtgaatggtgaaatccaggttagaggggatgcaggtgctcctggtgagattctcccagtttgctgtatgtttgaaattttcctaacaaaatgttggacaaaatactaagtagttaccctgtggaaatcattcacagacgtgttcttaaagaatgagtagaaaaataaaataacagcacatgaatggttatatgcagcaaaggatcacatttccagtgatattatgttggccatcacaaagcaccgtacacaggatggcttaaaacaacagaaatgcactttgggaggccgaggcgggtggatcacctgaggtcgggagtttgagaccagtctgaccaacatggcgaaaccccgtctctactaaaaatacaaaaattagctgggtgtggtagcacatgcgtgtagtcccagctactctggaggctgaagtgggagaatcacttaaatctgtgaggtggaggttgcagtgagccgagatggcatcactgcattccagcctgggtgacagagcaagactccatccccacccaccaacaccccccagccctgccaaaaaaaaaaaacacaaatgtattctctcacacttctagaggctggacagcggacatcaagatttcaacagggttggttccctctagaggctgcgaggaagaatccacttcaagcccctctccgggcttctaggggggctgctgtcctttggtgtttcttggcttgtagttgtatcgcttccatctctgcctccatctttatgggtgttcttcccatacgggtggctctatgtcaatgtctcctcagtcccctcttaggaggatgctagtcatactgaagttagaacccaccctaatctagcatgacctcatcttacattgattacatcaaagatcctatttctgaccaggggtggtggctcaggcatgtaatcccagcactttgggaggccgaggcaggagggtcacttgagcccagaagtttgagaccaacctgggcaacatagggagaccctgtctctataaaaaatacaaaaattacccggatgtggtggcgtgcacctgtagtctcagctactcaggaggctaaggtgggaggatcacttgagcccaggagtcagaggtctcagtgagctgagatcacgtcaatgcattccagcctgtgtgacagagccagaccctgtctcaaaaataaataaataaataaaaatcctgtttccaaataaagtcacattcacaagctctgggcggacatgagttggcagggggaattggaggaggaacactattcctcccagtaaattttttttgttttttgttttttgttttttgttcttgagatggagtcttgctctgtcacctaggctggagtgcagtggcccaatcttggctcactgcaacctccacctcccaggctcaagtagttctcctgcctcagcctcccacatagctgggactacaggcacgtgccaccacacctggctaatttttgtatttttagtagagacagggttttgccatattggccagtctggtcttgaactcccgacctcaagtgatccactcaccttggcctcccaaagtgctgcaattacaggcgtgagccactgtgcctggccccaatacagttattattaaacaacttctgccactcaaacaacctagatgaaagtgaatatgaatgctcattggagaactatggtctattgaagaaaaatgactccaagacagagagttcaatgtcgaagactcatgtgaaaagtttgatgcttcacttgagtgaaaaaaatccgtgtgtaactaaagaattaatgtgcgtagattatatttttaaaagattataaggccaccctccaaacctacaaaatgtaaatctctggagtcaagacctcagaaatctgtattttttgtaaataccctttgtgactccggagcaccatgaagtttgttgtaacccattgtcctagaaggataaggacagaagaaaaatggagatggggaaattggaggtgctgggtgtggcttggcaggcagtgcttatggggttatttatttattttgagctggagtctcgctctgtcacccaggctggagtacagaggtgcaatcttagctcactgcaacctccaactcctgggttcaagcgattctcccacctcagcctcccaagtagctggaattattacaggtgcgtgccaccacacccagctatttttagtagagacggggttcactatgttggccaggctggtcttaaactcctgacctcatgatccatccgcctcggactcccaaagtgctgggaggcatgagccacctcgccctgctgttcgtggggttattaaagaagccacatcctcaagctcttgtcgtggtgcgtagcgtttggtgcggagcagttgagctgtggacactgaccgggcagcccatgctcttgccctctgagacagaggagggagtctaggatctggagcctaagactgtgctctagttctggctctgtatctaactggcggtgtgactttgggcaagttaatcaacctctctgagcagtgtgttcctcacgccctgcctcccctgcaggattctgtgtggctacagtgagataatatgagagctgtggaacaggacgcagggatcacacccacacaggagggcaaggagtcccttcagctccagcttctgctaaccaggggtgggtctctgctaggtggtgagggacgggtgttttcagaacctgagctgctgtgtgcttggaccctcctgggcaggactgtgcacccctggaggagccggagaatgtgacattctggtctctctgagtcatccctccaggcctggccagggagatctgcgatggcctcccgccttcactccatcttcacctggacaggtgcagcactatacccaggacacttaccctggtcagggaaggacagtccccaaaggtgaggctggccaaggccccagtttgtcttgggggctcacggggctgcctcctgctccccaccatcccttcctccattcagccgcaaatatgctaatatttcctctgtgccaggcaccctgcttggtgctggggacaaaaagacacctggctgagacactcatggggattacctcagaggagtgagacagacatgataattacaggtggcagcaagtgatgcaatagaatagaaacattctgtatggaccaataccctgggtcagaaacattccaggcagagggaacagcaggtgcaaaggccctgaggcatgacaggaccgagaggagactctggcattgctggagcatggggagggatggagtctggtgggggctgaagtggaaggaggtgggcaagagccctacttggtggggctcatgggtcatggccagggatttagattttatgctgagaaccaagggcggccactggaggattttaagcagaagactgacagattttctctacatttgatcagttagctctggctgccatgtggagggcagattgggcttggggggagtcaagagtggaagcagcaagagagttaagaggccattgctattgtccaggtggcagatgggggtggcctggattggtgactgtgaggatggagagaatttgaaattgtcgtggacatggaaccattagaacttgctgatgcattggatgtcagcagcgagggaaaggaagaagttgaggatgacaccaaggttttggcttgagcaactgggcgatttgatttatggaaatgattaatactggggtgggtgtccatgtttgggataggactatcaaagctcaccggggccaggtttgagatgccagggaaacatcagtagagattttgaatactgattgaatatgtgagtccagagctgagctgtccaaggtgggaaccaccagccatattagacagcacacatatagaacatttccatcactggacaaaatcctgccgggtggcactggtctagagctgtgtcccagcccagcaccataggcatttctctctgggataatggcacccaatctgatggtgctgtctacgaagctgctgtccgtgtgtcatttgcaaatggctctttcttgccctctctgcttgatcacaccagaatgtgtattcagtgctgtcccttacctgtggccatgtcaggcaggcactgacctcccagaaagacaatttaccctgtggtcatttaaggaagtcacttcctggggctgaagcatcattatggtgacgagtgtaacacatagaatggaggctatacccaccaggcgtcaccagttgtcatgaattctaggactcactgcgtagactttgctaattgaagaaatgtgtgatggggccaggcgcagtggctcaaagttataaacccagcactttgggaggccaaggcgggtgggtcgcctgaggtcaggagttcaagaccagcctgggcaacatagtgaaatcccatctctactaaaaatacaaaaaattagtcaggcatggtggtgcatgcctataatcccagctactcgggaggctgaggcaggaggatcgcttgaacccgggaggcagaggttgcagtgagccgagattgagccactacactctggcctgggtgacagagcgagactctgtctcaaaaaacaaacaaaaagaaatgtacagtgggaccaggcacagtagctcatgcctgtaatcccagaagtttgggaggctgaggtagaaggatcccctgaggccaggagtttgagaccagcctgggcaagatagcatgacctcatctctaaaaaaaaataaacagattagccggccattgtggcatgtgcctatagtcctaactactcaggaggctgaggtagaaggattgcttgagcccaggaactcgaggctgaggttgcagtgagccatgattgcaccactgcactccagcctgctgacagagcgagaccctgtctcttaaacacacacacacacacacacacacacacagtgaaaaaaaagaggacataggcctgaatccaatggacttgtcttctagaacacaccatgccacctgagacaagtcagccaatctttctaagcataaacatccttaactgcacagggaggagattgcatggccaggcatggggagagggaattgcttgaatcagcaaaaagaagtaggaggtatgagggagggtgttgttgttgttgctgctcttgttgtttgggttttttaaataaaacagttcagtgactattattgtttttcgtagtataatcatttgccattttgtaaacagtggcaagaacaatatttttctttcttaaattattagataataaaagacgcatttcaaaatattgtttctggaataatggcatatgaggttgtttgtaaatcaatagtcttgattctccttttaaaaatagcaaaatacaggataattcttagattggagtgttgtgcaatagatctgaaatttgttttattatactagttgggtcagtgaggagataatatattttaggtgtcgtacgtgtattttccttgtggaatgcacatcctgtaaacctacttgaggtggcttgaggtctcagtcttgagagactacggtccagaagtggtctcagcaagtctgcaaaaggacatgttttaaggaactcatgtcctgtgagctgttgatgctgctcattggagttgaaactcagatcctcccattttacccgtgcagcaagaggcaggattttgtaaggaaagacccagaagggaagcctccaaaagcccctcttgtttaccctgacaagctctggccgcgtcccttccagctgtgctcccagcacggagactttccctgggggcctctccagatccccaagtccagcattcactggaaaaacccacgtgtctccctgactcagtgcattcttggaaactttgccctaatccgaggttagaggctggagggctaaggatcccggtggctgccaacagtcagtggcaacatttggtaaagaatggagttagtggcttgaaaacccacagggggtatcctagcgagtggtaatttcattttttcaaaccactggccccttttcctacgtcctgggttgcctgcccacctgtgctggcttaggcttccggtgtcgaggttgctggcaatggcatcagagggagttcacttcacgagcagaagcaatgctgggtccgtggtgaatagagtcaacgccccagggcccaagactgtctttttgttctccacacacctgagctggagagttggtcacagctcaggcacaggtttcctgctggttttctttcctcctttcctcttgctcccgtgaataccaggacggtggcctgcagggcccatcgccttgcaatgactgcggggagggcgaggggtgggtgggcttcgggggttctgaggcttctcacttgccagatatggtttcttaggccaccacaggcatccagagctcagctcctggccggtcctgactcctggattggatctagaaaggcagagggcagcttattaaagatggaagcaagcggatccgctgccttcatttcagccgaaagcttttaccaaaaacaaccagctcgaaggggactgctccctgggggccgcagaggtgggcttgttaatgcaaaaggctcctccccaagaaaggctcttgctgcagatacagataacggcttggaacagccttggcaccatcatctccctctggggcctgccccttcctagctgccaggggccatgtgccacccaggggcgctgcgacacctggaccccccaccttccccctgggcctccatggggtgggggcagctggacccaaggcccgaggcaaccattccctttcagaaaaagggttttcaggcaaaatccaggctatgggataaaaggccatctgtccgtcccgcggtgcccagccccagctttcccgaacaacatgcctttatgccggcgcccccgcccccagcccccgcccgccgcacactgcctcctttcacgcggcctctatggtggacttgtttgtttgtggtgcagagcgcagactttctgttgttcttctctgttctctcccccgtgcgccgtccaagcaaaccctctctagggaggacagggtctgggaccctggaggaagctgggggcttggggacctcccagagagtcctccacgaggggagaaaggaggctactgtgaggaaccttcccgggaacagccctcggagtgggctgctgtgtgctccccccgcccgtccagcaatcacttgagagatcttgaataagtcattcgggccgcctgtgcctcagtttcccccgtgtgtggaatgcctcctgccagtctctcagggagagttgtgtccgccccagtgagacgccgccacatgtgcgcctcggtgaaggtgcttgtggtggagatggcagggctgttccagctgccacgtggggggtgggggaagtgcagaatagaacaaggtttgcactaaagagggcggcgtttgcttcactgctccacgcgcagcgtttccatgtagggaaaactgcgaagtgacctctcaggccctaaagaaggggaacaaggccgcccctggctgcagatgggcagcagtgggctaggaacggacctatttgaatgcctgtcctatttgaatgcctgtccccccggggccatctgtgtggcctgcccctgcgggctgggtggcaaggctgtgctgactgaaagagcctggtttctgccgcgtcctcagcataggatgaggggcagactcctggctccacggctcctcggatgcctccctcggttgtcccctcttctggttggattccctctcctttggtggcggtcttgatcccagatgaaactgattagctgattcaggccttgttacaggttttctaggctgctgtaacaaactgtcacaaagtgggtggttgaacaacagaaatgtattgtctcgcagctctggaggccagaagtctgagagcaaggtgttggcagggttggttccttctgaggacattgaggggcagtccttccagccctcccctgagctgctgggggctgccagctgctcttgaccatccttggcttggagaggcattgctcccatctctccttccatcttcacacgcgtgtgtctgtgtccaaatcaccccttttataaggcccaccgtaatgatctcatcttaactacatctgcaatgaccctgtttccaaagaaggtcacattctgagacactgggggttagaacttcagcatagagttctttgtgaggactggcatagctcaacccacaacctctacactgggaagcgagaccctggaggtaacgcccttggtgcatggcctgagactctactgtgattccttacccctcacagattttgtcacttttctttctttctttctttcttatttatttatttatttattttgaggtggagtcttgctctgtcacccaggctggagtgcagtggcgagatctcggctcactgcagcctccatttcctgggttcaagcaattctcctgcctcagcctcccaagtagctgagattacaggtgcctgccaccatgcctggctaatttttgtatttttagtagagatgaggttttgtcatgtttcccaggctggtctcaaactcctgacctcaggtgatccacctgcctctgcctcccaaagtgctgggataacaggcatgaaccgccatgcctggctaattttatcacctttctagacataaggggaggagaaccgggaaaaaccaggtccaacccccacttctactccctgacccgctgcttcctctagaaaccagtccccacctgaggttgcccttcatcagaccttgctgggactctggtccctctggtgcctacctgccctgaccccacctgggccttggtacaactggccctgaatgcctgccccatgaagctatatagcccaggctccccattggaattccctgttctgggaattgacagagagaagaaaacccctgctctcgtctgtctctgctcatccttctcagtggacagggcatcccagggagcaggaggcctgcagcttgcctgggagtttcaaactggcaaaccaagggccacatttatattcatatgtgttggttcggcccacatcatttgttttaaatgcaagtcaaattttaaaatctggagattttacataaaaatatatttttccagcttttcatagaaatcagggccaggcgcagtggcttatgcctgtaatcctagcaccttaggaagccaaggtaggaggatcacctgaggccaggatttcgaggctaggaggttgagactaacctgggccacatagcgagacccccttttctaccaaaaaaaaaaaaataataataataataattgagcccaggagttcaaggctgcagcaagccatgatcacaccactccactccagcctgggcaacgaagtgagaccctgtgtcaaaagaaaagaaaaagagaaaagaaaagaaatctgaaggtctgacaacccttggtccccatcctcctatgacttggacctaagtcagagctgccctcttgtaacagggtgtggcccctctatttcactgtagtctgcttcattccctgcagcctccttgatacgaagatgcagtgacaggccaggcactgtggctcatgcctgtaatcccaaggaggccgaggcgggcagattgcctgagttcacgagttcaaaaccagcctgggcaacacggtgaaaccccgtctctgctaaaaatacaaaaaattagccaggcatgttggtgcatgcctgtagtcccaactactcaggaggctgaggcaggagaattgcttgaactcaggacacagaggctgcagtgagacaagatggtgccactgcattctagccagggctacagagcaagactctgtctcaaaaaaaaaaaaaaaaaaaaaaatccattgacagtgactcgataccatccttgtggcttggactgaccagagaggaaataacgcctggtgatgagccaggaattggcgttgtgctgggagcagtgagggttggtacttctgtctcaaaggcttctctcctgtgtggccttggactgtggctggaaggctctaaggaggttgaagtgccctccctaccctccattgcccggcacgtccagtggctcttggctgggaatgagcagtgcctgctgaccccgtctccttggcagagcaccttggccattgcttgtgcccatccttttctctccaagtagacgtgggctatggaaggctcttttcctgcctgccctccccacgcatcggtggcctctccaggcctggggcagggggttggggagggctctcagagtcgacccaggccacccacctgctcgctaatggatcactcagcaagtattggcagggccaagcctgtgctggggactagggagtgagcagttagcaagattgagtggggtctctagtgcacggtgcttatgggctagcttggaatacaatcaacaggtaaatgcggtatcaggagagccaggtgcccccttgccactcaacagccctggagctgaacacaagagtgtcaagctgtctcttctgcctaccttcccaaggcagagaggcctggagggactgggatgagggcttctgtcctcagcaccagactgttgccctgggacagtctcgttcgcctcagggtacaagaaagcaatcacctgacacagatgggttggacaccccctgtcaagccacactcatcaacacttgtgctgatcactcctgtgaaagccagtgtgggtctaactacaaaattgttcacttcccttaccaaatactgaaacctacccagttcaaaggcatcaccagccaggcgtggtggttcacacctgtaatcccagaactctcggagactaaggtgagcagattgcttgagcttaggagtttgagaccagcctgggcaacatagcaagaccccgtctctataaaaaataaaaaatttggtggacatggtggtgcacacctatagtcccagctatttgggaggctgaggtgggaggatcacttgaacgtgggagttcaagagcagcctgagcaatagatcaagaccccatctctacaaaaaaattaaaaattagctgggcatgatggtgaacacccatcatcccagctacttgggaggctgaggtgtgaggattgcttgagcccaggaggttgaggctgcagtgagccaagatcatgccactgccctccagcctgggtaacagactgagaccttgtttcaaaaaaaaaaaaaaaaaaaggcatcatctggaataatttccaaatactggaaaaaagaaagcacacatatcttcatttgaggcactttttggtttttaaagtgtttaaaaaccaccctttggcttgcttccaggaccaggagaaccttttaaataatgaatgtgaaagtttccaagaaactttctaaaagccttttaaagctggggttgtaccctagttcccaggaatgacctctacacactcctgattcatggatggtgttcgcctgtggaattcaagggtgagctggctcaactataaaataaacaccggggcgggagtctggaaaacgtggcccagatcaacgtgtgtggcatgcgtgcggcacagctgctcctggcaggacccagttcctggagtcctggcgtgccccaggtgggaatgggagaccttcttcagaagggtctttgtcttagctgtgtgtagggagggtttttagacctagaatctcacaactagacttgagaaaatcgattaatgaacaatgcaccggaggacgtgtccctgtacctaggagtattcctgctactgacaccgcgtgacgctggctctggttttccttggagtctcctcccatgttggaggtgtgtcccatcttgtgataagaacctgggcttctgccaaggaggggtgtggtcccaatgaagccacccaggaaagcaccttgcttagtcagtctggggcttatttgccagaagcatatcagtcctgacattgctccctggggtggccctaggacccgagagcagaagcaggaaggaggatagaaagaggccatgccgacccccttcccctttgtccctcttttcctcagcctccatagagagggtgccccctcttccagcccttgactggtgctggtccatgattcagaggaattctggagagagaatccctggcccctctgtgcgggggatggagccgctcgaggcatgacccactgcccttccccctgtctcccaggagcaggacagaaatccacagagcagggactcctccggtttcttcatgtcactcaggatacttccagttgaatgaagctttcaatgtgctgtttctatttagccagcatctctctaagaaacaggatttttgtaatttttgaagtagaaccttagaaccaggacatggtgaacatttgatttacttcctgttacagatagatcatcgagccccacatcaaccagcttgagccaaaagaacaattatgtgtagttaatgctcataaaaacagaatgttgttgtaattgttctgcattcataaatactgtaaaatagaggtcgggcatggtgcctcacaccagtaatcgtagcactttgggaggcagaggcaggaggatcacttgagcacaggagttcaagaccagactggacaacatagtgagagaccctatatctataaaaagaaaataattaaaaaataataaaatagaaccttttttggtaaatgtcagtataaagttgccaactgccttccttggaaagaactgccttttatcctgaaaacacatacttcctatatatttggtattgaaatttcctcttgtttatgaaatgttgctgatagtaaattaaaaaaaaaatttttttttgagacaaggtcttactctgtggcccaggctggagtgctgtggcacaatcatagctcactcatagcctcaacctcctgggctcaaatgatcctcctccctcagcctcctgagtagctaggactgcaagcgcacactaccaccacacctggcttttttattttttctttgatagagacagggtcttgctttgttgcccaggctggtctcgaactcctggccttaagcaatcctcccacctcagcctcccaaagtgctgggattgcaggcatcggctaccgtgcctgcctttgaaatatttttatttggcaaaataaaacgctggcaatctcataccagtcttatatacttttcattctgctcgtgcctgtcctatgtactcggccgaagggcactgagaatctatgatctaggttgttggagttttgatccttttatctgggcactgtcctatccagcccagagtgcaagatgcatgttttgtgtcctggcccaccccctcaggcagacagccgtatttccccaccacgtggcagggtgggcagatgcacccactccatttgtttcacatccccaaggagtgtgagtcctgcagagcttcagggcttcgcccccacagccaggcccaccacatggcaggagtcttggaagacgttggctgcttgcagagacccagcattgaaacacgacccactggggaaatgtgggtggagcatctggtatttgcaagacccgtgctaggcgtgggtctggaaacaggaaacagaaatccacaaggtccctgcctgttggaacctatcacaccactggagtattttgaggttaaacagaattggaacaggattattgagctgctgtcacgggaagagggaggacatttatattggatatttaaggcatttccatgtatgatgtgctataaaatctactcttctttgtactcaagacagcatgatacacacacacacacatacacacacacacatacacacatacacacacatacacacacacacacacacacacacacacacacatatatatatatatatatatatatatatatatttaatcaggtgttggcccagcacggtggctcacacctgtaatccgagcactttgggaggctgaggtgggcagatcacctgaggtcaggagttcaagaccagtctgggcaacatggccaaaccccatctctactgaaaatacaaaaattagctgggtgtggtcatgtgcacctgtagtcccagctacttgggaggctgaggtgggaggatggcctaggcccagaagacagaggtggcatgggctgttgcaccccagcctgggtgacagagcaagagtctgtctcaaaataataaacaaaaaaattcagatattagcttgatgatacagactaaatatgctgagacacacagactaagaaaggaccacaaaagccgacttttacttgggttacgtgtgggttttcccataaaatgccaaaatagtcactgtcaccatcaggttctcttgggtccgtttggaaacaaaaatgtacaagtcatgacagtagcctcttggccgccggccaatgcccagcttccagctccctgccatggccaccagcaccatggcttccttcagtcacaaggacacagagaaggcaagcgctctctctgcccctccttcggggcagcatgggtttcacttacgtgccagcctgctgtctctggcctcaccctgcgtgacgtcagagctggctggggctgtgtgcttttcccagcacatcccgtttccctctgactttacctctttgtgagttcgatttaaccttgagcccacttgggcactgctctgccaatcccaccccacgtgtggctgctgactggcactcgggtgttgctgcagggacagcctccctcgctccctgctgcctttctttcttgtgggtatgtggccctagaagccacagcctgtgactcatcagtgtggccctgtgagccccaccaggtgccctgggcgctaccctgggactccctttgcctggcacctgccagggacctgaaggagaaccggcagggacccctttcccggagggctcccactaagcaagcttctttccctgcagtctctccactggctcacttcctctcccagatctttctgcctcttttatttatgcagaaattttattattattattattattattattattattattattattattattattttgagatggagtctcgctctgtcgtccaggctggagtgccaggctggatctcggctcactgcaacctctacctcccgggttcaagcgattcttctgcctcagcctcctgagtagctgggattacaggggcgcaccaccacgcctggtaaactttttttgtatttttagtagagacaggttttcaccatgttggccaggctggtctcaaactcctgacctcgggcgatccacccatcttgacctcccaaagtgctgggattacaggtgtgagccactgcgcccggctggaaattatttttttaagggaaatgtaaaatacagagaataacaatgctcacatcagggtctctctgttttccaaagtacccagcgtccttgatctccaccaccctgccccacccacggggctctcaccactcctggctgcctcttctcggggcagctcggggctctgccctcttccctcacccactgtgtataatcctcttgtatcttctccttccagggctccatggagaacgagcctgtagcccttgaggaaactcagaagacagatcctgctatggaaccacggttcaaagtggtggattgggacaaggtacctggcataggatggagtggggtgatgactgggggctggcgggaatgaggagaggaagagggtgtgtggagccaaagctgggagtgggcatgacgtgtgcccaggggagaaggggaaggagaagcaggtgtccacagcccagaggcatgacctgggacagcaaactccggcaggggtgtgggggtgcctcactggtggaaagttcagaaaaatagcagacaagttctgagcatggaaccagatcccagacacccctggagaagaagaattctcccgccaggacccctgaagctgagaaggggctgtgacaggcttggcaggcccagacatgcccattttgaccagggcacaaggtagagctgcccctggcacctgcagccatgtggaagcgacattggccagtgcagggcacaggagactgctgagtccagcaggagacagcgctgaagccatcctccgtgtttgggaggagtcagagatgcctgcagtcttaggataagcctcttttggcatcaagaggccagtgccttgctatggctgagcagaccccatagactggtgagatgagccctggaggagctgagcggtcacggtggaaaaggagtcactcagcggcaggggagaagcagctttgcctggaggggtcactggagggggtcactggagggggtcactggagggagctgggcttggtgccatttccttccagcttaggaacagacacaaatgtgcatgtccataaacccctaccctgcatgccctctgcctagtttgggcctcaaagacacagaaacaaatgggacaggcccctccctgcgagagctcacagcctggtgcaggggacagtaacccctccccaccaccgccataaagagttattaccccaggaggtggcatgggatgctcgcccaaggaacacaggtgagcagagtggggtggggaccccacaaagctgactgtctgctgggcccccttggccctgacactgggaacacagagatcccacctgtcgcatgagatcacagccgcctctgggagaacccatccgcccacagcacagacgcctcaggatccaaccagagaggccgaaggaagttgtgctgtgccatgtcccctcctgagaggtgcagaacccagggcaagatggaggccagccagaggaaaggctgcccggccatgcagccggcgagctgggacctggtttccgaacctcaacccccagcttgggccctgggcactggcagggtcaggacctcagtctggaacagggggagatcggaggggaatggggagagtttggggactgatgaggggaccaaagggtgagctacagtgtgtcctggctcagggtcctgtcctgagtggccagtggatggtactggaaggagctgcagagagaggcatctgtgagcttggcttagggcttgaattctgaaaagagctgaccgggactgaacaaatgtggcagccatcagggtgatgtgacatgaacaaaactgtcctggagggaggagctggggtctgaggctggctggggacgggagatccagcccacattgccagctctgtggtcagctcctcccagtctccccgagctgtggttcagggctgaccccggccccatcactgcaggaggcaaggggaggattaacccaggctgtgccaccgtcacctatgctgtcaccacgaccacacccaaggggacgaggggcccctcctcccccatggactgctccctgcctggctccgggccagctgtccaagcagcctgactcaccttccccacctctctctcattctctctctacacactcactcttcctccccttcctcctgtgtctctgggctgagacggaagggcgagggctgggccctgggaggatgtggaggcctactctggacggagcccccacctgcccgggtgtgcatgggaaccccttcagcgccccagaaaatcagcacagggagcagggcttcccaggagggcagagggtgcttttctgcttttttcttttcttttcacttttgactttccaaaaaagggtgctgctgctgcctcgttcacctcacgggcaatcccagctccgttagtgggaacagagaggctgggggagcccgcggtgctccaacctgagccctctctctgttgctgacccaggcagcgggggctggggtaggtcttttggatcgggacatggaggagctgggaaagaggccatgaaggtggcagctttgtctcagccgagggtccccaggcctggggtgggtttgcacacctgcccctggggcagaagggcttgctggtgttaactcttctggctttacctccaagctgagtactgtgattgctgccaaagactggagtcctggcctcccggggcccagtttccctggccctagaaggtggggacagagtgggaaggtgtgtgtgagaaggggtgagtgagaatgctgggaagagtgagaggacaacaggccaggggagccagggcagagttagaaggatctgaaaagacaggaagaagggccaggaagcaaaccctggtgccccgctctgctcagaggtgagggatggtcttacttttgggctctgtgtggaattttaccagaacagtttctaaatcatcccttcagtcacccagccaggcagggtccaggcttccttatgggacaagaagccaggttgtggattctcaccctccacatccctccctgtttctagaacacagccaggtgaggtggccagagctgcccaccactctcagctcctggacacacgtgtccccctggtccagcagcctctttttgccacttcgccatgtccttttcggagccctcccttgggagccctctccaccctttccacccgggggaccagcctccctttggggagggggcaagaacaggtgtgatttgaggggtttgcagaagttcgctgcccagatgctcagcagcggagttagccctgaattcacatctcttgtactgagccctcactgtgtgccagccgctttcaatgtattattggttatctgctttaatcctgctgacagcacgagggataaggattataattatcctgatttaactgataaggaagagcttaaatctcccgcccaaagtcacctctgggcacactagcagcccagatagcggcccctcccctccacaaggtcctggaaccttcccaccccaacagctgaccatgaataagaccctgaggccggtgagtaggagagggagtggcagagggagggaggaggctgagcagataccagcagtgtctcccaagccagccacatcctcttccccatccttcctcaggctaagccagatgctggcataaccagctgctggggctggccaatgggtgtgatcagcctcttccctcaagggacagatagacgcatccagcaggcatccccaaactccctgtccctgccccctgcctgacataacacagaccaccagggtccccagggcctggaaaggctattgaagttggccatagtgttttgcccatttaggacccccagatcagtcactgagaactcaggaagatagcatccagatcagagaaagggcccttttggccaacacactctcggggggaccagccttggcaccgtgggcactggcctggctctcctctaggcaccctgcctgcctagtcgccttgggtccccttgggcctcctttctctctataatccctcccagccagagtaggggtctggagggcccaacatccaaagggcctccccaaggctgtccatactgggcttagagtccctgagtctcctctctgcctgcctccttactcagagctcctggcccctcttcagaggagctcagcggtgctcaaaaaataccccaaggcagaaagcaggcaggtgggctgggcactgccctctgcttccgtgggtcttagaggacaccctgggagggcagtggacagggcaggctgggaggcaagagatgccacagtgttccagtatgatgcagaaagctattccctctatcttttttatttttttagagacaggttctcactctgttacccaggctggagtacagtggcaagattgcagctcactgcagcctcaacctcccaggcttgagccatcctcccacctcagcttcctaattagctgggactacaggtgcataccaccatgcctggctaattttcttaaatttttttgtagagatagggtcttgctatgttgtccaggctggtctcaaactcccagcctcagtgatcctcccaccttggcctcccaaggtgctgggattgcaaccctgcatcttattattgcgtaggattatctggaggatctagtggaatgtactaaaggatatcagaaagtgtgctgcaagggaaagaccaccctacctggttttggggtggggcccctgggcaggctcccttcgctcgtcttcagccctaagggcagaggtcatgcctgctttctgccagcgctcaagctgtctttcatctctccctgtgtctctggcatttttgctccctatccactctccgctgcctgaatcctcgtggggtgagcctgaggccacctccctgtcctcacatcccctgggtgacgggagggtcatagggctcagggggaggaggcaggtgatccggaaccacctctgtggacttcagcttgtcccagttagaccgcgcaggacgggcctgcagccactccggcaacgccaccaagagccccacctcactgcccccactgaccgctgctggctgtgaggaatcacagccgttgtgctgaggaagtcacagccatgggatcccaatctggctgacaggaggcctcctggccgagcctgggctgtgagtggggcactcgagtccaggccctgccacagcatatgcagccgaacatctgaccctgtcttctcatctgtcaaaagaggtcatcatcggccccaactcccagaattaaggctcatgaaggataggggatgtgaggcctgagccccagctgaccagcgaccaggttgcagacaaccggcccccactcctctcccgcagccccggctgcctggaagcctgtctccacctctgctcagaaagctgccctggggcaatatgcctgagtttgggtggacatttctttaaacaattgccttagctcatcgctgtgggggtgagcagtgctgctgacactgagcagctaccctgcccccgccgcctgcccccgctcaccacatttgccaccttagggagaagcagattctgggcacacccttccccaggaaagcgtcctatgccacctggccctgtgctgcccaggaggaggggtcctggggagggggaggaggaaaacagggaaggcccccttctaccggggcaccatgcccttccgcccaccctctgggcagcaggctgccctttccccctgccgtgctgctgtgggccacattcctggcatagcctgggagaagccctccccttctctctaaggcagggaccgagcaggctgggggaggggcatggaccccacacagtcggcacaaggtgctttggccgaatccactcccccttgcatctgcttcctgggccccggcccgttggtcgggtctttgaatcaccaaaaaatccctccaccccaatgagctgctcattccagagcagtttcgggcataaccgtgctgtcgcccatgcaggccagcttcctctggacggccctgagtgctggacatgcctctctagcgtcgggttccactgctgtaaaaggggacttgttactgtagggggagccgtgggagcccccagatgcctgggaagtggaggcatcatcagtgtggcctgatctccccttctcccccacccgagccacgtacatagcccacagacccatgccttccctctgtcccccgagccttgggacataagaagtaaatggggcccggaccaggaacgagctggaaggaagagacccactaatgtggtgggagtaggagaggggtcttcggtcaggtagaagagggtgggtggaagggcgtggtgcccaggtagaagggggccttccctgctttcctcctctgcctccccaggacccctcctcccaggcaatacagggccaggtggcataggacgctttcctggggaagggtgtgtccagaatctgctccccaaggtggcaaatgtggtgagcgggggcaggcgggggacggggcagctgctcagtgtcagcagcgctgcccacccccatggcaatgagctaaggcaattgtttggtcaggtagagcaggaagcgaaatgtgtcttgcatcgcttcccatctcattggatcccaagccgtcatcgtctgctgtcctcccatctcaaaacccggtcccgccaactgccatgttggaaacgaccagcaagtgagaggcctggaacctctcagcacccagctgagcctttctccttcagtgctcacgactggaagatgattaagaaaggacaccctatcagtgcatgtaccacctaaatcaaggtcaagtgcacagggtgccagtcccagctcttgggaaactgtgtggaggctgctacaagctgggggaagggggagggaggcttccacttcaggcccaaccaatcctatctcaagagccgcttgacctctcaggcctcaatatcctcatctataaattgggtcgggggtcggcgggcctgaatttctgtgcttatctggaaggctcacggggcttcccctggaatagcgagactgaggccccagtcatagaactataggtgttggcctttgatgactgaggcgggtgttcacagaagggagagcgaggcctccctgggattcctccagggtggtccttcagccccagagtgaagtgggcaccttccctgggcacccaggtgggcttcctcgtggagacacagcgtaggctagatacagagctcgggtgtgaggccctccacggccccagacaggcaagaggcagcttgggactgactctcaagcacaagtccaccatgtgtacaggtggcagtgcttgcgggtctacccagggagtaactgaaatcaggtcaatccaatgacatcaaatgacagacccctgtgctggggctctgttcccaccacacctgtaaacacatcttccacggtctagctccggtttccacgacagttctgtgcttttgttctgtttcctgtacatccaggtgtgagatctaggctgaagtccctgcttatagcttacctagacatttcttcttgtggttcaactgaattcaacgtatgaatcctatgccattttcagctggggacagtggttcacacctgtaatcccagcactttgggaggccgaggcaagatcacctgaagccaggagttcaagaccagtctggtcaacatggtgaaaccccatctctactaataatacaaaaaaattagccaggcatggtggtgcatgcctgtagtcccagctactcaggaggctgaggcaggagaatcacttcaaccggagaagtggaggttgcagtgagccgagatcacaccactgcactccagcctgggtgacagagtgagactcaatcttaaaaaaaaaagaaaaagaaaaagaaaaagaatcctatgccattttctacttgcttcacaaaataaagacaaaatagatcaatagattaaaatttgcccaaaccactgctaggctgagagaggggccccctggccacatccctgtgctatagctggaaaagatcatagttcaagatcgctcagtctgtgtaaagtgcacaagtgaatcacaggatagcagtatctgtcatgtgtaacatgcaaaagtgggacatagaaaaaccaggggcgctggccaggcacagtggctcatgctcataagcccagcactttgggaggctgaggcgggaggatcacttgagcccaggagctcgagaccagcctacacaacatagtgatacttcgtctctaaaaacaaacaaacaaacaaaaaacaattagctgggcatggtggcgtgagcctatagtcccagctactcgggaagctgaggtgggagaattgcttgagcttaggaggttggtgctgcagtgagccacagccatgccaccgcactctcacttgggcaacagagcaagtccctgtctcaaaaagaaaaagaaaggaccaggggattcatttgagagagatggtcgtaagctacagatgtgtattattatctttacagcaacaactgcaaggaaaataccaaaagcatagctaaaaagtcaatagaggagatagtatggaatattgttaaatatttcatacaaacaagacaaaggaagaacagaggagacaaatagaaaatagcagccatgtgtggtggcgcccacctgtagtcctagctactcagaaggctgaggcgggaggattatttgatcttcagaggtcaaggctgtagtgagccaagattgggccactgcactcccacttgggtgacagagcaagccctgtctcaaaaaaagaaggaaagaatgagaaaagaaaaccagaggagacctactccaacattaaatgtaaatagatttaatgcttcaattgaaaggcagagatggccgggtgtggtggctcatgcctgtaatcccagcactttgggaggtggaagcgggtagaatcacctgaggtcaggagttcaagaccatcatggccaacatggtgaaatcccatctctactaaaaatacaaaaaaaaaaaaaaaagccagacgtggtggtgggcgcctataatcccagctactcaggaggctgaggcagcgagaatcgcttgaacccaggagacggaggttacgatgagccgagatggcaaaaagagtgaaactccttctcaaaaaaaaaaaaaaaatggcagagattgtctgactagattaaaaaggaagacccaactatattctgtctgcaagagatgcaccttaaatgtaaagacatacacaggttgaaagtaaaagtatgggaaaacagggatcctgcgcacagcaagcttcaggaaaccagtgtgattctattaatacccaagcggacttcgggagaaggagtatttccagggcccaagatggctctttcccagtggtaaaggggccaactcatcaaggagacataactgggcgaccttgggcagattactcagcctcggtttccccaactgcaaaatgacaatagttagaatacacgcctagttaggggtatggcgaggatcaagtgactgaacctgtgtcaggtgtttagaaccatgcttgacacataaccagggctccatggggattagctctgagtgctactgtagctgggacaaagccttacattctcgccttgaccctggcccaacttcttctaaggtggggctctgcagactgccgcaagataaggtgtaaacacaggccaccagctggttcctccagttctttttcctgatggtggtggtagcggttgtggtggtgcagggtgtgtgtgtgtgtgtgtttacagacctagggcagaggactggagggaatgagacagcacacttccaatgactccacttgctgctagactcaagggctgaggtcaaggagactggggtaaggaagggagcagcgactaggtggagtttggatgattgcttgatttagttagtgccagggcgggatagctccaggctgacttggatcatcttccagcctgagaagcaggaagtgaaccccccaacccccacccctgccacaggaaggcagccagtacctgggacctgccaagttcacatggcagaagccacagcttcctttgggcccttcaccctggtcacaggcacagagagaaacccagtggccttgcctgcttgctcccaggacccccacccccctgctcccaggctgtgatgggcgagaccagctccacctccagagcagctggggggcatgtaagggctagttcctggaagacccgctgtggctgcaggctttggtggagaggcctgtacaaggatgagattgcagccagggccaggggaaggaggtttctggaatcactgatggctgtttcgtccaggcttgcaagctcttccacgtgcagcccttgctcctctcccctcctctccctgcctgtggttcccctacttcccacctgcagtggctgcctgactccccgtgctgaagattggctgagcatccaccgagacaccctcatcctcactccgattgtgtgtggcagattggggcccaccagcatcacagatgagggcactgaggggctccgggaggaaaagatgcacgtccaggatctcacagctggtcaaaggcacagccaggctctaatggtgttcccctgactccaggttcattgttctttcctggattcggtccagattaacccagcactggcttgtcagaaatcctcaagggcttctagttgcctggagctgaaacctgcaaacttttctgagcttgcatccctatgagtgaaactttctgcacacactctccattatgtgtccatttaaattatttctaaagtatttgcatgtgttaatgtactctcacagtctgtgcattagaaaacattcaaatgccgtgtaaaggtgagataaagcctgcgtagtggcacgctcctgtagtctgagctacccaagaggctgaggcaggaggatcgcttgagcccaggagttcaagtccagcctgagcaacacagcaagacccacctcttaataaaacaaataagaggccgggtgtggtggcttacgcccataatcccagcactttgggaggccgaggcgggcagatcacgaggatcgggagattgagactatcttagccaacatggtgaaaccccttgtctactaaaatacaaaaaattagcgggcgaggtggcatgtgcctgtaatcccagctacttgggaggctgaggcaggggaatcacttgaacccgggaggcggaggttgcagtgagctgagatcgtgccactgcactccagcctggtgacagagcaagactctgtctcaaaaaaaaaaaaaaaaaaaaaaaaatcaagaccatcctggccaacatgatgaaaccccgtctctactaaaaatacaaaaatcagctgggcgtggtggtgcgtgcctgtagtcccagctactcaggaggctgaggcaggagaatcacttgaacccaggaggcggaggttgcagtgagctgagatcatgccactgcactccagcctggcgacagaacgagactctgtctcaaaaaaaaaaaaaaaaaaaaagaaagagataaatatattacaaacacaaataaatagaaataatagcaatagaaatagggtcgttaatattttctccctgcctctggggattagcctgtgagtaccgatggagtacacgtacatccttgccttggagacaacaggcctggagaataagcaactcctggatgtggtacagggtgttctatcatctaagccttcagcagctttcttcctgctgcccacagagcactgttaaggtgccagaaaggccacaaccatattcaactttacatctgtgcccacactccctgtcatcctttcctctctcccccttgtcaaatcccccatgttgatgaactccaaaccaaaacccagatcctctgcaaagccctcctcgcctaccgtgacccgggcatttgtaccagccattctgcctctggatctcagcctgctttgtatctccactaaactatcctgcttggcatgccacatctcattgagcacttaatgcaggtaccgttattatttttttatttttgaagagacggagtctcgaactattgcccaggctggtctcaaactactggcctcaagcagttatcctgcctcagcctcccaaaatgcagggtttacaggcatgagctactgcaaccaacaattacttccattttatagctggggaaactgaggctcagagaggttaagtaattttccagaaatcacacagtaaatggcaaatggatttgtacccaggcctgacttccgagtctaactgtaagcactaagctacatgaaacaaggttggcctctttcattcctgttgattcttcccagcacctagcatagaaataaatatatatataaaaaataaattgctgaataaatgattgaatgaattaattacccaggccaacaccaagaagcctggggaaaagagcccacttcattcctgatacaaaatgtattacctcctgtacctcaagagtcctgagcaagactttaaacttcagatgtggctgaatctggatgctcagatatcatcactgagattctgtctctctagctcttggtttggccatcttctgtgctggtggcatcttcaggcaggctctgctagtaaatccaggctcatgccctgccgatttagcacctccaacagaaagagggatcatctgatggctcatcacaccagcttaggtcgcaaacctttaccggatcctattgctgtggctgggggctgggatgagcagcttggtcagttcttgatcactgaagcaggagggtgggtggccccacacagatcacaggagctgaggtaggagcaggggattgggatgctgtaacgaggaaatgggagaacgaatatgggaagacgtgaatatcaaacgtccacttggcttcatctcttgcaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtgagctcttccctgagcctgtggcaggctgtccctctcttctgacggtgccaatcagatatggaaagggagggggcaattgagtccctccccagagcccaggtctatgctgtaaagctgtcagggagggaggaacatgccatgggaataattcatccctatgcatggttttgtccactgggtgggtcacaacccagcatgtagccagaaactacattgaatgccacctctggtctattccagactcttatgaggagtttcttgcccacgatgcgcatgggaacaattttgcctgcaattagctcctctgccacaagaggtcagcatctgaccagttgcatagagtcagtagccctggggacacagttcttttctgccagtaactcatctcagagacaggaggcagatggactcacagcctctctcctcttttctcttccccactccctgtaccagtgtccctttgaccccaggtctccataggcattctgcatatgctttggtgtcatcttgtccccaatccagttgagttatgtgtctctaagaaagctggaccctgccgggcatggtggctcacgcctgtaatcccaacactttgggaggccaaggtgggtggatcacctgaggtcaggagttcgagaccagcctgacaacatggtgaaaccccatctctactaaaaatacaaaattagctgggtgtggtggcacatgcctgtaatcccagctacttgggaggctgaggcagaagagtcacttgaaccccagaggcagaggttgcagtgagccgaaatcacgccattgcactccagcctgggcaacaagagtgaaactccgtctcaaaaaaaaaaagaaagctgtactctgtcaagctcctgtgcatgtatctctctcaccctgatggccttcctgcaggtacagtgtccccatcatctgggtgcccctggtgctgtatctcagctggtcctactaccgaacctttgcccagggcaacgtccgactcttcacgtcatttacaacaggtaatgccagtttctttcctgacttgccctgaggatcctagagggaggagacctcagtgctttccctggcccagagtttctgagagcacagaaccccaaactacatcacagacatttttggtgaagcctctctgtagaaatagtcttccaaagaagaattttgtctgactcccatctaccccccaaatggatacaaaacccaacaacacatcagcagaaactaaatggaatcatcgggtggcatagcaataaaaaaagagagagagagagattgagtgcctctcattgagtgtcacaccaaaagacacatgatgtgggattctttgctaagaaactaaatgaaatcacttcatcgggtgacacagctgagagctagactcggactggcctatgaacccagcacagattagcagagaacttgggagagaaagatctgggagtgtcctagagtgtgtccaaggcaaaggctcaggcagcagacccccagactgggagtaatggcccactaacctctatgggacacttgccatgtgcggggccacgtgttctcccaggaccgcctcatttacccctcccagcagccccataagaagggtcctgtcattatccccttttagagctgaggaaatggagcctcagagatatcaagggagtagctgaaaggcgtgtggctaggatgtggataccaggtgcgccccagcttctagctggggggcagaggatgaaaagacaggctgatatggggcagtgtctaaagagcctatgagactggggtttaggatgactgtgggtttaagtatagccgctgggacagccagccccacaagcatcttgcctaccttgggcctccaggtacatgccacctgccctgtggtctgtctgtcctggctctgagcttcctgagctgccctcactctgccaggggaagctcttttccctgcactctgcaagtcaagtgcctgaatggttgacatgagaggggccatggtcacggcatcaggaacttcatttatccacctgacccaggatgagtctggtgagcgagctgcaggaagttcccccaaatccagcccagagctcctcccggtcaccgagggttactgcaggcatccctcgagccatggttgccctgttctgcccacgctgaatagctcaggcacagcacggagcttgttgctcagaaggcctgctcgctgaatcacccactgtccgcccggcactcccctaacaatcacaaacagtggcagggccgccagggctggcagccggagggggaaggggatgctgaagctttggcccaggtccctccgccggattcctccagagatgccactcagtaccagctccggccggatgggcagacaggggtgatgctggggtgagggggcgggcagaggcttgacctataggagaggtctttcctgcatggcagggaggatgatttgagggctctatcagccacacggccttggcagagagctaaaatgtgcctgtcttataaaggtccagtgtagagggttagtaagcctgtgaccatgatgccagtgatgggggcatgagagataacgtctccacgtgcctccctcagcccccagcttgtcatgcaaggcacaagccacaggcagagaaaataagagcccacaaagcaaggcaaggggagactcggcgggatcctagtgcagctgctggacaaaggacgcactggaatcaatacagaagagtcagggtgccaagaagcagtggaagctgaacgcagacaccagttcaaggctgacattcctagatgcgcacatgaaaatgctttcaaaagctgaggagacgggggaaagggggcggcgctgcatactcaggatggctccagagcagcttctgagagcacgttagagcgagtggcatccctgagaggaggggaggcaggcttccagtggggtggtgtgcggggcccggcagaggccaggaccttagtctgcgccggagagtgctcccgtacgtccagtcctttccttaccaacaagagagctaaggccaggcacggtggctcacgcctgtaatcccagcactttgggaggccgaggtgggtggatcacctgaggtcaggagtttgagaccagcctggccaacatggtgaaacccagtctctactaaaaatataaaaattagccaggcatgatggtgtgtgcctgtaatctcagctacttggaaggctgaggcaggagaatcgtttgaacccaggaggcagaggttgcagtgagccaggatcatgccactgcactctagcctggatgacagagtgagattccgtctcaaaaaaagaaaatataatattaatattattatataatacaatgtatatactcatcatataatcagatactctgttacctccatcctaactacacccctccaagatgggtagggtgtttccctgaggaaactgtaacacctaggcggtgctgagccaggatttgaatccaggtctgcaaatccaatgcctgtgctctctgcacttcaccggaatgaccttatggaccccagaggtatcagggtttctctggaagcagggtctctcaccaaccagaccagcccagctaagactccatgggagaggggtcacttgaacctgactcctttggtaatatgtggatgtcagtaaccacagcctcccaggaaggaaacccaagaggaggtgggcgggaagaaggaggaagacggttggcctcatttgggaggtgttcacggtggggactgtggacaaccacatggagctgtccagtagggcgtggccacccagggtggagttggtgtagagcttcggtcgtcagcatgtgggagaggaagggattgagctgagaggcagagggtccaggtttggaccctggggacaaagggcagagtttccaagatggagcctgagcagggagatccagggaagaggagaaaagccaagtgtggcggcaggcagaagggggagctatggattccaaccttattgctcccggatcctttgagaatttgagaaactgtggacacagtacagagaaaaaatgcccataggtgtacaatttgatatattagcaagttcacagacactctgcaatccaacgtagtaccctcggatattcataagcctcaggttaaacgcctaggcagctgcagattgaagaagagagtagagctaatgtcatatgccacagccagcttagaggtggactaaaaaatatgcttagatttggcaagaaagacatcatgaatagcctttgaagttctggtggtttggggcagaagacagatttttttttttttttttttttttgagatggagtttcactcttattgcccatgctggagtgcaatggcacgatcttggctcaccacaacctctgcctctcgggttcaagcgattctcctgcctcagcctcccaggtaactgggattacaggcatgcaccaccatgaccggctaatttttgtatttttagagacggaagtttctccatgttggtcaggctggtctcgaactcctgacctcagctgatccgcccacctcagcctcccaaagtgctgcaattacaggcatgagccactgcatccggcccagaagacagatttttaaggacttgacaagccaatgggaagtggcaaagtggagccatgagtccaacctacgttttcttttctttttttctttttgagacagggtcttgctctgtcatccaggctggagtgcaatggtgcaatcacagctcactgcaggcttgaactgctgggctcaagtgatccccctgcctcagcctcctcagtagctgggactataggcatgagccaccatgcccagctaatttttttactttttgttgaggcggggtctcactgtgttgcccaggctggcctcaaactcctgggctcaaacgatcctcccacctcagcctctcaaagtgctgggattacaggcatgagcccccatgttcagcctagcctgactttttaggagccttgatgatgaaggggctgagtccatgatgggaaagtcttgcctacctcagaaagatgagcagaagagccaggagaaaaggagagactgaaggagcccagaggagtcccttgggagggagggtgggaggaggcggctgagggctttgcactgccgagcagggggagccaggcaagtcatggactttgggcctccacgtccttaatcatgcaggcaatgcagggcttcccttgtaaggctgtggtgagatgaaataggaagtaatccatggaaggcccttgggcggtgcctggcacacaggaatcagtcaggacacatctgccgttactgttgctctgatcatccagcgcccgcgtgccggtgcacacctcttccctgagaagcaaggaggatgcgccagggtaccggcagaatgtggtgtgcttggaagttgggggaagtatgtggaggggatagttcctccccaaccccagggcctctcttctctgtgaagtaggaagctgggtggaaggagaggcagtaaaggggagtagagcgtgttcaagggcagtggggagggagctgaacttgaagatgcacagggatcatccatcaggctgtgtctagggtcttgcagaggttaaaggtgccagacccacagctgtgtgagtctccatgctcagcagcttgggtatggggtacaaaggcaggttcctgcgctgacccaggggtgagggttcatgggtgcaggtgagggagatggagtaagggttaaaagagaacggctaggccaagcatgatggctcactcctgtaatcccagccctttgggaggccaaggtgggtggatcatttgaggtcaggagctcaagaccagcctgaccaacatgttgaaactctgtctctactaaaaatacaaaaattagttgggcatggtggcgcacacctataatcccagctacccgggaggctgaggcaggagaatcacttgaacccgtgaggtggaggctgcagtgagccgagatcgtcccattgcactccagcctgggtgacaagagcgaaactctgcctcacaaaaaaaaaagagagagagaatggctagctttggaaaacagtctggctattcttcaaaaggttaaacatagagttatgatatgaaccaacagtaccactcctgggcttgtacccaagagaaaggacaacatcttttcacactgaaacctctacacgaatgtgcatagcagcactattcacaatagccaagagctacaaacagcccaggtgtccctcaactgatggatggatgaataaagtttgaatatcattcagtcttaaaaaggaatggagttgtaatacatgttacaacatgggtgaatgttgaacatattcggtaagagaagccggtcataaaagaccatatgtcatatgattcaattgacgtgaaatgtccagaataggcaaatccaacaaagaggaagtagacctgtagcttcctagggttgggagggtctgagaagaaatggggagtggctgctaatgggtacaggggcttggcggggaagtgataaaaatgttgtaaaattgactggggtgacggtttaacaactttgtgagtgtactaaaaagcactgaattatatattttatttggatgaattatatggatgtgaattagatttagataaagccgttaagaagagagaagatatggccaaagctatggtttgtagagaaaagaaacaaagataagaggatgaggatgggctgggcacggtggctcatatctgtaatcccagcactttgggaggctgaggagggcagatcacttgaggtcaggatttcaagaccagcctggataatatggtgaaaccccctctctactaaaaatataaaaattagccaggtgtggtggcacacacctgtaatcccggctactcaggagactgaggcaggagaatcacttgaacccgggaggtggaggttgcagtgagctgagatcacaccactgcactccagcctaggcaacagagcaagactctatctcacaaaaaaaaaaaaaaaaaaaaaaaaaaaaaaaaggatgaggatgaatatatggagcaaacaggaatgagagctgaaatctccatgaggtcaaagaatgaatgaggtggaggaaagagctgaaagccgctaggactgcaggctgtctccggagggtggtgggaagcatgtgcttgaagatggtgccctgtctccagtcttctcctctccacctaggctgatcatcttcagtgttttcacatcttcctcctgtgctatgatttcaggtcttgtctgttgagatctcggtgcttgttttttcttgtccttcctgccccatggtccctggtgggtcacacttcccatcattaacaccctggaggccaggcacagtggctcccttctgttatctcagcactttgggaggccaaggcgagagaattgcttgagtctgggagtttgagaccagcctgggcaacatagcaagatctcgtctctacaaaaaaaataaaaataaaaaataaatttaaaattagctgggtgcggtggcatgcacctgtggtcccagctacttgagaagctgaggtggaaggatcgcttgagcccaggaagggaaggctgcagtaagctgtaatcacaccactgccctccagcactccagcactccagtcttccaacctgggcgacacagagataccttgtctcaagataataataacaacgccctggctcaggagtgtcgccttctcttctccaatgtccttggggcaaggtcacccttccaggtaaaggcccagccccagccacagccactcctcccacagcctctgtaaggaggatgtcaggcctccagccagtggcccatcactcctgtaaaggacttcccagacccagaccagagtcctacagcctccttcccattttgactcaaggaccccagcagtatggcctggccctgtagctgtccaacagagggcagcagctcccgagctgatggggatggtgaggcagggacacctggagctaccaggctgctatgcaccggtcctcacctcgctctccctgccaccctgcagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggtgagcggggcggggtcccagcccggacctagcatgtgcagcccgagagggcccggcagccagccgcagcttcaggtgctgcggagcctcctgggagtctggctgtgggttgggagggacgggacgtttgatgtgactcacggggcaactgggttgggcatccgaacctaagccaggcggggacagcgtgggtgtgcagcatcaagctgaccccaggccctctgcacccttgtttacgcatcacctttaatcctcaaaacaactcattcattcgttcattcattcagcaaatgcccagtgagtgcctcctgtgtgcgagacactgttctagacatcattgaacaaaacaacaaaaagccttgcgctcctggagcttgtgctgaaaacagccccatggttctccccgttccacagagcaggagactgaggcctaggaggactaaggaacttgccccaggtcacacttggcacagccaggatgtcgtaccccattctggggattccagagtctgcgctctcaatcacccttcccctgaggcccttcaaggactccacgacagtcccagaagctggcccgagaagataggtctgcccaaaggaagctacctcccctgtaccccccgctgcttctctgtccctgcattgtgctgtccttggcccatcccaggctgttccccagcccgtctccacactctgttctctgctgggcataaatcagagaaaatatggcagatatgatactttcgggacaccagtttagaccctgatgtcgctgatactgaacgtgggtttcaccttggtttcccagcagcaacttaatccggttcatctcgatgagccgattcggggtttgatcggccgcctgggacagttctcaggttggttggctgtggtcctcccggctctccccagagttgatctgcatcctagggggctttcctaggggccagtatcagggtgggtgcccagtcctgggccaacctgtctctcaggtatgctctcagaggtagcgcagcccaggcctggcctgtgtcctccagcctcacctggcctctgctctgcagagctcactgcatctgcttctgtgtcccttgccctgtttgtgaagccttttcagatccactgccctgtccgctatctttcccatccacaggggacaccagaaccttctgggaacctgctcaggccattctggggccccaggggctgtctcaggctccctcttttgagacacttccaccccagtctgtccagtcccctgctgccacaccatgaggacccgaggagactgtatggcctgtagccacgtgggctccaatcaggaacgtgttctcagatccccagacctatccatctaaggatcctgatccagctgtgacccggatctggcccataccagctcacaagagcacccatgcacatcctttcctgtttctgttccagtgacgccacctcagcgcttgaaagcgccagggcagttttcacactgcaggaattggcaaacactaccaatcagggctctccctccctccctttatttccccctccctcattccccagctctctcccttcctccttttcctgagagctggttttccagcacatcactggtcctgttgttcctggtctgaagggagggaggcccacgccagcatctcattgtgtcactgtcacctgctttctctctctctcctccagcccagagaggctgcaggattctcttctcagactcctcaccaagccatagctaagatctcacctctatgccaggcccttggcttctgaagctcgagggccacggtgaagcggtgttctctggttcactgtggcgacacccccttggaacaaaaaaggcctcctgtttggacatgggggtggggaggacacctctagtgacacttccgggtcatcccgccacagaggctgcattaacctcagttgccctcagtgccttgctctcccagacaacatcaggcctcagtctaggtgccctgtctccagaatgcccctctagccaggggcacggcatttagggatgggatacctgtctagcacctgacaaattccagagtcacagtggcctctataagatgggctctgagccgccagcacaccccacccatcctgcccatcctgcccatcccgcccatcccatgttcctttgcaatctgccaggtcccttcctggctcacaaatgggaagtaagacagtctctccagatcttccagacgtggtggcccgccctccccaaagccaccaaaggtgccaagcctacgcagtggaatgtctgggccgctgtgcccctgtcctctgcagggagtggccagggtttggccagctgccggggcccctggctgcctcctgatgcccaagcctctccatctgcaggcacccttcgacggctcccgcctggtcttcccccctgtgccagcctccctggtgatcggcgtcttctacttgtgcatgcagctcatcctgcctgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggtgaggatgggcctgtgcttcccagccccctatgtgtgttcattgatttatttgccaactaccatcgagctcctgggaacggcaaggcactgttccatgtacggggcatatacagagggttccctctactctcttccctggtgcagacagctgtgcagagacaggcaaggacatcaataaatggcaaagatttcaaactgtgataaatgccataaagaaaataaaggggctgggtgtggtggctcacacctgtaatcccagccgaggggattgggaagccgaggcaggtagatcacttgaggtcaggagtttgggaccagcctggccaacatggtgaaacctgtctccactagaaatacaaaaattagcggggtgtggttgtgcccacctataatctcagctacttgggaggctgaggcatgagaatagcttgaatccaggaggcagaagctacagtgagctaagattgcaccactgcactccagcctgggcaacagagcaaggctctgtctataaaaaaaaaaaaaaaaagaagaagaagaagaaagtaaagcaaggtgatggaatatcacataggtgggggagggtccagcgatttccactgacatattatgtgggccacatatgtgattttaaattttctagtggccacactaagacatgaaaataaacagatgaaaagaattttaataacatttacttaacataagcaaattattatttcaacatgtaatcaacattaaaaaatcattaatggctgagcgcagtggctcaggcctataatcccagcactataggaggcggaggcaggggattgcttgaagccaggagttccagaccagtctgggaaacatagcaagaccttgtctctacataaaaaagttttaattatccatgtgtggtgatatgcacctgtaatctcagctacctagaaggctgaggcaagaggatcatttgagcccaggagtttgaggcagcaatgagctatgatcatgccactgcaccccagcctgggtgacagagtgagaccctttttgtaaagtctctttaaaaaaaaataattagcaactcttatactaagtctttgaaatctaaggtgtattttgtacttacagcacatctcaattcagatactaaagtttcattagaaatactagatccatatctagattttataaaatttgcaaacagtagttcacataggtaagttgctccaaacatgcttaaacattttccggtaacacacttgaggaggccgagacgggcagatcacctgaggtcaggagttcaagaccagcctggccaacatgttgaaaccccctctctactaaaaacacaaaaaattagctggatatggtggtgcgcgcctgtaatcccagctactcaggaggctgaggaaggagaatctcttggacccaggaggcggagcttgcagtgagccaagatcacaccagtgcactccagcctgagcaacaagaacgaaactccatctcaaaaaaaaaaaaaaaaaaattccagtaactcaatcaagcatcagtttttacattgacatgttaattcatcagaattaaatgaagttagaaattcagtttctctggagctctagccacatttctagtgctcagtagccatgtgtggctaagggctagttggacagcaaagagattaaatggtccaggtgtcattgcagaggtgccattagagctaagaccctaatgaagagaaatcagcatctggcgtcccaagagcgactggtgcaaagccctgaggcaggaatgaacttgggccccaaggaaggggaaggagatggaggtggggggtgggagggggccacgtagcctagaaacgaaggccagataaggaattagggtttattccagcttcatgctggggacaataaaagacacaggttccccacccttgacttctgccagaatggcctcgggagttgggaaggccaaggggacagatattgacattgtctccacctcttatccctaccctggcacccttcccaagccagcgcacgcctgctccttcaatgcctcatcttctccccgtttgtctccctctctaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaatgagttgttcatcagactccctcgtggttgggaaggggcagtggtgtggggagggatagaggggcagaggattggtccccagggagggagattctagccctgaccagggtgggtagaattgctggggcatggtgatgattaaaagctgaccaactctcagctgggcgcgatggtgcatgcctgtaatcccaagattttgggaggccaaggtgggaggatcgcttgaggccagatgttcaagacgaacctgcccaaaatagcaaaactccatctctaaaaataaaagaaaacaagacaaaagaaaacaaaacaaaaggagaaagctgactgactcttattctctcactcagctttattctgtttctaaattctctgcagacagcatctcctcttattgcctgcacctgggatgcattgtgcccacaaaccactttgatccgccaatggggagggatctcttctggagtttatctaaccccaactgagcttccagtcgactttcctaaaacagagggagaaaggctccagcaacaaatgcccatagtgggaactagaacctcaagcagctcagtctcggtgaaactgttgcttgtctttctctgctgccctatcggaaccacctaggaagctgtcgaagtgcagctccagggcctcgcactcagggtctagttcagtaggtccaggggggtaggccctggactcacctgtctgaggacacggaagcggaagcaagctgatgttggggagcctcggagggagcccagaactctgctgtgtctccctgctctggcagtcataggggcagctttatgcctgcagctcccagcccgaagataagtaggacccgtcggagccacccatcactcgagtccctgaagcctgtcaccggaacccagcccgtccaagcagcagaactcataaccttcatttactgatggagctgagcagctcaccctagaccatcacacccagggggagggaggcagaggaagaacacaggaggagctccgcaagtgtaaacacacatggccacagcaggagaaaaagcctaaggtgagcaagatttagcaaaaaaaaaaaaaaaattgaaaattttctttaagaagagtgaaacaggccgggcgcagtggctcacacctgtaatcctagcatttgggaggccgaggcaggcggatcacttgaggtcagtagttcgagaccagcctgcccaacatggtgaaaccccatctctactaaaaatgcaaaaattagctggggggcgtggtggcatgcacctgtaatcccagctactcaggaggctgaggcaggagaattgcttgaacctgggaggtggaggctgcagtgaactgagattgtgccactgcactccagcctgggcaacagagcaagactccatctcaaaacaaaacaaaacaaaacaaacaaacaaacagtgaaacagacgggacatggaagcttatgcctataatcccaacactttaggaggccaaggcagccagatcgctttaggtcaggaatttgagaccagcctgggcaacacagtgagaccccatctctacaaaaaataaagaaaattacctgagtgtggtggtgcacacctgtagtcccagctacttgggaggctgaggtgggaggatcacttgagcccaggaggttgcggctgcagtgagccgtgatcacaccactgcattccagcctgggcaacagagtgagaccctgtctcaaaaaaaaaaaaaaaaaaaaaaaaaggaagtaaaacaaaactaataagaaaggccaaaaaataaagtgagtttctagcatggtaatgagaagatttagaaaaaaagtgacaacacgaaaccaagcccacctattaatgaaaagtccaattggtgaaaatctgacagattctcccagagctccccattgcaccgctgtaactgtccagtggggttgggagtatccacaaggccttttggagagagagcaagtcccacctcacagggacttgagagtg

SEQ ID NO: 13286 - DNA, 5435 bp, Human
  misc_feature (1)...(5435): n = A,T,C or G
gggcctgcagaggcctggcaatgcatatcttgtaggggaggtgttggctgggtcacaattccctccagagtcacaagatttgccctcagtgcaagggaaaggtccagggacatgttcagccccttaacatgcctccctaaggacagtgcagaggtctctgaggctcaggaattctgggcacagccctggcaggagaagtggcaagcttgaatgcctgggtctcgttgtctccccacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttggattccgttggcatctgctatttctgtaacagagaggagcaatgggccctgagtgtgtaaggcaggacaagtgacttgggaaaaaaaaaaaaaaaaacccgcccagcctgtgtccccctctgcaagcaggggataagaactgtgcctccctttctttgctggctccagagaggctccggggcggaagcagctccgtaagatatacctcgctgcagaggggagcaacagcggaacggagacacggtggccgggccgaaaacgtcacaaagccgcagagagcgggctctgtcccgcccgctccccaggtgggcgcccgcgcctgtccagcgagtccgcaggctgggggaccggaggcaccaaaggccaatagacatgtaggggcggggtctccaccgattttttttttttcctgacaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtgagttgggcgcggggggccggcccggttgttcaatgggtttctgtttgccctacgtgctgagttagttgtggtctctactccgtgtcaggaggctcccaggtttgtctcaggtaaccctcgccttccctgctgaggatcagagatagagaagacccccaaggtcatacaccgatttaagcggcagaggaggaagtttgagtccaggtcaaacccaacgctcttaccacagctctagtggtttccaagcatcgctgtatcactgtgcataaccctctgtggggggtgggagatggggaggtgtcgggtacaaaatccagattcctgggctctgctctggagattctgaactggaggaatcaattgggtgggggtcaggaatcagtttctttctctttttccttttttttttttttttttgagatggagtttcgctcgttgcccaggctggagtgcaatggagcaatctcggctcaccacaacctccgcctcccgggttcaagcgattctcctgcctcagcctcccgagtagctgggattacgggcatgcaccaccacgcccggctaattttgtatttttaggagagacagggtttctccatgttagtcaggctggtcttgaactcccgacctcaggtgatccgccctcctcggcctcccaaaatgctggattacaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccagaaggcagggcagagctagcttctgggttccttcagcccctgcaaggtttgggactctgtccacaggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggcgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacaggtacagtaatcctgccctcagcttgccccacccccaggtctcttgggtagtctcatttccacaatgtcccttcctctgcctcccagcagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaagagctaacgttgtcatttacagtttttcatatttcgaatgtaaatctttcatgctggctgccaggaagggattgagccaaacaaaatcaagcacaagcagcaaatgcagcacagctcattcatttggcagtaggcatctccctgccactctcacgcgtgccacggagctgattctctttattctctttttttcttttttttttctttgagatggagtctcactctgtcgcccaggctgcagtgcagtggcgcaatctcggctcactgcaaccccacctctgcctcccaggttcaagcaattcttctgtctcagcctcccgagtagctgggactacaggcgtccaccaccacacccggctagttgttttgtatttttagtagagatggggtttcaccatattggccaggctggtctcaaactcctgacctcaggtgatccacccgcctcagcctcccaaagtactgggattacaggtgagagctaccgcgcctggccacaaagccgattttctatagcagatacctaaaggccagtgcccactgctagcagcctgcctagttcagtgatggagttagacgcataccctttctagtcttctgggaggagcacccccatgtccacagctgctgtcacacctcaaagtgaccagggacttcggatgccattggaccctagacaagccagggccactctgagccctccctatctatcacaggaagggttagactgaggttcctaaccctgtgtaagggtaaaaagctgtgaggcccctagagtggggtggaagggggcaggacttcagggacagcaggaattggattcccagggttaattgtgacccattgcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcagagctcgtgtccggctccctccttaaggcccgacgcccccggccccggcctcgccaaggggcagcgccccgccctccgggtagttttcaccacgggggccgaagcagccgcgcaagcgaatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13287 - DNA, 7386 bp, Human
  misc_feature (1)...(7386): n = A,T,C or G
cattggaccctagacaagccagggccactctgagccctccctatctatcacaggaagggttagactgaggttcctaaccctgtgtaagggtaaaaagctgtgaggcccctagagtggggtggaagggggcaggacttcagggacagcaggaattggattcccagggttaattgtgacccattgcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcagagctcgtgtccggctccctccttaaggcccgacgcccccggccccggcctcgccaaggggcagcgccccgccctccgggtagttttcaccacgggggccgaagcagccgcgcaagcgaatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcaggtgcaaagccccaggacggtgacagggccacaccctcctaaagtgtaccttgggtacaggtcttttctctcccacaggcccctgtctcccagcctgatgcccctggccaccagaggaaaggtaatacttacaaaaactcggcactagccagcactaagagggtttgtcatgggccctgattccaggtgtccatcatcttgtgtaactcccctagaagattcaaactattattctacccatttcacagaggaggaaattgaggcagtggggttactgggatctggataaacagggcaggggaagacaggttgtgagggcagagtggggagggctagtggagggtggctgtgacttggggactggggaggacagatgctgggagcagctgcaggaaaaccagtgaggacttaacccctaccggtctgctcccagtggtgtcatggatagatgtgtatactcgcgctacctgccagccccgggaggtggtggtgcccttgactgtggagctcatgggcaccgtggccaaacagctggtgcccagctgcgtgactgtgcagcgctgtggtggctgctgccctgacgatggcctggagtgtgtgcccactgggcagcaccaagtccggatgcaggtactgggcaggtggggcaacgggcaggggatgcaggtactgggcaggtggggcagcgggcagggtggatgctggctggctctggggctggggcagcctggagactgatgcacaggagacagggttggggggagggctggtggccagcctcccggctgttgggtgagcttttctcccttcagtcttagagcatcccctttctctctctccctcactgtcccccctgttcttctcctgagcacagatcctcatgatccggtacccgagcagtcagctgggggagatgtccctggaagaacacagccagtgtgaatgcaggtgccagccaggcccaacttctgagctcgcagaggccaggcttggggggtgctgggtatggtggtccacagaactggggaccaggttcctaagagtagaaccaaggggccgggcgtggtagctcacgcctgtaatcccagcactttgggaggccgaggcgggcggatcatgaggtcaggagatcgagaccatcctggctaacatggtaaaaacctgtctctactaaaaaaatacaaaaaattagccgggcgtggtggcgggcacctgtagtcccagctactccggaggctgaggcaggagaatggcatgaacctgggaggcgtagcttgcagtgagccaagatcgtgccactgcattccagcctgggcgacagagcaagactctgccacaaaaaaaaaaaaaaaaagagtagagccaagggtaggccttggatctggggcaacaaagtaggatgcttgggccgggggtagtggctcacacctataatcccagcactttgggaggcccaggcaggcagatcacctgaggtaaggcgtttgagaccagcctggccaacatggtgaaaccccatctctactaaaaaaaaatacaaaaattagccgcgcatggtggcaggtgcctgtaatcccagctacttgggaggctgagacaagagaatagcttgaacctgggaggcggaggttgcagtgagccgagaccacgccactgcactccagcctgggcaagaagagggaaacacagtctcaaagagagagagagagagagagagagtaggatgctgggatttcctgatcttcctcttgtttgtctgtgtctgtctatcttacttttcagacctaaaaaaaaggacagtgctgtgaagccagacaggtgagtcttttggactccagctgagtaggggtatggggagtacaagtgagtccagaagctgttgctcctctttctcctcccacccgtcccccactttcccttttcctctgctccccaagcctgtgttctctgccccgaccccagctctagggaagactcttccttcccaccccagacatgtcgcttctcctccctagggctgccactccccaccaccgtccccagccccgttctgttccgggctgggactctgcccccggagcaccctccccagctgacatcacccatcccactccagccccaggcccctctgcccacgctgcacccagcaccaccagcgccctgacccccggacctgccgctgccgctgccgacgccgcagcttcctccgttgccaagggcggggcttagagctcaacccagacacctgcaggtgaggcgtctgtggggtggtgtttgtttgggaaggcaccaaggccctgtcctggagcaggtccagggtgagcctgccagtaggaggagggccagggaaggggaaactgttgaatgtgttgaacaaatatttaccaaacagctgctggcacctggagctgtataagcaagtccaacattctaactcaggagtcagatacaggagggacaatgccagcagaggatgtcaagggctgtggtgaggggtacctggcctcgtctttcagaggtcagagatctcttggaggaggtgacatctgcccggagtagaaatgtaggacacagcttttccagcttgcagttcgggccttcccagaagcccctgtggtagacatctgcccttacctacgggcttcaagaggccaggggacatagtggaacccttgtccacccttacctgatgtgtttctcaccatccgtgtcccgcagtgaggccatggggtgaaatcatatgggcagggccagtgggggctcccgaggagtgtcaggaggggatgacctttgcaaaaggttcatccttcgccctgcagcctccagtgcccagggccgagtggtgtggcaggatgctcaggttgtgatcttagtgggcccgaggcacacatgagtccagggctggggctgcgctccagccagcatgaacagatcacttcctccctcctcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgcccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcagcgctttcagcatctgctgctttttgttccctgcagcttgaatctaaagcctcagcacctgccctgtcttaacttcactcccacctccctgaaagggaagcaccgcaagtctggggctggtgggcctggtttgggcggcaggctcccctcaacccaacccacagttttttgtgtttttttttgtttttggacagagtctcactctgtcacccaggctggagtgcaatggcacaatctccactcactgcaacctccatctcctgggttcaagcgattctcctgcctcagtctcccaagtagctaggattacaggtgcccaccaccatgcccagctaatttttgcatttttagtagagacgggtttcaccatgttggccaggctggtctcgaactcctgaccttgggtgaaccacctgcctcagcctcccaaagtgctgagattagaggcgtgagccaccgcgcccgcccaacccacacagttttctccaccctcgcctcccttgcatcctgcagcttccttcatcagttgctgcctgagattctcctgacttgtctatcctagcccaagcccagcccctacccttctccctgcagcctccagtgcccagggctgagtggtttggggtggatgaaaggccaaccttgggcaccactgctttgcctgctgaagcaggacattcaggggcagagttaactcaattgggcagccactgggaggggcagccaccctaatggaggctttctctgaggtgttgggtcagagcatgtgggtatgatcttagtgggcctaaggcaggagtgggttgaaccaggagacaattcctgacagcgattactactttcaaatcattttctcagtcatgatgtcactggacatgccataggtcaattagcatgaggcagaaaggggttagggccccagagctaccgcctccagagcccagttagccccaccagtcacgcacaatgcttcacatgcacctcctcacttcctcctcgctcgattctgaggtcagcatcatgattgtcttccttttacaattgaggaaataggctcagaaaggctaactggccggggggatttgacctcaactcagctgtctccctaaccttcaacctaggtttagctgcctctcaactgcaggttcattacttcagttgacagatgtttggtggctgctggggcgcctgaaaataagtctggtgggggaacaggcccagccagatcattccagtcatgagtcacagcccaggtgcacaggtagaggtaagcctggctcctgggagagagatgtgggcaggagcattggctggaagccagggcttgtcattggacatcatctcggtcctgcaggggccctgtggggtgggtgtcatcaagcccgtgttacacgcctgtattggatgacaaattctaccaagcacacagccgaccgggagttcaaacgtgagtgtcactgtgaagcccaggctccacagcgactgagggccgtgggccatgatgaggcccgggaaaacaggagtgctgtgggagaggctgggggcgacttgaaatggcgcctcaagaccccctccgggaacccacgcccgcctgacc

SEQ ID NO: 13288 - DNA, 24984 bp, Human
tagtggagatggggtttcgccatgttgcttaggctggtctcgaactcctgacctcaagtgatccaccagcctcggcctctcaaagtgctgggattacatggtgggggccaccatgcttggcccccatgtggcttttaatctaaatcctaccctatctcttcccagcttttctgtttgtagtcagtgctttgtatttcctcagtttacaaaatcccttactgtctcccacaaataggattgaggaaacagtccttctgtcacattgcaaagccctagaaaaatgaagggactagaaaaatgaagctgtttgatcctgctctggttctcagtctaccagtgagtgaagggccggagggcccgggcaagcttgagcccaggatccagtgggcccactgaagtcagggcccacttttggggggctgggaaaaggaagggttgctgtgggaccactgggataggcctttaaacagcacttcaccattggcctgaatcaaacattgtcattcccagtgtcccgagcaccttccctgagtcttcataccttctgcctcctagcttatggaggaggagccaggggcttatcttttgggggaaatgagagcacgattaggcatcaagaagggttgatgagaaactggtaagggggactgtcaagaacagcagagtgctgaaatggtgacaaaagctctgggctccggccccagctctgtactgagaagctgtgagattttgggcaagtctcataacctctgaatgccaatttctcaatggaaaacagggagactacctaccctataggtctgtgtttggagaaaacaaagtgtaagcgctggacatacagtagcatcagaaatgctgaatccgttggccagggctcatgtgtaaggcaaacatttcttggccactcctgagtagcatggtcttgcaggaatatatgcttaagtgctgtgagagcacagaggaagctttgcccttccctagagggttaatggctaccaacgtgagaaggtcacggagttccttaatgagagggagcctagcctagaataggggatgaatgagaaattgttctgagaaccagaggcaaggctgcaaccagcacatagacaggggtcgttggtctagaaggggagtcttctccagatgagagacagccagcttgccctgtgctcaccatgtgcccagatagtgggggcttagcaggaggaaggtgtgaggaatcccaggcctttggaattccttgagaaagcagtgttgttttgaaggtaaggcaggggattggtgactggaaacttggaggtgagtgagaacctagggatgaacgttcagaagcagggctggaaggaacttaaaagggacatttggattgtttctagcttttgggcaaaatctaggattaaatatgattttttcattgatagaatgctctatcagtgataaaggctcttaatctagaaaacatacacctcatagggggctttacagagtccccaaactccctgaaattatgctcaaaatattttgtgtctaagtggaatgtgcatgtttccaaggttaagcactgcttttttaggaagtaggaggtccgtccgccactgtcagcttgctggtttctgcttaccctcctccccacttcgttcttgagggggtggtttgctggtctttggcagggccgccactctgggtcagcacatctgagtcacacatgttcctccccagccctattggaggctttgttaaagtcatctgcccctacccaggtcccacctgccacaggtgagctagggttttatgacagccgtggctgcagtgagtctcctcgacctctcgccagctgttacccagcaaagcaccttggggagggtggggctgcccacttccggggagggagggagggggaggggagaaggaagttgatctaaacccgcctctttctctgtctcccttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttcccggcctctgtactttgccctcgctgcctgacaggttctgctgtgggctctgctgaatggaagtcgctggtagtccttttccctttctccagtcgggtatgttgtccccctttttactctaggattgcctcctcctctttctttcctctcatctcaaacataggatctttagagagttgctaaggggcgccctgcctgagtccagcatagtaatattcatgggaagggtgtccagatgtggaagaggcattgactaggaaaggaagagggggcacataccagaagggtctcccctgagaacaagcagcttgacaagtgggcgaggaggggctggtgggaggcagaggcctgaggcctcagagaggatgctcccgtgctacagtgagggggagcctaggatctggggccattgcccaggactggtgcccaagggacacttttctcccccaactctatagtgcctggcttactctgcttctggccagggaatatcacccctcctggtttggctccttctcagccctcgggaagccaaaggacacttgaagccagccctgaatgcagagccccaaagcatgagcttctccatgggacaactgttggtaggagcctccagcattagggcaggggccctgcctacctgagtcagcgccaggcctctcggggtggaggctgtcttccgggcaagcctgacaacacacctaggccgagtctgagatcccaggcggaaggggcctgacaggcccagtggatgcaaaactatctttttattttctcctccatgtcctgccttctctcttcctctcagtagcagaccccaaagctgtttcagccctacttctgaatcaggcctgcttagtaactacttggtttgccttttggttccaaataactgccttgcagggtgaccccttattctttctaaaggctacttgagagccatagggtctactcttgacagacctcctccatcctttagggcctgtctagagtatgatataggccagagctttgggagtgcctggtgtgccacgtcttactataagcagggaggatggtggtagaggggagagcgtggcttttgccaggtcctattgagttggcccagcagggcagctaatcctcagcctgccatcctgttggtgagacccagggccaagctgaatggtgcagccagaaccaaaaaagagaaactctctctccatattagccactgcatactcttacctctttatccttcagggaagaagctaggtgaggaagttgcctcacttggggccttggcccaagaagcatttctgttggagactctctcctctcttttccctttttcttttctctgcttccttccagtggcttgcctccttaccctggctcacatccctgctgtgggaaacatcttacagcatagaagaaggggtgcaggggtaagtaagggaaggattgagcacttggagtcctctgagttggatggttcagtcccgaaaagggggttggtgactttggagcaggggatcaaagagcaagcaccagtgcttgttgcttctctggctcctgaacaagcagaacctcctctctttccctgtcctggatacccagcgtgggaccagcccttcacagccaccctgtcttgagttcctgactctcctccttccctcttttgaaggctagaggtgctggtgtcggctagcaacaggttgagggagtgtggcatttcaccaggtctggaggagagcgggcactcaacctggccccttctgcggaaaggcccgtagcatctcttgtcagccttcagctgagctgtagctggcttagcgggctcaacttcgatttggaaggttgttttgacagtgagacttctggattggcagacagtagtatttggggacataatgattgctcttattgaacatcggataaggcattttacatgtgctctttcatctacctgtgtaaagtagggaatgtttattgccactttacagataaggaaattaaagcttgtacgtgggggagccagggcttgaacctgattctgttggactgcagagttcctcgggatcctccctggcacagatgtctggcagtattggccactggtcgttttttgggtagttctcttccccatttgtaatagtctcacctccttcttgacaatgttgatgttacacttgttttattttggggctttttgtgtttgtttgtgtgtgtgtgtgtgttttcctttttgtgaatgggggtctcactgtattgcctttttaaatatattcttttttttttttcctttttgtgaacagcaggtcttgaactcttgggctcaagctatcctcctgcctctgcctccctaagtgctgcctgtaaaggcatgagccactgtgcctggcttgatgatgttgatgataataataaagttaatatgtgctgagtaggtgacagatttaggatttgaaacctggcagcttatctccgacatctacagtcttaaccagaaaggaagagaatgaatggtacaatcttgcttgtggttgttaagctccttgaggcccacttgtgcagcagggccaggcagggaatgctgacctgctgtgccacacagaccagcccctcggttcaccaagagggatgggcagagcagagctcaggatgggcatgggatgcccagatttggtctcagttggcaaaaggcccaagtctgcaggtagatgctaaatccctggtctggattttgagaacttagagaccgtcacacttcctgctgccttgggcttatatcctcggagaaacagggagtgacaacaaacttagaaggtgaactagaggttgccaaggaaactttcccacccatcttcctctcgtaggagttggggcagaaggaaggttttttcctgttcattgcccgttaggcagatgggtagggttggaggcagtctagcagcactgaaagggaggatggggctgagaaaaaggtagcctgaggagaccaggctttcagtaccctgctggacagggctagggtacccttcaggaggctggcccaatcaggtgccagcagggcctagaaatgcccttctctccaaggggtgtgaaccctagagttcctttggaagggaaaaaagcaggtatttaaaaatccacttgtcttgcagacactgtttgaggaccaaccaggcttaggtgagctacagggtgcgtggagaacagagcaccagagagctctgtgggctggaatgagcagacaataagagctggggggcttcatggagatgcaaaggttgatgaggaagagagaaggaagttaaaagggcctcttctgggatgtgaggagcctcccccttcaaacatctaccaaatgcatgggatcttcctcctccaaggtccaaccccatgtgtttctgggatctggtcaaacagctcaccaaaagacagcctgcagctaccatgcaaaggccctacgtgggcacagtgaagaaggggaaatgtcagaatcaggatactgtacttaacttgctgctgtcgtttctgcctgaaaagcatctggttgagctagcaagcttcttgtctaggaatgctggacagttccttgggtagtagcaagtcattctttttttctctgtggtttttgagtgcttcacgtacagccagcaggggccatgaaaggaagaactttcactcacactcctctggtcaccctgctgccctccagactgtttccttgaagtttccaaggcagctctggatggttctgggatgaggctctggcctcatatgctttgttgcagtatgctggagcgatcgctccagatgttctttgtgagatgtaaaccagggcgctaatcaggagttagaccagactctgcatttttttttttttttttttgagacagggtctcgctctatcacccaggctggagtacaatggcatgatcatggctcactgcagcctcgaactcctcctgggttcaagcgatcctcccgcctcatcctccagagcagctgggactataggtgcatgccaccacacccagttgatttcttaatttttttttttttttttttttgagacggagtttcactcttgttgcccaggctggagtgcagtggtgcgatctcagctcactgtaacctcctcctcctgggttcaagcaattctcctgcctcagcctccctagtagctgggattacaggcacctgtaatccaccatgcccagctaattttttgtatttttagtagagacaaggttttactatgttggccaggctggtctcgaactcctgacctcaagcaatccacctgcctcaacctcccaagatttcttaatttcttaattttttgtagagacagagtctccctgtgttgcccaggctcgtctcaagctcctggcctcaagtgatcctcctgcctcagcctcctaaagtgctgggatttaggcatgagctaccttgcctggcctagactctgaacagttttagtgagataccataagtttatccaagtttcttctgtgttgtagcatatattcttttttactgccaaccaatattccccggtaaggatatgctacgtttgtctatccgttcatccagctgatgggcatttgaattgtttccactttttgactattatggattatggtgctgtgaaccttggttacaggttttttgtggatttctgttttcatttctcttttgtatatactgaggagcggaattgctggctcatatagtctgtgtttagcactttgaggaatgtacacgtcttcacatagatgtatgttttttgtctagaccataccctttttgtacaggttgaacatccgtaatccaaaagccaaaatgctccaaaatctaaactttttgagtgccagcatgatgccacaagtggaaaattctacacgtaaccccatatgacaggttataagcaaaattcaatcactttatttcatgcacaaaattattttaaaatgtcatgaaattaccttcaggccatgtatataatgtacacatgaaaaataaatgtttagacttgggtcccatccctgagatatctgattatgtatatgcaaatattccaaaatccaaaacaatttaaaatctgccacgtttctggtcctaagcattttggataaaggatattcaacccgtattatgtttatatgcctcttcagtgctggtagttgtagcttctgcttcctcatcccctcatttgagccgggtggcagagcagggcagactgctgccttgctcagacctaatcgttcagttctttcattgtacaagtattcattgagcagcaaacataagccagtctctctaagtgctgggatgtatcagtgaataaagaatatatgcctgctttcatgtgcttccatttttactgggggagatggcaaataaatgtaaagtgataaataacaaaggttcagtggggcattcgtagttcagcggcagaaatttcgtctcctacgcgggagactcgggttcgacttcggccatgcagtccttccatgcaggaagggctactacgtttctacccaacaaagttattatggctggacgcagtggctcacgcctgtaattccagcactttgggaggccaaggcgggcggatcacctgagatcaggagtttgagaccagcctgaccaacatggagaaaccctatctctattgaaaatacaaaattagccaggcgtggtggcgcatgactgtaatcccagctactcgggaggctgaggtgggagaattgcttgaacccgggaggtggaggttgcggtgagctgagatcgcaccattgcactccagcctgggcaacaagagtaaagctctgtctcaaaaaaataaataaataaaaaataaaggttcatgtaagttttgggtggcgatgagggcgttgaagcagttatgaccatgtagctaccatgactttgagatgcagtcttctcgcagtgtgcacaggcagcatggagggaggcagggtaccggctctccctcctgaaccagacgagctgttgtgttgccaatggaggttcagggagccagtgatgggacagctctgctcctgagctttgccacccacaggacctgggcactggaccttatgatgtgcttctctggagtgaagactggctgtcacctcagccccctctcctttcttctgctgccatatcattcttcacatgcctaccagccccctggaatctgcccctgcaccctcatcccttatatattttgcagagagcgtttagaggactggaagtgtggcatgtaatggtatctctgtttccaccccgcagcccaccttgggacaccttgactccaagcccagcagtaagtccaacatgattcggggccgcaactcagccacctctgctgatgagcagccccacattggaaactaccggctcctcaagaccattggcaagggtaattttgccaaggtgaagttggcccgacacatcctgactgggaaagaggtgagcactgggactggggacatggcagcacctcccagccctgttgacactccagcaggtggtgatgggactactactgcagccaacctcttgtttatccggcagaaatgagatctgagatataggggtgcaaaaagctgtgggatgaaaaggagtaagaaatataaaggaggaagtagattggaatcctgggtttcgctggtcagagaagtgatttggggcctttttgtctcatcctcaggtagctgtgaagatcattgacaagactcaactgaactcctccagcctccagaaagtaagcacatggcacctcctgtccctttttttttttttttttttttttttttgagtcagagcctcactcttgtcgcccaggctggagtgcaatggtgtgatctcggctcactgcaacctccgccttttggtttcaagcgattctcccgcctcagcctcccgagtagctgggattataggcacccgccaccacacctggctaagttttgtatttttagtagagatggggtttcaccatggtagccaggctggtctcgaactcctgacctcaagtgatccgctcgcctcggcctcccaaagtgctaggattataggcgtgaaccactgcccccagcccacctgtccctttctaaatctctcttctggggtcaatgatctactgaccccatttagaccttctcttgaattcctagtttaaattttctggccatttcgctcaccgtcccccaaccattccctcccatggctctgctaccttcggggctttggttggatcatctgtggtgactcctcctgagtgggcttcctggccataggcactggctcttgtgaagtctttctgttcattcccagccacttggcctacctgtctgacctacttcctgcatcttgttatcttctggcttgtggccagccctatgcaaaaacacatgtttgtagccactactagaaacacgtgcagctacttcaagatctggaatgatacaggggagtggctttagaaatacaagaataagaggaagcagggaacctgccggtgggttctgtgccagctaccttttagagaatgagctccagctcaaattttctgaacaaaacctagttctgttcatcttgtggcaaatcagatattttctccataagcatattgtggcagttgagttaggagaaggcatgattcgtgctaacagagtcagatagtgatactgggaaccttaggagtaagggctgaggattgttgttgagggcgatgctcatggaattagagtggatgagttgttctccggacatgcaaatagccagaaccaaggtgtttcctatttattgttacccctgggatcccttcaagggttcttcagttcagtagaaacattgttgtcatcatcagggtgtctctgcttgaagctttccaggaggaagggaaaaagggctgcttatgacatcctggctccagccccacagaagaagtcagcgtggggtaggccatttggccttgggagcagtctagcctgccatcgtaataatcgccagtccaccaagccatcttattcctgaccttgtttttctccctaattcttcttggttttctccctaattcttcctgactctctggaaggcaccaacaccagacaaatagagccattttcaaaaccttttgagactctttgttactaaagccagtctgattctggccaaaaatgtgatctcagcaatgatccctgaaaaatgaacattgaagaagctagccccctcaggggtctagacaagcccagaaaaccccaagttctcccagaagaatgtcacttccatgccaggtgagcagcctcaggggaagaagccctggcagctgcctctggccctatttcagagctgctccccattactgccccagagggtggtatccaggctttttgcctctccatccaaaatatctgttggaccagggaaaaaagtaagaaaaacctaggccctaataaagggtaaggtcagcattgggttcctgaggattggaaagcctttttcttcttttcctttctagcttaggaaagctctggggcatcattaaaggggaaacaaatgtattcactttattccataaaccatatcttgaattagggcttcccctacccccaacaaaaacaacaacaaaaactagttctgttctttgtgcaagtgatgaggcctgaaattacaaaaagccccacctccagttctctggcccccgcagaggggaaggagttcatttctgtcatctttctttatggaaatacatggtttggagcccctggttttgtttcacaaagagagcgtgagtgtgtggaggtggatttgattaaaattggcatcagctatatataggagtggcttcttctgtcaccaccctagaggcccaggaaggaaaggcctatcccctagaacagagccctctgactactgtaaatcagaaaatgatggggtccccctctggtgctctaccacccctttacacagaccaagctggggtgtgtactgtcactgaaccaaggcagcagctcggattctgaatattcacgcacacgggctcacactccctccagtagaggcacccagccaaaacctgcctgctgttttggggctggatttggtagacgcagcagagggcatggctggctcatcctgatgccatcccgggtagcacgtccccacagccagccctcctccagcttccccaacttcccagccacagggaaggccgtgcatgagctagacaaccaccctattttcttttccctgcccggttttggttttttgggaaaaacaaatcctggcagggactgtttggagagacctgatgggagcaagttgggcaggcatgacccctggtattttatcttccagctattccgcgaagtaagaataatgaaggttttgaatcatcccaacataggtgagcacaagttgttatttctttcttcttccccaacagcaaggcactgctttccagcatgtcatcttctccccgaggtgcactgccttctggagtctgcagtcttcaaggatacccctggggaagctcagctcaaaatccatctccccttctggcacactgggctgtctttagcagtttggctggcatgagaggaacttgttcttgggagtgggggatcatgaaaggaggggagactttcgttcctaggatgctcctggacatgttggagagcagtatgtggcccctgttgcttcttgacttaaggcttggccttttctcttgtagttaaattatttgaagtgattgagactgagaaaacgctctaccttgtcatggagtacgctagtggcggtaggtgtggaactgcctcttcctgttgtgcccccacttcttccacctccagccagctctgactgagatccctgcctggtctcttacaggagaggtatttgattacctagtggctcatggcaggatgaaagaaaaagaggctcgagccaaattccgccaggtaggtgtgactccctccataggagctaggcctgacctctgcttttggggtttgacatgtaaggataagctgcctgtctgtaagtggcccttggagggtactttgggctctgcttatccgtgtggcaggttagcactaagtcacagggtcactgctctgtcagcccctgtggcccaccctcaggcacccctgggttaacccttcttccttcctttcagatagtgtctgctgtgcagtactgtcaccagaagtttattgtccatagagacttaaaggtaaggcatgcacttctccttgtgcctttgagtgggagccaggttgttgcctcttggttctccatgataaaaccatcaataaccatcaggccctgagtgttccaggaaactccagcctttctttttttctttctttctttctttttttttttttgagatgaccagaaagcccctagggctgcctctgatagaggccttgtggctggacctcgggttccattctagcccttgagcaggggccctctgccatttcacctcttggcacatcaccttttagtgctgccaagcaaggcaggcacactccaggctttctcagtctttcaggcaacctggtagctgacccagggaagagtgctgaaagttccacagctgtatcccagctgctttgcaggcaggcacacacataccatctccatcaccaagatactcaagtttgaggacacctgtgggtctcttggctgctgagtcctcacagacatgatttgattaacctgggcctgatgctgaagctttgcacagctcacagggtctctgggccttcagatcccatctctcccatggctgcccacgtgaggagtggcctgcattgccttcctcctgcccagcctattcacgctgattgaagccctgccctgaaattggtggagaaagttctgagactgaagatgactttccgtttgttctcccattcccctcagctccttcctgcccagggccttagtctggtccacttggttccctgatgttttccatcttacctcccaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggtggagtgaagtgcaagctttttattgcttctcatttcctctcggcctctggtcttagccctgacctcctgcctttgccacctgtctacatttgtcccaagccaaagcttcagagaagggcttgctgaggtagcagcagtcaaaggccttctgcacctgggaatgaataacctcagttcctttctcgaaagatgggataaactgtgtgtgtgttcatcccccaaggcactccggattgcaggcctcggactggtcaagttagagggtacgagggtatttgacttcacttgcctctctggtgaggtgtcttgtccccaggctgtctgccttcttccatatttcatttatgtctgctttgccaggcttaagctctcaggatcttggatattaggtttcttcctttggccttggggtgatttcaattttctaaccctggatcctcctgcaggagctgcgggaacgggtactgaggggaaaataccgtattccattctacatgtccacggactgtgaaaacctgcttaagaaatttctcattcttaatcccagcaagagaggcactttagaggtgagcagtggagcccaactggcggaagggcctggggtccccacagaaactttccagctgagtttcttccccctgcccttttccttctctgtgctccccagcaaatcatgaaagatcgatggatgaatgtgggtcacgaagatgatgaactaaagccttacgtggagccactccctgactacaaggacccccggcggacaggtgaggctgtgccgggctgtgaggttaagcttgcctaggagttgaggccagtcttaactgtatgtccccctgtgcagagctgatggtgtccatgggttatacacgggaagagatccaggactcgctggtgggccagagatacaacgaggtgatggccacctatctgctcctgggctacaagagctccgaggtgtgtgctccccgctccattctctgacctggccagcctcactgtctgtagcacctatgcttctaacacctgttgagggcagaagctcatctctgagtaggtgtgctctctgctcaccaattttaagcctcagctttggtgtctaaggtcctctggcccattcactgatctccatgagtgaattaatagaaagctggtagggtcggtgtgggactgggtcagagtttcaatacgggtgagttgatctaggttagtctgcattgattagatgtgtctaggtcatcggctagcactactacattgatctagatatctttgtgtctctttttgtatctggaagtgtacatttctgggtgtgtgtgtgtgtctctgtgtgtgtctgatcggaagtttgagtctgttgcttttttttttttttttttttttttttgagacggaatttcgctcttgttgcccaggctggagtgcaatggcaggatcttggctcactgcaacctccgcctcccgggttcaagcgattctcctgcctcagcctcccaagtagctgggattacaggcatgtgccaccatacccggctattgagtctgttgcttctgtctagtgctttatgtttgggtgtgtgtatctgtgtgtgtgtgtgtgtgtgtgtgtgtgtgtatgtgtccgtcttcccgtctgtggatctggagactttgtgattgttcttctgcccatttgggttttgttcatcatctgagtatccccacatgaactcccagcctccctgccctgctctccctctggtggtgggatccttaagaggcacctggtgacacttggtataggcccatattgctctgtgttgaggggagtggacttgagtctggacatgtgttcttgcggatgtttgtgtctctgggtgtgtgggcttatgtattcctttctgagactgtgtttgtcagtgtctgtgtcagagcatgtgtgtctccagggtctcctccaggggggatgtattggtcttacaagtggatgtccggtatgatcctggggtgtttgagtgttgggagagggcggtatgtgtaaatgtgtccatccatagggatctccacatgacttctgccctcccttgaagctgttttctgtttctttcagctggaaggcgacaccatcaccctgaaaccccggccttcagctgatctgaccaatagcagcgccccatccccatcccacaaggtacagcgcagcgtgtcggccaatcccaagcagcggcgcttcagcgaccagggtaaatgcttttgggagttgtaggtggggactcacccctctccagagaggttacaggttctgtggggacttgggtaacacaactaagtttcagtcctggttcagccacttattagtagtgtggctatgggcaagccacttcccttccctcgcctctgtggaatgggggcttgctgggttgttggccagccctgtaggaaatgagcatgcgtggggctggcactcagtggaccccttggccttacccattcccatcctccctctggcccagcagctggtcctgccattcccacctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacggtgagccgcaccccccgctctctccttccttcctgcggtggggcctgccctctccaggcagctcttctcttaattcagactctgttccctttggctactacttctgcttatagcaggaagcctcgctcccagcagtaaatgcagaatcctttccttaacctaccactgtctgcttcaggtggaagggacaggaagcctgttccatgaacctggggggagaacctggctgtagaccactttggctttctgatagaacgcttgccctttattccccacagaacagcgtcctctccaccagcacaaatcgaagcaggaattccccacttttggagcgggccagcctcggccaggcctccatccagaatggcaaagacaggtgagagacccgggccctgcctgcctcactccctaggagccatgtctcacagggtgatgtctgtcagcagcaccgtctcctgtccctgccagcgcattgctccctgctccctggagttccatcctggctgtgtccagtccagctttcccctcccctattccacgccattgcctcctccccatcttcctctgactgctacttgcagtttgccaagtgtggggctgaccgtggccatctcagctacatgctcgcttcttgaccacggccagggcatggcagctgccctcctctagacatgagcagctaaggccttgtgttgggggtcccagctcagggcagaaccaagagatgcccaccttgaggggtgtacacatagagggcgactccagccatccccatgagaccagagctccccagccttcaccggccgcatttcttggtgttgcattcctggctctatctcttctgagtttatgaaagtttcccctcagcaacaccccactctttctgtagaagaaactctcctgttcttaaaattcttaggaggccagtgcagcctggaggcagcggccccttgtctgctctccttcatttctgattcctcttcccaggcactgacccacctcgctgcttcccgacctcactcacctccacttctcagccccgcattcctcagttctgacttgcatcccgctgctgcccaggcctgacttctaccctgccagagctccccagctctggcccttcccctgcccttgcttcctaatccaggcctcccgccctcactcacccctaacacgggcctctccgctgcttttgtttcctagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccaggcaagtgtgctggggcagctggtgcacctgctgccctcagcccaccctacccccttgccccaacaatttcttcttcccacttgggggtcctgctgtgttcttgtcatcttagccacaagaaatgggtctgtcccctgcggccaggaagtggagggaacaaaaaagagcattaatgcccctcttttccagttctccctctcagaacaggtatgcaggaagctgtcctaaggctccaaagggaaacctttttgttctgaaccttccagggtttccttagggaccccggggatagtcggcatcacagggactcaatcctcaagggttggtccccattgccgccttgagggtccagtctgcccggctcccagggagcccgctgtctccagcctaaaccacactccacacaggggtccttccttgcctccctccctcccttcccaaaccatctccttccacttccacgagacttccttctcaccactgtcctcagtagtcacacccttccttctgtgtcctcgtgatggctgcctctgccctagcatccccctccctgtccccaccacagggtgtccaggtgcccagtgatggctgtcctgtaccctaattcgtccccctcaaccccacttctcttcccacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggtaagcaaggagctttgggtggcagagaggctcaggccaggccttcctgctttactcggggtgggttgggggttgggggttggggtttgggacactctgtaccggtattgggtcctggggttagaagaggcttcaggaagcacaagaaattaggtctttgtcaacaccttatgtgcccaggcccacccctcttaggcctctccccaactcctcacaggcacccctcattctctggccccaagcagatggccgatgccgcctcctctctaggagagtgtgaactcagatgctaaaataaaagcccccccttctctcctgggttcccatggaaacttatatttggtgacgcagctgcaaagtcatgaggcatgagccaggctggggccagcaaggaaaattttgtcctggtctcttgcccctttgactgcctctcccactagttggttctgtttctggctgcaggcgcagccatgcccttctgcccgggggttttagggtgaaacctataaatgaaatcactggcgagggcctacagtggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgcagagagtgtgggcaggtctgaaagcctgggactctagtctcgctgagcggctcttccgaaaatgggatgacccttgaacctgtaaagccacctcccccacctgcttatccacataccgtcttgttggttttttttttatttctttttttattttgtcttttttttgtttgtttttttagaaatctgtctttcaggtttgccagaaggtaggcgttgagcccgctgtgtgtgtgtgtgtgtgtgtgtgtgtctgtgtcctgtgtcctgcctccatcactaactccccttttctggctcttactctcctccatctgcttaaccaagtctgtgtggccctcctctctctgccatcttaaagggatgaagactgcctctgattgggcatcagcacaaggcctgccctccgtgcccccagtacaaacaggcagggctaagaggccacattggcccactcagggcaaatggctttaaaaatgagggccttccttgggcccacagttaacgcctgtcctcaagtaaggggagactgtctcagggaagcctccctttaagattgtctcctctcacccaccccaccccacccccactccctctcaccccaggttttggtcacaagtgttgggatcctttcctgccctttcccttgtcatgtgcatgcgctatgaggaagctccagggttacaagtgcatctgggatggtatcttgtttgttgtctcctgggtttcctgaacttcagagctatgtgacctcttccccgtggcctatgggatcgcaggactttggagacactacggggaccctggggccccaaggtttcagtctggctcccccagaccttaggagcttttgtctcacaaatggagcacagcaccccctcctggcagctcctgcagaactagccccacccacccgcacccctgccccagcacccctgccaccagcagcatctggataaatcaagcctcttctcctctaggctgttttctccagatatggcctgtctcttccaaagtgcggggagctgggacattctagggcaacggccattctaccccaagccgtagcaaaacaacaggagatctctgcacccttactcaggggtctcccttcacagtccccttcctggctctttcacccctggccttatgctcatcctctctgcaggcctcggggaccaaataccaagctgaagaccaagggccaggttaagagtgcttgttccccaaggctgtctgctcaggccctgcattgggactgggatgcctggcaggcacattggtgccacagctgatggaggaacgtccagacagggtcttcaggctttccctatcccctcctcctcccacccagctgttgactgcatgactggctgctgcctcaaggggccccagcagggggctgccccacagggggtctggagagagcagggagggtgccttcctcgcacagccgggctccctgctcgcagtgcgcttgtgtgcacccctgtgttggttgtgtcttcctgtttatttctatgtgctgctgctcttcctccttcctctcacatccttcctcctctgcaatccccagtttcctagctccagacacccatcttccagccaggagctggagaagccgctcagcggggccagacctcttccccacccacccaaccaaggtgtctgccctgccctgccccaccccaccctcatcctccctgcgtatgagcagatggcctggcaggccagcaggtaggggagttgggaaaggtcggaggaggccgccttttccactcagcagcaggaagccatccccaggtgcctaccatgcagacccaggccttggcactttgagtctcctgacaggcccttgcgtagccacggcccctcctcctacagagattcaaagcattgcagcccctttcctccaaaaggactgcagtcctgagaccctagcgtgtggctccaaaaacgcactcacacctgcaacccccagaacagcgcgtgagccctggctgtgggggagcagcctcgtgccgggccgtgtgctcagtgtgctcagtgaagtgcgtgcacagccactccccctcctcccccagagcagaggctccttctccccggcacagatctgggaatgtggggagggacaagccccatgtgctgggctccctgctggaaaggaatggttgagccgccagtgtgaggtgctgcagagccctgttggcttgccaggtgatgggcagagggccctgggcttgggtcctgcccacccactggtggcacctccccagacccactctcatctgggtctgtggcggcggaaggagcgagagatcccagcactaaactctccctcgctctgttttttgaggaacctgaatgaacctgaaagcaaagaccgagtggagacgctcaggtgagagggctggagccagcactggccctgcccgggccaccgggcttgccacagcctcctgctcctctcttccttctgccacttggctcttcctcccgtggttctgccctgtccctaccctctggggcctccctttcctcagagagtttccccttcccaaacccaattgcaggagttacgggcccttctcctcaggtctggtatattctggaagtcggagttctgggtcgggtggttggggctacagattcctacccctggactatcccacctccctgtgctcggaggctgctttctggagagagagtctgtgctcgtgctgttgagggcactggtgtcttccctgaccccaccccgcctaccccaaggctggcttctcctccccttcgctgtcctgagagatgggggttggaggactgccaccctccgcccccgcaggccaggggccacgcctggctgctcctgctccctcccgctctcctctctgggctcaggggctgtctgccagggtggctctcctggggtggggtgcctcagcccccccgtgacgcccgcctctgccctctccacagacctcacgtggtgggcagtggcggcaacgacaaagaaaaggaagaatttcgggaggccaagccccgctccctccgcttcacgtggagtatgaagaccacgagctccatggagcccaacgagatgatgcgggagatccgcaaggtgctggacgcgaacagctgccagagcgagctgcatgagaagtacatgctgctgtgcatgcacggcacgccgggccacgaggacttcgtgcagtgggagatggaggtgtgcaaactgccgcggctctctctcaacggggttcgatttaagcggatatcgggcacctccatggccttcaaaaacattgcctccaaaatagccaacgagctgaagctttaacaggctgccaggagcgggggcggcgggggcgggccagctggacgggctgccggccgctgcgccgccccacctgggcgagactgcagcgatggattggtgtgtctcccctgctggcacttctcccctccctggcccttctcagttttctcttacatgtttgtggggggtgggagattgttctccagcaccccacattcacccctgcccagagattcccccttctcctctcccctactggaggcaaaggaaggggagggtggatgggggggcagggctccccctcggtactgcggttgcacagagtatttcgcctaaaccaagaaattttttattaccaaaaagaaaaaagaaaaaaaaaatcccagcggccacctttcctccctgccccattgggacagtcgagactggatctgtggggtttcccgggagggtggctcagggctggaacactctcaggcaagagtggtggagctcccgtcaggccctccgccaggcccactgtgggcttctcccctctcctccctccttcccctccaagcaaaccaccagaggtggccttcccctgacctcaggcccctgggctggaggcctgggcggtggggcagggggcgggggtgctgcgcagccctgcagtgggtggggctgggggctgctccggggctgctgaggctggagggccggcacaaggctccgcctccctccacactgtaccctctgcccctcctccccagagctgggcatttccttccacaagctgctgtggggacgtgtgttccctcaaagtctgtgccatcttctcccacccctcccgggtagaaggaggggctgaccccagggctgggagaggggaggggactggagggcagactggcttctcggtccccagggggccgcttgggctgttggtctccagagcagggccactgggcactctgtgatgggggagcctttgtctgaaagcacagccccctcgcccttcctctccccatggcttccccttcattggcattaatctgggcaccagctctctccatagcagtgacttccctcaccactctcatctctcagccttgccttttcttcctgacactgtcgccccctcctctcaggagacactgccgagggccacctggcagaaggctgagttaggcagcagggccgggagcgtctgccctccacagggtgggggacagataggctaagcgactcccagcttgctaccctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagttgtacatttttttgtgatgggttttattttttattattttattttatttttttttttttttgatttatgatgactccacccctcttcatcacccccgctcccaggccaggctcagcgattaagccgagcccttgcgtcctaggaaggggccttgccaacctcagccctcctgccccacactcctactgcggctcagaccaagggctccccctccctcccttcccccctcctgccctatggaacagcccgggtgctctgagggggctgggagggcatggcttggctcccaaagggggtaggggcccggggcacccaggcaaggtggcccctccccgtctagccccctcctccccaaccctgcacttagtttctcctctggatcaaacacgtaataaagagaatgtttggaatctgagctgcctcctcctgtctcttctcccagccaggcagggacccagtctcctgtgggcaagatgtggcctagcccacctgccttgcaggagagacttgattcctgtctggggccagtgctgggtgggcccagctccccacttacccacagggcacagacaggaagcaaagcccagggcccttgcaccaaaagggaaagaaaactcagtaagcttagattttattttttttaatttttaaaaaatgttgaaaaataaatccatgtctgcataagttcccaacccccatttctccaagtttctggaaggtgggcttggtgggcaccctcagctccttagcatttcccagctggcccctgaagacagagcttctcttccagcctctgctgctgtaaggcccctctgcccacctccccccctgcagcctccctccccacctcaccccagacttattgctaaaagaagggaaagaggaatgagaacagccagcacacccaactgccctctccccactccacgctaaggtcactaccccggacacacaaagggcaggacccagaggcc

SEQ ID NO: 13289 - DNA, 24984 bp, Human; identical to SEQ ID NO: 13288

SEQ ID NO: 13290 - DNA, 22347 bp, Human
  misc_feature (1)...(22347): n = A,T,C or G
ctgggcacggtggctcacgtctgtaatcccagcactttgggaggccgaggcggggggggggggatcacttgaggtcagtagtcttgagaccagcctggtcaacatggtgaaaccccgcctctactaaaaataaaaaaattagccgggcgcggtggcgcacacatgtaatcccagctaactggtaggctgaggcaggataattgcttgaacccaggaggcagaggttgcagggagccgagattgccccactgcactctagcctgggagacagagcgagagtttaagaccagcctggacaacatggcgaaatccatctatacaaaaaaacaaacaaacaaaaaaaaacccagaaaaattagctaggcgtaatggtgcttgcctgtaaccccaggtacttgggaggctgaggtgggaggatggcttgagctcaggaggttgaggctgcaatgagctgtgatggcgccactgcactccagcctgggagacagtgagattcgactccgtctcaaaaaaaaaaaaaaaaaaaaaaaaaaaaagcaggcggttagattgcacaggccctgaaccccatcctaaagcctccagcactttcaagtgagggattaccaggtttgcggatctgctgcaacttggctgcagtgtccaaaatgggtggggcaggtggaattaaagatgaggctgtggagacaagctactggcagagaggacacactttaaaccctgggaagatatcattacccagagagggggaaggatgaggacactgcagagcccaacatcatcgccagacccgagtcatgcggctcctttgttccaggaaccaaggctgaccctagaagcaatagcagcattttcactccgcaggtgcatctcttccacgctttggggtgcctgccctgcctccgacttctggggctgggatttaaggccctaccagggcacagctcgccagctcacaggcggtcaactactgattcagttcttcgtctccttcactcctttacatcggactcacgagggctgaggggcagctccctttcgttaagtgcttcccgcgtgctcaacaccgcacgaattcccctcggccctacaggaccaaacgaccggcgcgctgagaaagggtgtgcggttccactgaggacgcccaagcgggacagccgggcccgccgcggtgagatccccggcctgtccagcccaagcccaagcgccctcgcggtcacgtggcatttccggaacattcagaacctaacagccaggaggcaggagggccgggccgaggccggagcgctggacaacgcgggtagctggcgctcgagggacaggcagctcccaccggctaggacccccatcccgatgcgcgggcgaagggctggggccctgtgccgctggcgatcccggggaccgcctggaactcgcggcactcgggagcgagagggaaagcaacccagaggccccgcagccgccggcgacacagctacagaccccgactgcagccggtactcccatatatcaggggcggggcgaaacccggccttttgaagggcagcgatttaaaccaatcagcgcaaagagttggcaaccctccgcccaattggaatcgctctcattctgaaggcggttccgacatggagtccggcagcccaatgggagaggtggaaatttccagaacgatcagaaccaatgggcgcggccagcgcggctacgattggcagtgcaaaagaccaatccgtgtcgcagaagttcgctcctccctccattcgtggagcctgagatgggtgggtttatagaggagcgcccaatcctgaggtgcgggggaggcagggttgagggaattactccccgctgtccaatgagaaggaagtggagatgatgggctggacctcaagccaatagtagagcagcacagacattccccctagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtgaagggggaggggcgggctgaggccccgagcctgctcggggaccggcggtggccaggccgcggtaggggggcggggcgggcgccggatccaggagaccggagctcggcgctggggccggacggggcggcggcggggaggtgagggccgcgggcggcgggcgggagcgggatctttagcgaggccggccgcggggagcgcccatcgccccctggttgggcgaggagggcccggcggaggccacagcttgggtgagtccggccggcggcgggaagaggggtcgcgaccgggccctgaaggcgtcccgagggggcggctgcgggccatgttggggagggtgcgggccgcagggggcggggtggaggtgggccgggggccggggtccgcacccgcgaggtagccctccgggagatctcagacggccgacggagaaaccgctcgggacttagccacgaggaacttggacggatccagggagcggggacggggatacactgggagtagccgaggatcttagcagcctgggatgcagttggggcaaatgttactcttctacatctgagaaggtcagggtgggagagcgttgagcgggggtctgaggagcgacagaccgactctacctgatgcaggaaagggaagggtgccgcaaaagtccttgggacgaattccatctctgacagtgttttacaaatgtattgcggcccctccccctctttttgtatgcttgtgtgtgtgattgtcgagtgaccgaggaccaacacttccgaaaggtgggtctgaaagatgggtttctgacgacccgggggtggttgtagacaatttacagagatcaaccgctggaagttatgggcctctactgagcatttgaggggccgagtttgaagcggttgctgcttcctttcagtgacttggttatgtcctcagtagcttgcggttatgaaaggcctagaggttttgttcgatttgaagctgtcattgagctgtaatgattcatcggaagaaaaaggacaaaacaacctccaagaaacctctaccaacctccgagaaatcatcctcccgctcgggagtactactgtcttcgctccgggcccataacacttgggggtgacaattctgaaactatacctggtatctggttcttacttcagggccataaaactaagatcgcccacactctccccttaaataagacatctcgatggactagtgactaccatcctttttttggtgtgagctacagagctgagcctttggtctcttgtagcagttgctgctttaggcaaagctcgagcttccttgctgtattaaaaagagtggaaatgaagttagtaaacttttttgtgcccatataatatttcagttgtatctagggttaaatgggctgtagtataggtgaggaaaagatttctggaataagacgttgctcttttacctttaagaaaggatctggggccgggcaccgtggctcagcctgtaatcccagcactttgggaggccgaggcaggcggatcacgaggtcaggagatcgagaccatcctggctagcacagtgaaaccccgtctctactaaaaatacagaagaaaaattagccgggcgtggtggcgggagcctgtagtcccagctactcgggaggctgaggcaggagaatgacgtgaaccctgggggcagcttgcagtgagccgagattgcgccactgcactccagcctgggccatagagcgagactccgtctccctccagcctgggccacagagcgagactccgtctcaaaaaaaaaaaaaaaaaaaaggatctcggctgggcgcagtggctcacgcttataatcctagcactttgggaggccaaggtgggcgaatcacctgaggtcaggagttctacaccagcctggccaacatggtgaaaccccctctctactaaaagtacaaaaattagcgggtcatggcgcaggcctgtaatcccagctattggagaggctgagataggagaattgcttcaacccgggaggcgtaggttgcagtgagctgtgatcacgccactgcactctagcctgggtgacagagtgagactccatctcaaaaaaaaaaaaaaagaaaagaaacgatttctgttaccaaatttattttgtattttttttagagacagggtctggttctgtggcccaggctgaagtgccctggtgggatcatagctcactgcagcctcaagttcctggcctcaagcgatcctcctgcctcactctcctgagtagctgggcacaccaccacaactggctaattttaacattttttgtagagacggggctcttgctgtttcccaggctggtctcgaatttctaggctcaagcaatcctctagccttggcctcccacttcattagcactaggattacaggcgtgagtcaccttgcctggtcttaaaatgtttgtttttaaattaccactactggtgatagaagtgtatgtacaggtaggtagatggtgaatgaatatttgacttaggacagcaaactggcatggcagctgtacagatgacctggcatttaatcccaggtgtgtttgagcccaccatctggaagccattcctgaaaacaaacacgatttctctaccttttgttttcattttcaactgtgaggtttgtatttcagtttagaaaatactcaagttgggccgggtgcagtggctcacacttgtaatcccagcactttgggaggccgaggtgggcggatcatgaggtcaggagtttgagaccaacctgtccagcatggtgaaaccccgtctctagtaaaaatacaaaagaaaaaagaaaaactgggccgggcgtgctggctcacgcctgtaatcccaacactttgggaggttgaggcgggtggatcacgaggtcaggagctcaagaccagcctggccaatatggtgaaaccctgtctctattaaaaatacaaaaattagctggatgtggtggcacgcgcctgtagtcccagctacttgggaggctgaggcaggagaatcgcttgaacccgggaggcggaccttgaagtgagccgagattgcgccactgcactccagactgggtaacagcgagactccgtctcaaaaaaaataaataaataaataagcggacattgtggtgcgcgcctgtggtcccagctacgtgggaggctgaggcaggacaattgcttgaacctggctggtcgaggttgcagtgagccaagattgcgccactgccctccagcctgaatgacagcgaaactgcatctccaaaaaaaaaaagttggacagattttgaatgttcaggcttttttttttcaataggggcctttcaaatcccacaatgatacacttcttacatttaacccaacacaggcgtacagccatgtaacacattcagcaaaacagtatttactgttatgtgcactgtgtgctggtatttttttgtcccatttggtctcttaaaatgctggtcatgacctacaaaattgatttcctgacccactgttgatcagtactctgtttgaaaaatgcttttctaaagcataggcaggaacttcaccagctgcctcttgacaccacttgagttttgttaactcttcgtcttctggcctccatcttgggctctaggattttttatcccttgtttgcttaatttggcaggttccttctgcccttgcctctgtaaggtctctgattgatggaagttcctgatctctctatttgaggattccaaaatcatttctcttttttttttttttttccaaatagagtctcactctgtcctccaggtgagaatgcagtggtgcaatctcggctcactgcagcctccgactcccaggttcagatgattctcctgcctcagcctgctgagtagctgggactacaggcatgcaccaccacatccgggcaatttatttatttatttatttttttgagactgagtttcgctcttgttgcccaggctggagtgcaatgacgcaatctcagcttactgcaacctccgcctcccaggttctagcaattttcctgcctcagcctcccaagtagctgggattacaggcatgcaccaccacgcccggctaattttttttgtatttttagtagagacggggtttctccatgttgaggctggtctcgaactcctgacctcaggtgatctgcccaccttggcctcccaaagtgctgggattacaggcgtgagccactgcacccggcagcagctaatttttgtatttgtagtagagacggggtttcaccatgttggccaggctggtctcgaactcctgacctcagttaatctacccgcctcagcttcccaaagtgctgagattacagcctaaaatcatttctcttgacaaaactatttcttgcatcaatttactgggtcgtgggtggataatacatagaatgagttagtaacttcggtgacaactctatctcacagaacgtttacctcttaaaagtgtattttggcctggtgtggtggttcacctttgggagactgaggcaggagggttgctttaggccaagagtttgagacaagcctgggcaatatggtgagacaccatttctaccacaaaaagaaaaaaacatttagccaggcatggtgacacacacttgtagtcccagctacttaaaaggctgagttggccgggcgcagtggctcataccagtaatcctagcactttgggaggccaaggcaggcagatcacctgaggccaggagttcaagaccagcctgaccaacatggagaaaccccgtctctactaaaaatacaaaattagacggatgtggtagtgcgtgtctgtaatcccagctactcaggaggctgaggcaggagaatcgcttgaacctgggaggcagaggttgtggtgaggcaagattgtgctattgcactccagcctgggcaaccagagtgaaactctgtctcaaaaaaaaaaaaaaaaaagggctgagtcaggaggattgcttgagcccaggagctcaaggttacagtcagctgtgatcatgccactgcactccaggctggtaacagagtgagatgccatctttaaaaaaaaataaatatggccaggcgcggtggctcacgcctgtaatcccagcactttgggaggctgagatgggtggattaagaggtcaggagttcgagaccagcctggccaacatggtgaaactccatctctactaaaaatacaaaaattagctgggcgtggtggcgggtgactgtaatcccagctactcaggaggctgaggcaggagaatcgcttgaacctaggaggcggaggttgccgtgaggcaagattgtgccactacactccagtctggggacagagcaagactctgtctcaaaaaataataataataaatacaatgagcttctcaaggggttgcctgccctcaggtaggctgctgtggggcacctgaccttttgtggggcagctcagtaaggagaaaccctttagtgaggacactgttctgacagggccaaggcctgcctcactttttttttttttttaatgaaaaagtaaaatttaatgtggaaaatgcaaacttggggagggcagaaagatcacacacaaggctgtcacttcacacttggagggttgcacagtggcccaacagaggcacacctcacttgccagacggtggggcaggtgggcagaggtgctcctctctccccagtcagttgggtggccgggcagaggcgctcctcacttcccagtcggtggggcggccaggcagagctgcctcactttttaaaactgctgtatcccaccgggcgcggtggctcacacctgtaatcccagcactttgggaggccaaggcgtgtggatcacctgaggtcaggagttttaagaccagcctgaccaatatggtgaaaccccgtctctactaaaattacaaaaattagccaagtgtgggggtgtgcgcctgtagtcccagctacttgggaggctgaggcaggagaatcgcttgaacctgggaggcggaggttgcagtgagccgagatcgtgccactgcactccagcctgggtgacagagtgagactctgtctcaaaaaacacaacaaaacaaaaccccgctgtatccttacttcttgcactttatatgtttgagaagggagaggtttaaaccacagtagcatttcttcatcctccatcccctttgtaatgtaatatttaagaatggcaggaatcaatttggggagctagcttgactgttacccattaatgaacatttatctatcctgtggtgacatgttgccacaccaggaaatggagactggttcttccctgatgggaggagatgacaactatgccataggcaagcatcttgccgctcccaagaaagagaagtctccgctgccatcccacagcctttgggtcactggagcatgtatcagtgccactccgcccaccttcttcctgtgaggggtgactagggctgtgctctgtttgtcatttggatgctttggaaatctgtggcaaatgaattgacttttccatggaaggagcatgtggcacattctggagtggcttcgtgagctccatgtggagaccggaagagtggcagagccctcgttcgtcacatgggggccagcgtggagtgcagcctgggctctttgcccctgcttattttttctttgctggctccttagggaaggtgtgagaaattaaataaatgaaccggttttctctcttctgatctgtaaagtcacctatttatttgttggtaactacatgaaagaatgagtgttgtctttaaagcttgggattaaatgggcacatcatagagaagctgtgtgttcctttcccctcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaaggtcagctgtgggcagtggagggagagaggcccttcagacccttccagaaatgccttttggtggcctgaggtttacctgtcctgatacactgatagttacctacccacctccctgtttgagtatcctcctcagaaatggcatttttcatcaaatctaaggtagccattagttgtaatacaggctttatttttggtactaagaaggaagaggccagggctgggcgcggtgacgcacgcctgtgatcccaacactttgggaggctgaggtgggcggatcacttgaggtcaggagttcaagaccagcctggccaacatggtgaaaccctgtctgtactaaaaatgcaaaaaaatttagccaggcatggtggcatgtgcttgtagtcccatctactcaggagactaaggcaggaggatcacctgagcctggcaagcggaggttgcagtgagctgaaatcgtgccactgcatccagcccaggtgacacggcaagaccctgtctcaaaaaaaaaggaagaggcccggtacagtggctcacgcctataatcccagcactttgggaggttgaggcaggaggattactggagcccaaaggtttgggaccagcctgggtaacataaggagtccctgtctttaccaaaaaaataagggaaaaagtgttgccaaagaaactgaccacagtcgatcagaggtgaacaaggcggggcggatgtgcctctgctatttggatggatccttacagtagcagccttggcctcgtagcctactcctctcctttttttctctttggccttcatgtgaatactcatttttcccccataaaagtagaattgttcttttttgagttcgtcttctagatttacctctgggtgttctctattttgtgtctgtctttggtggtttaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcaggtaggtaccacgcacagttttctttcttattattaatgtgattaattttgagtcttcacccctgagaaatgtcagtctggtagggtatgggacacagtaattctagtgaactcatttcatagtgatgtgctttcctttatttggacagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgtaagtggacgccgctcactgaggttctggaaatcggggaatgttatgctttcttcctgtaacctcacagcagagggttccctggtctaaactgcagagtttttgcctttgcttattctctgcagagcagtaggtggtggtcgtttatttgtaattatagaaagggtcaggggagcatatttcacagtaatctagaatgttctttgtcatctgtatacacctctctcctgctcttctagaactctgatctagcgtcaaccccatcctttccatctacttaggccctactttctctgttggtatatcagagtggaaacagggttgaagttcatgtgtaaagatgtgtctaaatcttgtactggtattcatctctatcaatcctctggctcctgagatcagctacggaagtatacctaaaacaactcattcctctgtgtatctgctaaccttgaggaataaacttgacctctgtgacttcattttattttattttattttattttattttttcaagatggagtctcgctctgtcccctaggctggagtgcagtggtgtgatctcagttcgctgcaacttccacctcctgggttcaagcgattctcctgcctcagcctcctgagtagctgggattacaggtgtacgccaccacgcccagctaatttttgtatgtttagtagtagcggtgggtttcaccatgttggctaggctggtctcaaactcctgacctcaagtggtctgcccgcctcggcctcccaaagtgctgggattacaggtgtgagccaccgtgctccgctatctgtgacttcattttatttgtttttgttgactctattttagatagtgttttgacggtttgagtatttctcaattgtaactcatgagtggtgcaaaatctagccatcttttgatgggtgaggagcttctaaacacaagaatctgactttagtagtaagtgggagttaaaagactaattgtggggaggagtaattacaatttttctttatttttttaaatcaatactaggaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataaacaactagaaatctttatgttgaatggggacatctgttgaccttgattgaccatgattattatggtttttttagagacggagtcttgctgtgtttcccaggttggtcttgaacttctggcctcaagcgatgctcctgcttcagctaggattacagtcacgagccactgtgcccacctaaaactattttgagtgctttagtatgcgctaagcttatggctattattcattagaatggccagcatgttaaaaaatcagcttcaggccaggcacggtggctcatgcctataatcccagcacttttggaggccaaggtgggcagatcacctgaggtcaggagttcaagaccagtctggccaacatggtgaaacctcatcttcactaaaaacacaaaaattagccaggtgtcatggtgggcgcctgtagtcccagctactcgggaggctgaggcagaagaatcgcttgaactcgggaggcagaggttgcaataagctgagagctcatcactacactccaggctgggtgacagagcgagactccatctcaaaaaaaaaaaaaaaaaaagcttcacaagagcattcctaggagtaatgtgtagcaaagagtgagctgcgggagttgcccttcccgtggtcaccacagcggcttcattgctgccagtgtgaatgttggtcctagcaagactggaaagttgagagtaattcacgtccttgtcgtgatccgaagaatgttgtccacatcaatccctaggcctttgcttcctggctggacatggtgtgtggttgggagtgtccgctaagcagcactcttttagagcagaaggcatgtgcctcaacgatttcatttccctccttgtaaactggaacagcagattgttgccaaatttagcaccttgaaatgggtaagcgttggttgtttagggtgtctcagctggaaaaaggccctccagtgtgggcggtagtgagctttgctgaagactcgtgccactcagccgcttctcatcctctcaccaccccctctgctatggttccctgacaactaagaccctgaggcaaccacaagactgacaccagatctgctgcagcctcagaataaagcctggtccaaaactctgctgtcctcaccggttgcttcaagtcgaagggatttcctctcccctaaagaagcgctctgcttcctgacaaagatctaggagagtaggtggaaaagggggagtttcagagcaagcaaagatgaagttagttttcattctaacggctgatactttattgtctatagctgattgatgaagaggccttcaggagaacttgatagaattctattcatgttagttgtatttcagaacttgtgacagatcatagattcttgctttgtcacctgagttagatttgctcagcactcacttctaaacctcatctaggcactgaaagaaaaagagctggggaacgatgcctacaagaagaaagactttgacacagccttgaagcattacgacaaagccaaggagctggaccccactaacatgacttacattaccaatcaagcaggtgaggcccagaaacaaggggcaagggaattgttgggtgtctctgagggaggaagcaaagactgactgttccttcttaaccatcctgcctggcagcggtatactttgaaaagggcgactacaataagtgccgggagctttgtgagaaggccattgaagtggggagagaaaaccgagaagactatcgacagattgccaagtaggctcaaccttccagaataccttgagtagcgcggagggtttgctgtccaagacttaagtttctctgcatggggaggagggctgctggccatagaatctgctgtgttaagaaagggctggcaagaaggtcaccagagacaagacaaaaggtgttgaaggcagtgatgcgggcctttctagctgcaggtgtgtttttctgcaggagctgactttatctctctgtcctaagcagtccttgtccctctttctttatcagagcatatgctcgaattggcaactcctacttcaaagaagaaaagtacaaggatgccatccatttctataacaagtctctggcagagcaccgaaccccagatgtgctcaagaaatgccagcaggtgcgtaggaaaagaataggggtattttcttgttttcctaataattgagccattgtttcttactgttttatttaataatgaacttgacttttttttttttttttgagatagggtctcactctttcacccaggctgaaagacagtggcacaatcgtggctcactgcagcctcaacctcctgggcttcagtgatcttcccacctcagcctgagtagctaggattacaggcacgtgccaccacgtccagctaattttttttttgagatggagtctgtttgtcacccaggctggagtgcagtggcatggtgtctgctcactgcaacctccacctcccaggttcaagcaattctcctgcctcagcctcccgaattgctaagactacaggtgcacgccactatgcccggctaatttttgtatttttagtagagatggggtttcattatatggaccaggctggtctcaaactcctgacctcatgatccacccacctcaacctcccaaagtcctgggattacaggccactgcgcctggccacgtccagctaatttttttatttgtagagaaggggtctcactgtgttgcccaggttggtcttgaactcctgaactcaagtgatccgccctcctcagcctcccaaagtgctggaattataggcgtaagccactatgcctggctgaacctgatctttttttaggtagtggctttggtcatcttacatgattctttctctgtcatttaacagtgacaacatgtaggaagtgatctggtgtttttttttgtggtttttttttttttttttttttgcagtttttggtattggccaagatttcaaccctaaatgtgttaatattgagggcctgtgcattgagaatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcccgccaccacaccaggctaattttttatatttttagtagagacagggtttcaccatgttagccaggtatggtctcgatctcctgacctcgtgatccacccgcctcggcctcccaaagtgctgggatcacaggcgtgagccaccgcgcccggcccctaatgtgatttttaagcccaatatttagatgattatgagcgtttaaattattatttcaagaattatgttttgtaggcagagaaaatcctgaaggagcaagagcggctggcctacataaaccccgacctggctttggaggagaagaacaaaggcaacgagtgttttcagaaaggtactgcctgcagctgggggattgggggagcagtgctgggtgtgcctcccgtgcctggctgtggggtaaatggccggctacacatgggggctttttgctttttaaaagacagtctttgtttttcttccccaggggactatccccaggccatgaagcattatacagaagccatcaaaaggaacccgaaagatgccaaattatacagcaatcgagctgcctgctacaccaaactcctggagttccagctggcactcaaggtgacgagacctgtgggggcggccattactgaaagcctgcacatgaggagtgggttttctctctctctcctcatcaacattgagttgatgatgatcatgatgtttgagacagtgtctcactctgtcctgcctcagcctcctgaggagctaggaccacaggctcatgcctccacatcctgctacattttttattttttttgtagagttggggtcttgctgtgttgcccagatttataggggtgtgtgtgtgtatgtgtgtgtgcgtgtgtaaaatatgggacctgtatctaactggtcgtgtgtgtgtgtgtgtgtgtgtgtgtgtgtgtgtgtaaaatatgggacctgtatctatctaactggtcctggtccatggagtcactactggttggcagtacattggaaggtgggtcctttcacccctgtaaccttcctcttttttctttgtttttgcctttttaaccatttttaagaagtggaattgctgggtcatgtggtgtctgtgtttactttttttgttggtttgtttgagacagtctcactcagctgcccacactggagtgccgtggcacaatctcggctcactgcaaccaccatctcccgggtattttagtagaaacggggttttaccatgttggccaggctggccttgaattcctgacttcaggtgatccacccgcctcagcctcccaaagtgctaggattacaagcgtgaaccaccacgcttggccccctttttttaaaaaaaaaaaaaaaaaaagacaaggtctggctctatcgcccaggctggctggagtacagtggcacaatctcagctcactgcaacctctacttccctggcttaaaccatcctcccacctcagcctcctgagtagctgggactacaggtgtgcaccactgtacccagctaatttttgtattttttatagagacagggtttcaccatgttttcccaggctggtctcaaactcctgggctcaagcgagcctcctgccttggactcccaaagtgctgggattacaggcatgagccactgcgcccggcctatgttttatttttgaggaaccaccatatgtttttcagcagctgtaccatccttgcttgcttttctgttttgctcagctaggtaggtctgctgttctcagtcatatcaagttaggtcaaatacaattgtttgacactgtggagttcccataatcctctcgaatctcagccaccctgcctctatcagcagttttttttgactgttctctagctgacaaacctggaccgtattgtgggaaggtgacaaagtgtgacctgtctagaaacagccatacctgggtttgtgttggtttttatattttgtgccactgtcttctgggtctgtgtcttggcctagagacatcatttctactagtaggattgtgcaagagtcatgtcaaaagcatattgatttgtgaggcaaagaatagcaggttgtcaatcacctgggaggtgggcagtactttcccgatcatgagagcgtggagaaagaatgaatgggatttctgctgctgtcccagcttcttggtgcaagagttggaattaattccaggggagctcagtgtactgcatagtgttctcttcctcatcatttctcactttgaagatgtttcaaagagaagaatacatagtgaatatctggtgtatcttccacctttatctgacaaatgttgacctgtttttgctgaactgtttgcgaaaggaaattgtatacatttggtacttagaatgagacatccaagtcttgtgcacgcattgcctgaaaagactcctgtccagtgcagcactgtcagcacacgcgacctcaccagaccaaggcctgatgccatctgccgtctgtccatccatacttagacttgcccacttctccaaaaatatgttttaaaactgaggtttttttatttttgtttgtttgtttttatttttttttgagacagagtttcactcttgttgcccaggctggagtgcaatggcgtgatcttggctcactgcaacctctgcctcctggattcaagcgattctcttgcctcagtctcttgagtagctgggattattacaggtgcagccaccaggccagcaaatttttttttttttttttttttttttttagtagagatggggtttcaccatgttggccaggctggtgtcaaactcctgacctcaggtgatccacccaccttggccttccagagtgctgggattacaggcatgagccaccgcacccagcgttgttttgttttttagtcagcaatggttttggattccaaagctctcaggaccaaggcccacgcattttgtctagttgtcatgtactcttcagtttctcaaactggaattgtcccccgctatgtgtttttcataacatcagcctcttgcagagtccaggcagtttgtcttgtgtgggatgatccatcatctggagttgtctttcctgatgttgtcccctctgtttggtgctgggtgaggcattagagttggaagtccacatgcttgagttgcctgtactgagcttgtccaagggaatgagcctaatttctttctgttgcttcattctaggactgtgaggaatgtatccagctggagccgaccttcagtaagtgcctttctgctgcctgtcccctgtctctagccaaaagattagagaaggaaagggcaagccctttgtctacctgtgtgtccttgggacctgtaggatttaggatccaacatcagcaggtgtgaacagtgttggtgtgcaggtgaagaggtgcaaggagcagccttgggcgctgcggttggataacgcgccacctttcctgtttgtagtcaagggttatacacggaaagccgctgcgctggaagcgatgaaggactacaccaaagccatggatgtgtaccagaaggcgctagacctggactccagctgtaaggtggggctgcttctggcctccaggggccccccctgcctctttctctgttggggcttttccatgttcagtccctgatttcttccctgtcacctccatttctctctgtttctctcttacttgttctctctccccttgtcagttacctctgttatcttggacctgctgaagcagtgagctgggtggtcctaacacgcttcacctttgtctcttctggactgcaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttatatgttgctttggccttgagtgattttttttttttttttaaaccaggagtttgtcttgcaggggctgctcctggaacctgatcttgctcttctctttggggcgggcttaggaggagtcccaagctgtggcttggcacagctccatggctttgccaagaaggttgccagatggcgctgttgctcagcagctggaagggaatctgaaggcttccccaccccaagtagtaccaatgagaggttcagataagctttgggtgctgttaattctccacgttatagtggagatccagagaacaggattctaatgtgagatgctgagacctctgtggggagagggcagctatgctgttagctgctgttagatttaggagttgggtcatggattgtttttgttttgttatttgagatggagtctcaggctggagtgcagtggtgtgatctcggctcactgcaacctccacctcctgggttcaaacgcttctcctacctcagcctccccagtagctgggattacaggagcctgctaccacacccagctaattattatattttagtggagacaggtgtttcgccatattggccaggctagtctcgaactcctgacctcaagtgatccacccgcctcaacctcccaaagtgctgggattacaggcatgagccactgcaccccactgggtgatgggttttttttgtttgtattttttgagatggtgtctctctctgtcgcccaggctggagtgcagtggcgtgatccagctcactgcaagctctgcctcccgggttcacgccattctcctgcctcagtctcccgagtagctgggactacaggcgcccgccaccacgcccggctaattttttgtttgtttgtttgtttgtatttttagtagagacggggtttcaccgtgttagccaggatggtctcaatctcctgacctcgtgatccacccgcctggacttcccaaagtgctggggttaacaggcgtgagccaccgcgcccggcctgggtgatggttttaatgcacggctcttacctgagaacttagggtgctaagctttaattacacttttccatggttgcaacaagctgcgttttctaaagctctcttcctggactggggaggcctttggggcaggagtaaaacttcctcatttgctccaagagtgctgctttctgggctaggaaggcgctgagactagcagctggctggacttcctgctgttagtttcatcagctttcttttcccctgggaatccccggcaggccgcccccttccccatctgagtggcgatgctcaggtagcctcccccattggcaggactctgccgcccccaggcttgcccaccctgcatgctccaaccccagtgtgttcactggaaaggccgctgtcctgcgcagagctggtggcggacgtgccttgctctactgaagtccacatcctagggcaggtgatgagcaggagggtatagaccaccagagacccctgaggtgtcacctaagcagggacttgatgggagtgagcctcgtggggactcggggaggctcatccaagtggagcacagtggaggggtcgtgtttggagctgggtgacctgagggcccgggaggttgtggatggtctgggccaagtactgttcacttgttcacctggcaggtctgagttcatgagtttgaaggtagccctacgcggagctaggaaaaactgcaaaatggacttgtttccctctggggccttgagggatccttggttgatagggatagccaggctggagccgatttaacctgtgagtcccaaataacctggatacactctgtcgactcctgggctctccctccggcagcccagtgatgtttcaaagcccaaggtccccacctcatgtgacaggctgaggatggcagacacttcccacaaaagtggacctagccctgaacacacacagccgggggacttgttgagtttgcactgagcttccctccaaatgaggaagggggcgtttttatggtg

SEQ ID NO: 13291 - DNA, 18008 bp, Human
acagagagacccttgcccttggggaacacaggcagcctgggccccaggcccctcactcaggggcatggaagggcagtctcttttctccaggacagaccggataggggttgggggtgtctcctccctgggcctaccccagagccaaggatggggggatgcagaggcccaaggagaggactccctggcctcggtcgttcatgtcgtcctgggtggagggggagagccggctgatacccgtcgggtcagggcagcggccgctgcgaggggcgcccaatgccccgctctccccctccccaagctgggggaggctctctctcctccaataatgcggatggggagggcctctgcctcctgtcctcgtaattctcgaaagctgcccccgccccaccctcccccaccgcgtccacgctccagcctcaaggggagggaggaggcggacgccaggtcctcaggccgctgatgggagagccggctcaggtcgtggggacccggggctccggctccccggctcccgctgctccgcccccctccccctccgcgcctgcgcgggcgccgttcgctacgcaaattgcgcagcggcccggctggctccgcagtccagcgccgcacccggcgtgaaaccgtacgagaattggcgcgagctgcgccgctggcgggcgcccggggttacgggaggcggcaggagggcggccgagttgcgggggccgtgccgcatccagggggtccccgggtgggccgtgccccgtgccgcccgcctttacttgtatgggggtccgccagttcccacgctcgtctctcctatacccaaatcggggtcgtgccgcccggccgggggcggcaacggattcccgtccctcggtctctgaagaaaacttccgcccatagccaagatggcccccgggccccgcccccgggcctgaacccgcggagccccgaatcccccgcgcgggcccgcccctcgccccggcgcgcccgcggccctgctcacctggccggccgcctgccaggcgtgaagcccccacgggccctacggtcctccctcaccgggtccccggccctcctcccgcgcccgggcagccatcccagccagggaggaggttcctttccttatctccagtgcccccgagatggcgcgggaggtgtcccccgaggcgggcggcgcgaagcttccgcgcctgggaggaggagcggggagcgggactttccgaccgggcacccagtccaggcggagcggtaacaatagcaacaataatcacatccgacggctgagcttcagttgtggctgtgccaagcgccttcgcccgcagtaatcactcccttcacaaagttttcactggctcccgggggagctgtcactatccccacttcactggggggaaactaaggcccagaggggctgaaggacttgttggcagaagtgggtctccaggttccaaatggggaccccagagaatccctctcctgctcccacacacgcccaaggtgtgaggcagcgaggatgtgagccccggggccgaaggagggaggaaaaaggctgcggacgaggagccttggatccggcgggggggcggggccgggccgggttgaccccgcctctggacctacccgagtgacgttccgagaggtgattgggccaggtcgctgacagttcccgttgcccaagcaactagggcccggagcccggggtgctggagggaggcggcaggcccgggtcaggggcctcgagatcgggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggtaagtaccccaccacctccacctgccgggacacctcacccccagcccactggctccctgcatcccagttgcatccacaggcactgaatgctttgggtcggtccccaaactctcagagccccagtttcctctttcgtaaaacagcaattaataaccaccattgtaggactgttgagttaattagcaggaacatataggatgcacttgattacagagctggtgcacattaaagctaaaaaatggttgctgccgggcgtggtggctcacacctgtaatctcagcactttgggaggccaaggcaggaggatcgcttgagcccagaagttcaaggccagcctgagtgacttagggagactccagctcttaaaatacatatatatatatatagcagctattagtgtggggttaggacagaaatcagtgacaggcaggcagtgatccgaaaaggaaaaggggcctgcctaaggccacaccttcctggtgtttctttccttagaatgtgggggctggaagcctccttggtgccctgccccaggctacatgctttccctgggattaggccttccagctcccagatgtgttctttcttgccctgtggctcgtacccacagcaggactgtcctggcacagtggccaggggcagatgacctcaaggggcagacagtcctcccagacagcagggctgtgtggggtgagaagcacaggctccaagatggaaggatggacactggggttctatgtccatttctcagtaggctctagcacccctgtgcccagcactggccttggcacctggaacaacaacagatatcttctgaacacaaaaaccaggtcaagctgggtggggtggcacatgtctgtagtcccagcaactcaggaggctggcttgagcccaggaattcaagaccagcctgggcaacatagccagaccccatctctaaaaatagaaaactaggtcatgtcactctggcactgcagcttaaaagacctcctccccattttcaggattaagaaggcttaagaggcctctttcccctcgctctcttacggataaacacccacactcgattctctcagattggaccccatagcttgctttctttttttctgtttgttttgttttgttttgagacagggtctcgctctatcacccaggagggagtacagaggtgcgatctcagctcactgcagcccggaacttctgggcttaagtgatcctcccacgtaactgggaatacaggtgtgtggaccacacccagttaatttattttttactttttctttttttttttttttttttcctgagacggagtctcactctgctgcccaggctggggtgcagtggtgcaatctcggctcactgcaacctctgcctcctgggttcaagcagttctcctgcctcagcctccagagtagctgggactacaggcgcgtgtcaccatgccgggctaatttcttgtatttttattagagatggggtttcaccgtgttagccagggtggtctccatttcctgacctcgtaatccacccgcctcagcctcccaacagtgttgggattacaggcgtgagccaccatgcccagcatttttcacattttcatgagatgagggcaggggcggggtctccttttgttgcccaggcaggcctcaaactcctgggctcaaacgatcctcctgcctcagcctccagaacagctgggaccacaggtgcatgccaccacaccagctcattttttattttttgtagaggtggggtcttgctttgttgcccagtcttgtctcgaattcctgggcccaagcaatcctctcaccttggcctcccagactgttgagattactggcgtgagccaccatgctcagcctccacagctttctttaacttcctgagcttgcacttggccatttttctgctcacaaacttcccctgctctctgccccccacacacactcagcattcactcgcgccacacagtgagtgctcaccgtgtgacacaggctgttccagttgctagggggcctcggtgaacccaagcgtcaggaatccttgcccttgtggagcttaccttctagtgagctggtggggccatgagcaaacaagcacaaaagcatcctatcatgcgtgagaagatttgtatgggggcagcatgtaaaagagttaagagaggccgggcgcggtggctcacgcctgtaattccaacactttgggaggcctaggtgggcgtatcacaaggtgaagagatggagaccatcctggccaacatggtgaaaccccatctctaccaaaaatacaaaaattagctgggcatggtggcgcgcacctatagtcccagctactcgggaggctgaggcaggagaatcgcttgaacccgggaggcggaggttgcagtgagccaagatcgtgccactgcactccagcctggcgacagagtgagactcatctcaaaaaaaagagttaagagaatccggagtcacaggggcggggggagtgatggtagcagaggtggtcagcactcaccttggtgagaagcaccactggagccaaggccacagggatgatgggaagagagttccaggcagagagaagggcagatggtaaggcctcgagggcaacacctgctcctggctagggtgggcctaggggagggggtttaggaaagggtatttggagacctaaagttgaaggtcattctaaggactctggcattgcctttgagtaaaaacctggaaaggatttgagcagaagcagcatggtcagatttagacattcagagagtcaccagggaggtggtgagaagtagctgatccctggatttatttttaaagcagaactggcaggatctgctgatggactggatgtggggtgcgagggaaagagaggagtcaggatgatgccaaggaattttaaaaaaactattaggctgggcgcggtggctcacgcctataatcccagcactttggtagttcgaggtgggcagatcatgaggtcaggagatagagaccattctggctaacacggtgaaccccgtctccactaaaaatacaaaaaattctctgggcgtggtggtgggcgcctgtagtcccagctactctggaggctgaggcaggagaatggcgtgagcccgggaggcggagcttgcagtgagcagagattgcaccactgcactccagcctgggtgacagagcaagattccgtctcaaaaaaaaaattattattggccgggcgtggtggctcacacctgtaatcccagcacatcgggaggctgaggcaggcagatcacttgaggtcaggagttcaagaacagcctggccaacttggtgaaatcctgtctctactacaaatacacaaattagctggatgtggtggtgggcgcctgtaatcccagctacctgagaggctgaggcaggagaatcacttgaacccaggaggtggaggtcgcagtgagctgaaatcctgccactgcactccagcctgggtgacagagcaagagtccgtctcaaaaaacaaaaaataaataaaaataaaataaattaggccaggcgcggtggctcacgcctgtaatcccagcactttgggaggccgaggcgggcggatcacgaggtcaggagatcaagaccatcctggctaacatggtgaaaccccgtctctactaaaaatacaaaaaattagccgggcgtggtggtgggtgcctatagtcccagctactcgggaggctgaggcaggagaatggcatgaacccgggaggcagagcttgcagtgagccgagatggtgccactgcactccagcctgggcgacagagcaagactccgtctcaaaaaaaaaaattattattattattattattattattattttatttttgacatggagtcttgctctgtcgcccaggctggagtgcagtggcaccatctcagctcactgcaagctctgcctcccgggttcacgccattctcctgcctcagcctccagagtagctcggactacagcctcccgccaccatgcccagctaatttttttgtgtgtttttagtagagatggggtttcaccatgttagccaggatggtctcgatctcctgaccttgtgatccgcccgccttggcctcccaaagtgctgggattacaggcgtgagccaccgcgcctggccaaattattattaattttagagacaaggtcttgctatgttggccaggctggtcttgagctcctggccccaagtgatcctcccaccttggcctcacaaagtgctgggattacaggcatgagccacagtgcccagccaacaccaaggaatctggcttgagcacccggtaggatgaagttgcttttaatggagaagaaacactgaagggtgagggaggatctggaggctaccctagagggtgggatagagggggatttttttttttttttttttttgagatagagtcttactctgtcacccaggctggagtgcagtggcacgatctcggctcactgcaacttccacctcctgggttcacgccattctcctgcctgagcctccccagtagctgggattacaggcatgcaccatgcccagctaatttttgtgtttttagtggagacgggggtttcaccatgttggccaggctggtctcgaattcctgacctcgtgatccacccgcctcagcctcccaaaatgctgggattacaggcatgagccaccgcgtctggccgctagaggtggcttttaagcatctggtgggatttttagcagggtgctagtgggagctggcagggacttggagtctgaaccagagttgtgcttgtctcagtccagttaggggtaggggcttcaggtgtgtgcaaaggaaggaatggtagatgtggggtccaagctggctgagcttcagggaagggagcaagccctgggaagccgcagcatcgttggagttggggtcccgggggcatgatccacacaggttgggtcagctggtgggaagcttgggatggagttatttgatggtgacaaggcctaggttatgtccctgggaatgagtctgaggggagagtgggacaagatcatggtagaaggagtagcaaggtacagaaaggagacagggtgctggtggagtggcagaggacaggagtaacattctgcacaggccagggacgacacctccccccagccccagctgcagacccgtaggaaagagggctgcgggagaagacagctgccaggtgaggacagagctggatttcttaaccttttgatttagttttcagtgtctccaaaagcaagtggtttcccagaaaagatcagcaagtgccagtgccccgccagagccacggggcctctgccctctctacctgcgcagagcaactcacacttggttcggtcactcctcatagtccctgccaccaggcccccctgctggatggctgaggtgtccccagggcagggactgcagccaccttgtgctgtgacagcccacacagcccagtgtctgaaacaggtgtggacagtggagaggcagaaagaagcagcccagtgctagcccctgggccagactgcagggttcaaacgtggctctacccttcctagcaggttgagcttgagcaggttaattaactccatctgcctgagtttcctcatctgtaaacgggaatagaactagtcccacctcgcagggctgtggcgaggacctgatgagttaatataggaaaagtgcttggaaacagtgcctggcgcagaggaggggctaagtgtttgcggctcttattattagaactgccattgttattatttatgtatatatatatttatatataaatatatatatataatttttttttccaagatggagcctcactctgtcgcccaggctggagtgcagtggtgcaatctcgcctcgcagcaacctctacctcccaggttcaagtgattttcttgcctttatgtacattcttggctttatatatttataaagcctcaaatttctgggctccagccatcctcccacctcagcttcctaagtagctgggactacaggcgcacgccaccatgcctggctaatttttttattttaatttttgtagagacaagggtctttctgtgttgctcaggctggtctcgaactcctggcctcaagcagtccttttgccttggcctcccaaagtgttgggattacaggcatgagccaccacattgggcctatatttttaagttatggacaaaaatccaaagaactatattttgtaacgtgaacattctatgaaattcaaatttcaaggtccctaaagaaagtgttagtggaacacagcaaggtgcagtgtattcatttacacattgattatggtttcctttcagctctggccacaaaggtgagtggttgtcacagagaccacgtggcccactgaaccccctttatagaaaacattttcagctaacttaggaaaagggaaaagaaagtgaacaaacatttgccagccagcctttcatacctgtaatcccagcactctgggaggccaaggcaggaggatcacttgagctcaggagttcgagaccagcctgggcaagatggcaagacacttctctaaaaattttttaaattaaaaaattagccgggcatggtgatgcctgtagtccaagctactcaggaggctgaggtgggaagatcgattgcgcctaggattttgaggctgcagtaagctgagatcgtgccaccccactccagtctgggtgacagagagagaccctgtcgctgttttttaaaaacaaaaaggaaacatttgccaactttagagtactttctgattttatgagctctgagcaaggttgggggtgttctctgcaggcctgaaggggcttctgtaccggaaggctatagtcaaggctgaggcctacaggtgccggaggcggacaggctgcgagtgtctgcccagggtggggtggcagcactggccactgtgctggccactgacgtcagcctcccccggcagcagattgtgtgtggtcggcatgtggtaggggcaggatccaaacccagcccttgcctgatggcagagcttcactgctccaaacggtctggaacaccactgttttaattaagtgtgcaattcagtgtgcaagtgtcttgtaattaagtgtgcctctgtttcctcatctataaaacagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggtgccatgctggggcctggggcacttctagccacagccactaccctccacttccacacccagctccgggccaggctctaggcggatggcaagagtgggcaggcctgggcacccacccacgttcacacccaaggaggagccacaccccttcccttccccagagaagggagagtctggcccaggccctgccccagccctctccttcccccagggaattcacagacactcccccagggtttttccctgtaaatagaacactttttaaaaattcaatttagggctgggcaccgtggctcacgcctgtaatcccagcactttggggggccgaggcacttggattgcctgaggtcaggagttaaagaccagcccgaccaacatggtgaaaccccgtctctactaaaaatacaaaaattagctgggcatggtggcgggcacctgtaatcccagctacccaggaggctgaggcaggagaatcatttgaacctggtgagcagaggttgcagtgagccaagatcacatcactgtactccagcctgggtgacaaagcaagactccctctaaaaaaaaaaaaatacatatatatatatatacacacacacacacacatacatacacacacaaatatatacacacacacacacataaatatatgtatatttgtatttacatatatataattcaatttacacaaatgggtatcatcttgataacaactagcttggctaagtccacgaatttggtgaaaaactcccaccccataggacaggttcctggcagaactggtgctagcagaaggcccaaaggggccttccccagcctaggcctccaaggcagcccaaggtacagctggaaggagcctggggcatgacagctaagcacacagcccctgaagccacattggttgggttgggatcccagctctgctacctactagatcagtgaccttgggcaagttacctatgctctctgccttagtttcttcctctgtaaaatggcaaccatgaggaacctccctgatagggtgtggcaaggatcaaatgaatgaatacacagggagggcttccgaccatccaccatacctgcccagtgtcttctgcttgttctgatccctgggcaaggggcagtgcccaggccaagtgcctgggtgcaagtcactcaccttccacctgtggggccttgtgtccggcaagcgtagtggtcctgtggccccactcagagctagtggaggagaacagctgccgtttcctgcgtatttaggtggctaagcaggctgtcccagccacacggcctcaggcaagttcttaacctctgcctctgtttcctcatctgtacaacagggagagctggatattcacctggctgggactctcagaggcctcaggctatgaggggccggtagggggctttcctgctctcatttgttgtcatggcgatcctggcagatggggaactgcccccatttcacagaagacactggggccccaaagggttggagaatgggctaaggtcagagcaggaatgtggccagggcctggcccacctagctgacccctgctccacagtcaccgcaccacagaactggaaattactctgcagacaggcctgttccgtcagtgccccttctgttcccggctctcctgcccctatccgaaatccttcagcctcccaaggtgctgggattataggcatgagccgccacgcctggctgtcatctgtaatctttactcctgacctagtatgcctctccccactgccacctcactcctccagggtcttgaggtatccccacctgacctgggggcagctctgggctttggtgatgctcagaatgcccaggcactctgatcacagcctatcttaccctaggcctttccggattccgtcctctcgttcccttactcgcttttttttttttttttttttttgagacaaagtctcactctgtctcccagactgccagactggagtgcaatggtgagatctcagctcactgcaacctccgcctcccaggttcaagtgattcttgtgccttaacctccctagtagctgggactacaggcccacaccaccatgcctggctagtttctttttttttttgagacagagtctcactctgccacccaggctggagtgcagtggtgcaatctcggctcactgcaacctctgcctcctgggttcaagtgattctcccgcctcagcctcctgagtagctgggattacaggctcgcgccaccacacctggctaatttttgtatttttagtagagacagggtttcaccatgtgggtcaggctggtctcgaactcctgacctcgtgatccacctgccttgggctcccaaagtgctgggattacaggcgtgagccaccacacctggcctttttttgtatttttagtagagatgggtttttgccatgttgggtcaggctgatctcgaactcctggcctcaagtgatccacctgccttggcctcccaaagtgttgggattactggcgtgagccactgcgcctacttgctttttttttttttctcgaggtagagtttcactctgtcacccaggctggagtgcagtggcgtgatctcagctcactgcaagctccgcctcccgggttcacgccattgtcctgcctcaccctcccgagtagctggaactaaggcgccagccaccatgcccagctaattttttgtacttttagtacagatggggtttcaccgtgttaggatggtctcgatctcctgacctcgtgatgcgcctgcctcggcctcccaaagtgttgggattaaaggcgtaagccaccgcacccggccacctacttgctttcttagtcatgtgtctcatttatgtgtcctagctgggacccctggaggccctgcactggcccacaggccaggtcctcaggtcctctgaggggagaagagacattccaatggttatcccccgccttcagttcctggcctgtaatttacctcctccaaagagcctccctgacagacatatcttgccataaacacccagcatgtttccctacctgcctctctttttttttttttttttttttttttttgagatgggtgcagtggcgtgatcttggctcactgtaacctctgctgcccaggttcaagcgattcttctgcttcagcctcccgagtagctgggattacaggtgcctgccaccgcgcctggctaatttttttgtatttttagtagagacggggttttaccatcttggtcagtctggtcttaaactcctgacctcgtgatctccccaacctcggcctcccaaagtgctgggattacaggcgtgagccactgcgcccagccccccacctgcttctcactctgtcattgcactctgagtgtttgctcaggggagtggttctaagtctttatcggtctgggtagaggagtggagttggcaggagttgggagatggcacagagcacagttcaaatagaccatagtaggcgggcctctgaataataacccatagtgcacttgcagcctacaaagcactttcttttttcttttgttattattattattatttgagacagagtctcgctctgccacccaggctggagtgcagtggcacaatctcggctcactgcaacctccacccactgggttaaagcagttctcctgcttcagcctcctgagtggctgggactacaggcgtgaaccaccacacctaactaatttttgtatttttagtagagacggagtttcaccagagtttgaggccaggctggtctcgaacttctgacctcaggtgatccacctgccttggcctcccaaagtgctgggattactggcgtgagccaccacgtctggccttcttttattaattttttaaattaatagagatggggttttgcaatgttgcctaggctggtctcgaactcctgaactcaagcaatccacctgcctcagcctcccaaagtgctgggattacaggcgtgaggaatcacgcccagccacaaagcactttcacattttttaattttatgtgatgttcacacagccactgggagtcagggctaggattatcccctcataaaggtgaggacacaggctaagagagtcgaaggctggctagacaaggggagagacacagagctccgctgatcatcactggactctggattccaccaaacctttggaaccttccagcctcaggcctccacagcttcacagaaactgggcaagtcttaactctctaagcttctgtcttctcacctaagcatgtttggtactcacctcccagggtggttaggaggataataagggaatgtctcggcctacacgtaagtgcaccatcaatggtacctaaaaacgtcaacagttccagacactgtctccagagaaggctctgtgggggatgcggacatgtagcggccaagttcttgttctccaggggctctgcaggtcccttgcagaggaggcattcaatcctgccggctgtggcaggacactttcctatccaagggattggcttcctccgatgtagaacagacactatgaaatagctaccaacccaggggttgccaggaggccccatgaaggtcttgcactaataatacttcttgctttttttttttttcttttgagaaaaaaagcctgtcgcccaggctggagtgcagtggcgtgatctcggctcactgcgacctctccctcctgggttcaaacgattcttctgcctcagcctcccgagtaactgggactataggcacgtgccactatgcccagctaatttttgtgttttgagtagagacagggtttcaccatgttggccaggatggtctcgatctcctgaccttgtgatgtaactagtatttcttatgcccttattttgtgctaggcacagggcctcacccattattggcactcggtaaggattcgtgggattaatgagaagttaacctaaatcttcaccaaaggcccctgagcttcccctcgattcacatacaagggactggggctctgagaggtgggctgtgatgcgcccctggaagacccacgagtgggcctgcagagctgatggggagggttcaggcagggccaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaaggtgagcgccagtccccagcgtgccaggacctgaagtaccaggccgccccccgccggtctgtccctgccttgtcccaaggcacgcccggatctggagtcccacgacccctccccaaagccgtcctgttccttcctagctccagagcattctgggatttgtagtcacaagacttccccgcccccactccccagctcttcccccgcctggtgtgtgtgtgtgtgtgtgtgtgtgtgagtcacagggcatgctgggatctgtagtctagatcccactccaggcgtgtgtgtgtgtgtgtgtgtgtgtgtgtgtgagtcacagggcatgctgggatctgtagtctagatcccactccaggcgtgtggtgtgtgtgtgtgtgtgtgtgtgtgtgtgtgtgtgtcagtcacagggcatgctgggatctgtagtctagatcccactccaggcgtgtgtgtgtgtgtgtgtgtgtgtgtgtgtgtcacagggcatgctgggatctgtagtctagatcccactccaggcgtgtgtgtgtgtgtgtgtgtgtgtgtgtctcacagggcatgctgggatctgtagtctagatcccactccaggccaaagctcctgggttccccgaattcttggaagaccaggcatgctggtatttgtgctccttgctggcacctgtgcgctctgtcgcccaggctggagtgcagtggtgcgatcacggctcactgcagcctggaactcctggcctcaaaggatcctcccgcttcaacctcccaaagtgctgggattacaggcgctcaccatcgctcccggccctttgattctcgaattgcggtctcatcttctgggtgctaggtctccagctctggcctttccatttagggccctaggcatcctctcttcccgtctccggcacggagttcctgggatctaaccagttcccattcctgggggcccatgcgtcctcgcgagcgtccctgaccgcccggcgtggagcctcctgggagttgtggccttcattatctcccccccgatctcacttagaggaaggctcacggaagtggagagcctggctcgagctgccatggtaatctaactcatgtaacccttttctccctccaccagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgccgaggcttttctgtgcgtcgactggggctccggcaggccggggtagtgctctcacggatactttcaaaagaggccgctgtcttacgagggaaacttaggctctgcctgacatccagcgacagagacggaaggggtcgcggcggctcgcgggcctgggctgcgcggcccaggtccaagtccccagcacgcgcattgggaccgcagcgctgccggcagcccgatcccgcgctctgcaaaccgtgccgcggccccccagagagggtcactcgctcctatttgggtcagccctttccagcagctactgtgtggccggcccggggccagcgccgcccgggtacctcgcggggcgggagggagcggctgagccaggctggcagcagcgcggtcgctggaaactgaggcttcatgcggggacccggacagagcgggggctccgttccagaaagatttattggcgccccctataacccgggccggttcttggtgccgggcacagagatgcattgcgccacggccctgctcgcggaagctcccgagggcccggaatcggcagggcagtcagagagggcttcagggaggaggcagctagagctgcgaccggaaggtgaggtgagggtcatcccccccggcgcaaggaggagtggacccatggaaggacaggggagcagcagaggccaggcttctaggggctggaatgtcacacccagaagttagacattcagctggtatttgaggacctgggaactgacttggagtgtgtccctcagtggacaccagctagagtcaggaaggtgggagttggctgctgaggagcctagatacggaatacactggagtgagcagaactgggggatagggcagcgtcccacagaagaagtgaggaagtctggggccattgcattgaccctgagggaggagggccctactccggagcctgtttccctggcctccccaccccatctgtttgcctgaggctgcagcaaaaacaaagcaaagaagatactcaattggcaggagataagcccagataagaggccgccttcccctggaggagggatgcaggcgggcagcctgggaagagccaggaagctgggagaggccttgaagaggtgccaagccgaccctgctgcgagcccagccccgccctggagcccgcactgtgggctctctgccacttttcgctggtcttgaggcatgggacaggtccaggctggctgaagacagtccaccacggagggtccaggcctgccctgcctccaggtcaggacgtcttgacttagctgtggcctagcacacgacagatggctccgggcctcagtctcctcatctgtaaaacaggcataacatctccctcacagggatgaggggatgctgggtggcccagcccctgcgtgtctgtgactgtccacttcccttcccccagagtcacaggcaggcctactgcccacctatttctgaagacccaggtcccccggtgttgggcaggttctgagctgccctgctccaccctggccgatccatcacctgatagagtcaactgcctgtcgggggcccagagcagccccagcggaagatgctaggcgtttgggtcatatcaggccacaggaagcggggcagggaagg
